United States Patent 10,233,495 (METHODS AND COMPOSITIONS FOR SCREENING AND TREATING DEVELOPMENTAL DISORDERS) - sequence listing, part 136

SEQ ID NO: 649 - DNA, 3322338 bp, Homo sapiens (residues 1,661,170-3,322,338 of 3,322,338)
ttggtgctgaggacgaggggcctcgctttactaggaggccctgccctgagccggggtcggcctcccttgtggctgccttcctgaggcaccctctctcctgcaccccagacatggtcctggcctccaggagggataggtgagcagggagcccagggagctggtcaatcctgggaacgtgtggggagtgtcccgaggcctccttgaggagaagggttttttccatccccctcaactcttggagaggatgagggtctgtctgatgccaggtgtgatcctagggccatgggccttgtataattttattgtggacagtttaggccctgtaacccttccttatctctttattaaatgctaaacaggatggttaaaaaccccacaaaagtcaaaaccgtgcagaggggtgtaaaatggaagtgaaacctctcccgaaccccactcctactctctctccagaggcaacaatcgttacctgttgcttgtgtctgtcccaggaaaggtccccgccttcataagcataaaccttctctgcaaaggccaacggggctgtgccgcacactgcgtgcccgtccctgtcccgggtccacctgccgtccatccactgtcgccaaggatgaagagacgattggccattcctacccagccggtttccactactaaagacacctctggcaagtgttcagtttccgtgggagcgtgtctggggtgcctcccagctcttgccctgcacactgaagggacgtggatgggggtggggtgggctctggagggactggtctgcctccgggtaccgtccacctcgtcacacatgaagacacgaaggtgcggagaggtggggggcggggctcttgaccagcaccagcaggctggggagagatggcggtatggagggccctgggctccaagcacccagggaaggaatctgagcactcaagccccatgtcctcctccctccctgaaacattgctgcgtgtggtctgaatggaagccgagttccggcaattaatcccatcagaggggccctgctgaatggtaggaggtttttttctgttttgctcccttggtctagatttccctggggacagctctgaccagccgccgcgtgcctggtaaattaaatgttaaaaaaaatccccacaatgactttaatcaatccactgacatggcgggtggcctcccagaagcccttggtccgctgaagggagcccccccctccccgccccaggctcagggtcttggatgagacaggatgggggaagaggacagtcttccccagtccccttcctgtgggggagggaggagggtgggtggtccccagagtgtcctcctggagagggacagagagaaaggggggactctggccccctttataacttgccctgatcccaggccaggagtgatggtggacgcagggagggggcagctcttccccgcctctctcctgaccagaagcctgggtgagtacagagcaggtggtcacgatcggccatgtggtcagcaaatccagcgtttatggtgattctgttggagacaaatggcagtgctgggctctgggttggagtcaggttgagacaacgtccttcagcctccactggggggagtcaggggaaggaccgggggagcaggacggccttgcggcgccgccggagcagtggggttgtggggcgtggccatggtccttcccaggggagagtagaggagtgcagggggcagagagcacagaaagtctagcccagccttagcaccccagccaggccataggtgcgcgctggcgccgctgaaaacgttctccttccctcgcctgtccaccttccaggtcctgctcaaggcgcctaatatcccctgggcagggtccctgacacttccttaactcccaaagaccttccgcgtgggcctagcgcatttaggcgaacctctctgcctgcttgatcctctcccttcctccctcaagccaggcatctcacccacttgcgcgcgaggctggggcagcccacaggaggagcgcgggacccgggcttgagtttgcacccaggcagagcgcccacccccgcccctagcttcggaccctgaaagtaaagtcgtcgtgcccggcagccagcccgaatcttccagccctcagggagtcggggtcggggcagggaaggccacgggtggcggcacaatcgggatcctggagtggaggcgcagactgcgggtcccgctgcgcacgctccgtggtccggttggggtgggccttggaggtccataggccaaggttgaacgggggctctggagcgtgggcggggtggagtgcacaggtcactgggctctgagcgtttccatgggccaggaccccaacgcgccgtgtcctcaggacagattggagggggaaggggctgcgattatgccccagtcggaagggttttacagcagccgcgctgccctctccctgccggatacccggcagtagacaccgacgtctgggggctagcgaggcaggtgggcgcggaccgcgacccgattctggcttccaacctccgcccagtggcgcgcggggccgtcgccccacacctccagtccgcgtggctggtgtctggctcgccgccggggcggaaggggcgctgtcggcgcaggcgggcggggccggagcgcgggggcgcgcggcgcggagcgagcgcagggctcgggggcgcggggcgcggaggaccgggggcttgacgggcggccctgcgcggtgcggggcgcggcggcggcgggcgcgcggccagtgaacgcgcgggcggggcggcggtggcgggaggcactaggggccgctccccgcgcttccctcttccatggcgctgccccagccgcccgagccgccccgcggcgcgccccgcaaggctcccagcctgctggagatgggggcgctctgcctggactcggagatcatcctgggcttcaccagccacctcctgcggcgacgaggcaaggtgagggctgtcgggaggggggcgggcggcgtaggcgccgtcccgttactttgccgcgcggctcgcgcggccgggggtgctgcgccgggaaggagacggcaggtccggagccgcgtcccgcagcccgggctgggactcgctgccgcactttcccccattagcgttgtccaagtctccctctgccttcaaggctgtgtcccaaccggacccacccggaggctgtggctagggcggagagcgcagcgcagggattctcgggctcaccttgcgccttgctaggatgggcgaagtagggggtcggggcccctgactgatcgtgagcccccgaggtgactccagccttgtgcaccccgtgttctgcggatatgggatgtgagcttgtgcttcccgaagcgccgcggcggtagaagcgctgaagttgcgggtgtggctggccaggggcgcaggaccggtgctcccgaccgctgcgtgcttctgtgttgcgtgtgtgggtggggggacgggatatagagagtgtgtgtcccggagcagtggagcggcgggaggcggtgctgtctgccggcagtgcggggtggggtttgggtgttgtcctcagtacccagatccagatgtgggctgacgcccgttttcattctccaggctgcgaagagacgggtaggggaagcgcttccggccccccaggctgggtggaaagcgactgcaggcttacggatctcagaaagagtggagagcccctgccactttattccatacccccttgcgttttcgaacccctaaggtcatcaacgacccggaaagccgggaggggatcacccaccccactttctggggagtgcgtgcgtgggcggggaggcttatccaagtaaaagggggtgggcaaaacggaaagggtcactttgacgtactgagtctctgcgaaggcctcaccgtatgtgccggcagccgcgtgtcctggtctccgccgggtcacgaccttcggagtttccgagtgcgcctcaggcctgggacgcgcggcgctgtctccccagtctcggagccgtgtgcgcagcggccggcagggggcactcgcgtcacggggagcccgcccgccgcgcccgcctggcttgacccgggctttggggctgacccggagcctggcccggagctgcctgcggccgcggatgccggcgacatttggggcccggctaggcacagagcaactggtcgccagggaagggcgggggggcggcctcccagccggagacaaacaagcaattaattccggagctgagttcccatctgccaggcctgctgacaacaggtccggcgcacgcccgcaggacctcccgcttcccgggcggcacggcgcgcacacccacttgcgggcacacgcgcggctgtaaagacacgtgccgttcgcagacgcgccgaggcacagatacgccggcgcggtcgctgcccggctcgaggcgcacaccgcggcgacactaacccacgcgcgacagttagacctaaagtggcccgcgacacgcagagtacgctgggcttgctggaaaggcgcctgggagtctcggggccggggtcccgccccttcctcggcccacctcgccgtgggccttgggcaagagcgtcccctccgcagcctcagttttcccgcctgtagagggaggggcgtcggcgcctcctgggagacgcgcagccctggtgtcccgggagaggggcgggaggcgcatgcgcgcgcgcaactagatcctcgccgccgcccccagcgcccctccccggggcagggactcacctaacaggttggggtccttggagtgcgcggggccgcgtggggaagcggggaccctaccccccccacgcgccgcccagcactgggcaagggcggggcactctctgggctcccgcccctcgccgcccgccccgggagcccgagccccgcccttccccggccccgccctcgcctcccgagcgcgcccaccggagccaccgcgctcctcgcgacactcgcaggctctgcgaacttccgagcggctgggccgggccatgggggcgcctcggggccggatcacgtagccgcggcgcccccggagagccagcgtggccgggagcgcctgccgggctcttcccgcgccccggccatggtcggccgcggcgtccctctgtgcgctgcgcagcccgcggtacgcgcggcccggcctggagagggaggcgggcggcgggggcccgggacggcgaagatactcgcggtgtgcgctggatccctgggggccgggcctcctgctgagggtagcggacccgcaggcgggacctccggggatggagggagtgggtgagcgccagggtcgtgcccagggctcctaactttggcaagagcgtcacgctggggcagggcgcgcaggggtctggatccgacggacgtcccaggctcactgtccgcttccgcccccacaccctgcaggtggccgagggcggcccggcccgcgagccgccgccgctgctggaggtgtccccccgaaagaggctacccgccgggcccgaccaggacccatgcggcagccgccctgctcccgaaggcgccggggccggcccagagcagggccactcggccggcggaggcggctggtgccgccactgccacacgaagctggtggagctcaagcgacaggcgtggaagctggtcagcgggcccgggaccaccctccgggtaagtgacacttccttaggccgacccctccgagcagggccacgccgaacttgggtagaacttggggcttggagggaagcagggttccactccttccctgctgctgtttccacaaagagttatcagccaggacttcccttctgcgggcctcagtttcccggtctgtaacaccatgtgtgagctagggagctcagcccgaggggccctgctgcctcggatgggaggggcctgggctggcgttcctcccccagcccagatgtcccacagctggaacgcaggtttgtgtgggaggaggaggggagagagcggatggcagggactccacccagggcgggacagctccagccctaccagcagggagaggttatttggtgcattgtggcccttggggcacctgggcccccagccaggtgtctggaaattacatacctggggccggggggcctggcaggtgaaagggtgggccacagcagctggggggtccctgcctactcctctcccagcctcaaggataagaactgttgtcccatacctcctgggatagactgaggcagtggccgcccatggggaattgagtcggggccctctgggttccccaggctccagccccaggggcaggtgcttgcaggggaggggttctcctggatttccagccagtgggcctgccggctttggagggagcagggaccattgttccaggaacaatgcatgctggaagtttgcaaaggctgggggcgggtgggggtctccagaggaagcccgctgccgggccttcagcctttatgaaagagttcctgggaagtccgcataatccccattgaatctaaatatagttctctaagggctgtgggggttggagtgagctgagaccctgactgccctgtctggggcagggcagggtggggcagggtaccagtctggtttctgtcctgggcaccgtctccgggctctctggagtctcggcgagggataggattgctgtagcctctctctggctcaggccaggcgcctgtgggcctgtcctggggtggggctggacccgccctgtcctctgctctggacaggctgcagccttggccatactctgtgccccagtggcctgtatctagtttaaaaggtagcaggagacccttgagggccccctggagagggccagccagagctaaaggcccatcttgctgccccattaggggaaacacgccagagacaggaggggcattaagattgagctggtctcctcattcttggagtgggcttggactgctgatgctgcctggccctggggccatggtcctggcatggactcgtggaggggagggggctcctggtcacgggcaggccaggggtcctagtggagagggctgcaggtgatactagtccctggtggattctaggttcctcatctaggggggtgtcttggtctcttctggcagacaggtcttcaggggagccccagaccacccatctccagcctcccctgagcttggcctttgacactggaaactcctcttgagtgccagctgggggctcccccttccctagctggcgctggcactcagcacaccggggtcccgggctggtctcagccagggctttgttctgctctgggcccccttcttctgctttgtggtctcctctgtcacctggggcctgttgtgaagtgctgtcccacctgcagggtgctgtgcccccgggagagaagaccccatcctccactgtctctccacagggcatggggggctgcacctgccatcctggggccttacgggtgtcattgtcctgtcccctgtgcgggcctgggctgtccccagagtcccagcaaaattgcagcctgcagccctggcctggcccgctgggcccagatgtgtggacatggctgcttctgtgtttgggttgggagggaaatctctggggtggccagggagaccccagtgtgctccccggagtctggtgcactgtccagtgggccctggcctctgctctgtaaggccaacgtggcaaggggtatttagggttggtgttctaggatttccccaggggcccgtttcgtattttttaggggagagatgagcttccttgaggatagctgtttacagggaacttcacaatcatccatctgtctcatgcttggatcttcagaagcccagagaagtggagagacttgctgggacccggcctggctattagaggccctcgcctccgggcttcctgcctgtctccgttgtagagggaggcgtagagggtcggggcccagcctgccagggtctccctgcctgtctccgttgtagagggaggcgtagagggtcggggcccagcctgccagggtctccctgcctgtctccgttgtagagggaggcgtagagggtcggggcccagcctgccggggtctccctgcctgtctccgttgtagagggaggcgtagagggtcgggcccagcctgccagggtctccttgaatgtgttgctctttagcaacacccgatgcctgcatggtcctgcctatgctcatcccctgctgggcccttgcccaccctcctgccaggaggcagctcccctgagcaggttcccgagagttcttggccactgtttcctgctctgcgacatgggaccgtctttgtgcccattgcataggtacgtagagcagtgcccggaagggatgcactctcaccttggcagctgctgctgctgtttgctgagttagggactccgagtccctggggctgttggagcccaggttcccggcctacctctcccttgctgtgtgctcttgtctgcctgagcctgtctcagttcccttgtctgggcagtgagggtgaccatggtcccctatctggggacctcatccctgtggcatggataagactgtgccctccccacctttctgagctctggtgccccgtctggggccgtaggggagggggacattgtcttcctgcccctgttggagccccaggggattgtctttcctgatctgagaagggtgcttggccctgggtgtggaggggaagccccatgatgggactctggccgtggctcctgctcctcactgtgtccccacactgtgccctctgctctcaccagggtcctcaggccttgtctccgggctgactacttcaggacccccatggcctggagcggccccctgtggcctggcctcctgtggcctccagggacctttctctaatgggctgctctgtctgccctgccatagatgctgtcctcatcccaagaccccctggcctccctgggctggaggcccctcagtgtccctgctctggcctcaggggccccttctcaggtgcccccaactctgagatgtccctgtgggaggttgcagcctggtgcctcccattcagcaggcaaagctggggcctccctctttctccacatctaaggcccccctcgcttccccatgctcacccaccaccgcaaactgttgtggcagacctcttccctctccctgaccccagtcctggtttcccccacaagcaggagctctgccaggtcaggcatggggtccgggtcacctggaggtgtttgttgaatgactgaatgaccaggcttttcctcccacaccccacttgctggtggtcacccccgggactgctggggctggattccggctatccgcccctcaaaatgacagttcccatggaggatgaccatccccctcccccacaaaggatggttccctgcttcaaggagagggtccctgcttggggatccattccagctgctgacagacacgtcatgtgaggtgttgactcctcctgagaccccgtgacatttgaagcgtcagtaccggtgctgaattgattatcgcccccgatggggaaaatgatcaattctcatttagctcccgtgcatctcttgcttatccaggcaggggcctcatccttatgcccccaagagctccagaaccactgttggtgccgcctgctggtgccacgcagctgaacagtgagggaagctgcccatcgaggctgtggctctggactctcctcccggcgaagctccgggtggcccctgtgtacagggaatcagttgtcatggtctgaggctgggagccctcctaccgctctgtgtggcttggcgagtcctgtttctccttggacgctgctcatgggcttctgtttgcttctcctgttgcctctctggtttgactggaggtgactcctgccagcttttcgttcctcctgccagcttttcgttcctcctctgtcacttgtccgaggaagccctcttagccccctggatggatgggggcatctctgtctccacagcccccaggcctgtgatttgggggtcccaggtctgttgcccccaaataggcaatggtcctgggagggtaggagctgcgcccgagtggtcccatgacggatgctcgccacttgtggtcagagcccctgggcccccagacttggggctgccaccttccctcgctgcttggagcctggcccggcttccactgctgccagggccacctttgtgcctggcagtggcacccgcctcggggatccgcagggtggggtgcctggcatcagcagcattcccagctgagcccaggtgtcacaggctttggtggcagcctggggaggtgtgagggggcacggctccctggctggcaggcggggcactggctaactctaccaggaagggctctgctcgggaggccgtggagctcggagctcccagttactgttggggagggagcctggggaagggccgggagggaggaagcctgggtgggcccagcctcgctgtgcagcctctgtgggacctgggctttctcttccctggacaggcggtgctgcctccgggattccctgtggttcagcatgtgatgggtggagggcacgtccttgtgctcgtcttgtctctcttgcttctttggggtcccaggggttgaggatgggcatttgggggaggacttgagcttgagggatgtgaaccattgtcctctgaacaccagccagaagcagagatggagccctagcggcttccggggtacaagctttatgtcggggcagggacgtgctctgggggagtctggccgtggtcacatgtgggctgggtggggatgggattgtggccgctggcctcactgcctctctgctgccaggtagaggacagggaaggagggggactgcaggctacccccaaaccttcagctgctcagagtcctgctggaggggcttgtgagggtttggagtgggctaagggaatgggactggggccttcccaaagctcccttaagtaccctggaaggatctcttatttgggaatcagaagagctggtttttcccttaagtaacaaagaaagtctagttcttctcttcctttgcctgctaggaagctcacagcaaatgtgctgctcagctctgggccgcgtgggacttttcttctgctctaatgggaacgggtcattctttttgttccagttatgactgactgtagttgcatggttttgtttttagcttatattttgtagttcctgcgagccaccgcacaatctttgtgcaagacagtgtgggctatgagtaaataagtaagagtaaaagtggactgaccgtgccttggtcgtgtctgcttcagcctgttcatctggtccatggaagcggagcttgtgctgttggggggagtggctgtcagctgggctttccctggttcctggtggcagccaggctgggtggtctggcctctggaagtcctggcccaggaatgggcagccctcgtcagcctctgagctctgcacccacgctgctcccttcctgctggggtgaacactgtgcttggtgagactttctcagggcaggctctggaggctgccacccccaccacggtgtgtccttgtcctgcggggcctcagtttcccgcctgtgaacagtccttgggctgcgtcgtcactgttgcttcttccggcgctcagggtcacttttccttccagtgtcacagtgtctccgtttcgttcacgggcgtgccctggccatagctgcctctccaggatggagtcttctaggcaggacccgtgggctggggtggcccgaggccctccgcagggctgcactgtgctccgtggagactccccagcccacctgtccccgaccccagcagcatcccaggcctcagctgtagggctggggatgggtgggtggcccagcccggtgcccggggctgatggcaatgtgtagtcccgcctggcccggcgccaggtcactcagctcagcgcgctgcattggacctgggatggtcgtgcttgcgtccctcctgcgctggcctctgaccccatgtgatgggtgttgcctgagctttggcctctgtttctggcggaggtgccgcatgctggcccttgcctggtgccctcagggagctcttcctaaatgtcctgtccccatcttccctccccagctcatagcttcggttcacggctgtagcccggctctgccctcaaaaccctcacccctgccgccaacgtggcctccacaaagccctcgtcctccagccgcttgacctagcctgtgggggctgccctgagcaaggctgaaaggcccctcctgctctcgtccctagggccccctctccccgacccccgcaaatttgccttcaccaggaagaagtgtcaggcgacctggctccaagctttatcttccacgcctggctctccatctttttctcctgagggtgggactggggccaccccatcagcccagaggctccccaagatggggccagcagggcagtggcaagggtgcgtctctgggccctggagtcacccaggtctgagttggaaccccagctctgcgaccctggtggtgtggcctgaggcaggtgtctcagtctctctgagcctcagtctataaaggggtcacagactcctggtagccagtgaacagggtggttgtttttgggggtgggtggcccctagggctgtgcagggaggcctggggtacctggcaggggagtgtctgggtgttgggatggtgccaggggcccagcttgcctgctgggtgattgggagaaggctcgtcctggtcctgcccaacttcctggctgcatttggtgttgtgggaggggctgtagcttgtggggcatggggtccctgccctctatagatgccctagaggcctgtggggagagggtcctgagggcggaggccaggaggtctgaactcatccctgtgcctaccgagtggtgggaagagcatggagggcttgggcctgaggagccgggcagcgggtatgcagagggtggcgaccaccgcagatcctctgtgcctgctgctgccccacgtggtggggaagaagtgggggcagccacagagccaggctgtccctggcttctccttctccactgtgtttccataagcaaactgctgtgaccatggggagggccctgggaaggtgcagtcccggcatccggacggctcctggggcggcagtgtttgatctcagagttaaaccaaggagacggggtgagggtctccaaggggtgggcatgtgaaaagccccgagatgggcctggctggagctcacgtggagaccgccacggggcaggccaggtgacaggaggcgggcgctctgggggctgtgtttggagtggagctgtgctccagccctgggatcctgggcactcttggcagcctcgtaggaggggctggtggtgtggacagtcctgtggcccctcacatgcagaggtttccgggtttctgcccagggatgcctggggccgctgggaggcaggggcctgatttgaaaccgagtccacggggccccttggttcacccggtgactgcagcctacatggagttggattgagtgtgcaggtgacccccaggcccctgcagtgcactgagcatgcctctgagcattggggctcctgatgagcctgcccctctgccaccccacctcgccggggccatccttgcctgtctggcctttaaccacccataaccccagatcccagtcatggcatgcgatggaggacaggggaggccattgaggggatgagggtctcaatgagcttgtctgtgccccgagctgcccagctggactggcgcctggcacaggcccttggggatggcgtgccggccagtgctgggtggactgggttgtgtccccgctccctcccctcccagcagaggaggaagggggtaggaggccttcagagctgcagacccacaggatgggaatggtccctggagtcctggctggcagaccagggagggtctgggcctttggagaggtgcccagctgggcaggaggggcaccggggcagccaggtgtggccagccagtttccagactggagcaccgagcccgctccttgccccccgccctgatgggctgcaccagacgtggaaatgtcctggacagcaggacctgcgagggctgctgcctggccgggggtcccttcctggacctgttgtcagctccggaaacagcggctgctcggggttgcagcccagcacgctttgtttgggaaggaaagggagggcaagatctggaggtcatggcccatggggtccttttgagggctgcccgcacacgcatgcctcactgcgtgggtcggggaggggcttcggggcctagttaccctcccagcggccctgccagtgggtgccagagctcctttgtggagacgggtgatggggactcagggagggccccgtatggctgaggtctgggggtctgatggcgtggcgtctctgaactgggagcaggactcccctcgctgtcccagggtggccttacctggcggggaggtttgatcagctgttctttcccatgggcagtggcttggctggagtggggagacttctctcctgcagtgacggggagcggggagtccccggtaaagtcccccgggcctcacacgcaggagaaaatggaaggattacttaaagcaactcggagaccccagaaacaaaataaagaacaaagtcatgatttgtaagtaggggggagactccctaaaacccaggcgcgcaatgggtgggctatgtttgatgctaaattgaatcaaatgaagaaaaacattttccaaatgcaagtaaagtatctgtgtaattagaccataaagagaaaattaaaagtcatatttcgcagtggagtaattactgtcttcctcaagacaccaggctgtggaggcctgggtgacaggcgggcctgctggctggggctttgaggagttcagattcctgaaattggggggcagtaacccgttgggggcttgggccagaggaccccgtgagctgccgggatggctgggagaggaggcctggtcccactgcccagcctgtgcagaggttggaaggtgcaggaagtggccacagagcaggatttgttgttgttggcggtgggggctgtgcgtggccggggagggggagggggaggggaggggcagggctgcagggctgggcggcttttgtctctctgagggctgcgtctggggtctgctgtgcggggagcagtcagtggtgtgggagaccctcgccttcaccttctggggcccaagatgcccatccctgggagccacccatgtcagcagcggcctccctgagcccctccctggagccctgagtgctggtcccgtgtgctgagtggggtgccgagttctcctcttgtcttagctggacagtgtgctgggccccaggctggtcctgcaaataggaggtctcgggtcctctgggctgggctgtgtggctctgagtggccccggcaagcagccctgtggttctgttctacccgagcagtctgtgccctggcccctatgctgtgccagcctggtgcagcctggctggtgtgatggctcagtggtgggggcgatggcgcctggtcccatccagtgtcttgctgtgttgccctaggccggtctcgcataagtgactagggttggagagatggcccctgccctgtgccttgaattcctggggccttgggtgggcctctcagtgccccccatggagcctgctgggtcggggttgggtggtgagagtccctgagaggagggcctcgtggcccgtcctggggaggggtgcgtggcccactcgtgggctttcgctgtggggcccggcctccaggatgctggctggcacctgggctgctgggggaaggtaccctggcccagatgcctgggccgccgctgttgctgagcaggtgaccagcagcctcggcttgtccccagtgggggcttcagcttgatgggcccccctccagcactggcccccaacacctgggacttggatgcccggagctccgaggcctggatagggctggggcctccctggcagctgctgtctgaattcctgatggcaaagctgggtgggggcttgggtgggggccactttggcttcctgtccccttttccctgttgcccctctgcctggccagcccgtggtgggtggtgcattctcaggtcgatccgggcttcctccctcccctgccctccactctccttcctgcctcctgctgtgcagccctggagagaagggcagggtgggcttcccaaggcctgaggtcgctggacgggcagaggctgcctggcctgtctggaggctccagaacggcgagctgggggccgggctgcctgtcaggttgggttaatagctccagcaggcggggacttccttccccttcacacggggccaccagggcagcctcctgctgagtggaaaatcagcataatctgagcctgactggaaaacaggccctgtctgccctcagcctgtgcaggggccagttctgggttctacatgtagacctgtgtgcccactggccgcatcagcagagctaagcggggctcctgcagtgtctgctctggtagggccctccccctcctggtccccctccccgtccccctccccctcctcctcctcccccttccccttctcctccttcccctcctcatccccctcccccaccccctcctcctcctcctcctccccctcctccttctctgcagggctccttgtggctgacctcagcgaatctccgaagcagcaggagggaggggcattggctaatcgggaccagacgcgccaggcacttcagaggctctgcaggccctgggttggaggaaatccaggcctctggagtggcccataaatcaggcagctgggcctgatgggggtcgccttttcatgcgacctgcctgggactgtggggagtgtgaggtggtcctgggggaacatgattgccgcacatgcttggctggcaccggccaccctggaccacagctgttaccactgtgagcctccagggcatctgtggacaagggcccagccagccaagggcaggctcaaggaatgtgggtggggtgactaagacaccccctccccgggataatgggcctcagcttcctcatctgagaaatgggcacgtttgagaaggctgcagtgccttttgtggccaacagggtggctgcattggagtccggtcttgcctggaatcccttgaggcaacatggccagccatcgagccagggactgcctggggccaggtttcgggtggtgggaaagttgggggctggtggaggacccctgtcgggtggtgttcggaaagccctaggtggtcacagccacagcagcgctgggctggtgctgtcctgggggttgcccgggctgggtgccctatagctgagacaccccttggggagggggtgcagacgcagagggcctggccccctccccagagagcaggacagacactggtcctgactctggccctgactgttgcagagtggtcccaaggaggggcaaggccagagcctggtggggtggtgagggacacgggtgggccccagagaggagtaagcctcttggtcgattccctcccagtgagctttgctctgtggcttgtctccttcttgctcctcctcctcttcctggaagatgtcactgcctccaggaagccttccctgactctgaggctgggtgaggcgcatcctcctctgggttcttctggctcttgtttttagccgtttctagaacccagtctcagggttctagagaaacctgtgtgtccccccagttcagggaagggggcagtcaccaaacagggtgcatcccagcgtacagctcagacctgggtgggggagctggtggagtgtgcggcggggggtggggccctgggctgtacccgatcctgcggctcttgcgccccttcggtgagctcatgtgccctctaggagcgtctccgagggaggccttcgcttctgttgacacctttacagcagcactgatttgattttccacctgccccaccggggctggagacctgaagaggaagggagagggtctcctgcccctggctctgccttgagtgagtgtgggtgagggaggccctcgtggctctgaagagacgttgcttttaaggggccctgcttcttgccagtctcctgcgtgtccccggccaggcggccttagctgacagtggtccggttgtccgggagccgcaaacctgccttgttagccgcaggccggggcgcttaatgacggctggggaaggtggacagttaacaaggacattgtgagcctcacgatgaagcccgatcattattttcctgctgggcttgtgtgggtgaaagtgtttgggcttattaatctgttacggatggtgcggtggccaggcgggagctcgcagcgtcatggacggtgagagtgctggtgggctctgggtgccggccctccctccccaggcactgaccctgcctttgtcccttgctgtcctcaggatccttgcctctctgccctgcttctcgacaagctaccagcacctggggccctgccagcctgtcgcccagaggccgagcgccgctgtgacgtctgcgccacacacctgcagcagctcacacgggaggccatgcacctgctgcaggcccctgccagccatgaggaccttgacgccccccatggaggccccagcctcgcaccccccagcaccacgaccagctcgagggacacgccaggaccagcgggtcctgcagggaggcagccaggacgagctgggccagacaggaccaaggggctggcctggtcccccgggcccagtgtccaggtgtctgtagcacctgcgggtcttggaggggcgctgagcacggtcaccatccaggcccagcagtgcctggagggcatgtggagtgtctcgcgggtcaacagcttcctcccgccggcgtgcctggtgagtgtcttgctcagcggatgggagctgctggcctccttgtcagaactgggcttccttcgggggtctctgtccacgttgagtgccctgcagtaaggcttccctgaagggaggggacggcgggcatgggggttcctgacactcctgaggccccacatcagatgcacccttgatggtgcacagcagctgttctcaggtccctgcctgactcagggaataccttctctgggagcacgtgcccctccctgtctgtcttttgagactggggctgagggcccaccagtgcccagcacagggcttggcgatgcacagggcaccgtgtgtagatcggggctcacgaggcagatggagtaggagggcccttgtggcagagcgagggcctgtgtggaggcctgggggtgtgaggcgtccatggacgtcgggcgggggaccggcagttgcaattgctggagatgcgttgcctgcccctgtggcaccctgggggcagagggacatgtgggtggctgtgaagagccgtgtttctgcctggtacactgtctagtcaccacacagcgaccagcacaagctcgcccttctcccttggtctccaggcctggtggtgtttccaggggcagacagaggtgcagagaccccgtagtctctggggcaacattggccactgatcctaaggccaggcagaccctgcccttgccttctgggctttcggcctccctgtgactggtgaggtggcctgtctggacatcaagatcctgccccagctgggggctggccttggcactagctgccctggcagtggctgctgggctggtccttctgaggctgctgggctgccctaggggtcgaggtacgccgaggctcactggaggaacttctggacaccccccgggtcccagctggtgtgatggttcccctgtggccttggcacctacacccttccacctgtgaactctgtggtgaggccgaggagagggagccccacccttgccacgaggtgcctcctggccccagagctgaaccccacccttgccatgaggtgcctcctggccccagagccgaaccccacccttgccatgaggtgcctcctggccccagagccgaaccccacccttgccacgaggtgcctcctggccccagagccgaaccccacccttgccatgaggtgcctcctggccccagagctgggcatcctgggaggggtgggcggggatggtgctgggggctgcagcaggtgagctgggcagcatcctggaggaggtctcattgagctgggcctgtgtggaagcatcaggggctgggcctgaaacccaggatggtgggcacaggcacctccgtctcctgctgtctccctgggccacttggcctcactgcaccctgcccgtggctgagggtcccagcgggtgggggtggagaagatcgcaggccccttgctgggcagccctgctggtggatggcacaccatgaacatttaggcaccctctcccagcgttatgtgcacattgatcgtggccagggtgggtgggaatggatttataattagacagcagtccgggcgatcgatagggagattattagaaccataaatagaactttaggattcagatgaggtaatttcccctgaaccagggcatcgatcattagcgtggccctggaatgttaatggtgcctgttagactctagagttaaatacttgtggagagatgcgctgcaaatctccaccacagaccgtcaaccacccctgggtcgaatgagattgttccaaggcaaacactgatctggggccagcgggtgggacgggggtgctgcagccccctctgttacacgatgtggagaggaggggcagggaccagccatggcactttggcctcggccgaggcttggcaggggatgctgaacgttactgggtctggccagaaggctggtccttggaggggtggtgggtggcccagggctcccagggcctcctgcggccacaggtggggcctggaacatcccacatcttgagcatccagagactcctgggctatggagccgccgggcagggctgtccagcggttcttcccggactgttgggccggggcagcgctgccgttgcagagggcagaagctgcccacggagcctggccctgtgcctgtgccccacgcctcctgccctgagagctctggacagtggtcatggggcccaccccagtgccctgcctgcaccaccagaggctgccatggtctgggacatgctgcgaaccgtggcccatttcacgctatgaactgagctgcgagaccgaggctctggccttcagagcccacagtgggttgcaagtggcaccgtggccctccacagaggggcggcccggtgggcagtgtggggtgctggaggtgttgacggtggccctgaggagcgggggtgcctccatacatggagattgggtggcaccggcttgggggctcctgccaccgctgtgctgggctgcaggggccctggagggtgtcccgtggtcctcacggctgagatgggccaggcaggggcagatctttgaactcagggctgtccaggccctagggccctttgagtgacgaggctggagcttcgcgtgggtgggcgagtccgccccatggggctctgcagggtggcgcacatccacacccgtgcaggggtgacactggtgacagagttcggctctgagcctccctggccgctcctcagcccctcctcctccctttctcccccacttctcagcacaaaatagcacccagtgaggtgtttatctggggggctggtgtctttcacgggccagaaccttacagatgcgtttgggcctggagggctcctaagaagagagttagcttggcatttcctaaactgtgctccacggaaccctggtgttccccgaggttgcaggtgctctctgctggccgcctggtgcctgctgtggttaggaagctccccgtggggtgggtcccgtgcggctatgcttggggcccttggctctgcgcccctcggcctcacgctcccctctctcctgcctttccttccgtttgctgctgtggcacctccatcacatgctctgtctggccgcccgccccccctctcttctgcccccgtgttgtggtcttccctctcgccgtcctcccctgcccccggctctcgctttgccagacggcttcttttggcatgcccgggctctgcttccggcaggaattggcagtggccgtcccggcggatggggcggtgtcccggcagcgcgtgggacggtggagccgaggcgcgtgccggactcctgagacaggtcagtgtggggaggcccagctggccgcaggcctgtaccgttgctgggcggggccggaaccttctggccggaggtggagtggctggcctgagatgggggagggctcgggccctgtgggaagagggtggaggggccgggtgggctgtggtgtagcagctctgtccctgctgcagcccctccagcctcggtgcccctgtccagtgggggaggcagggtgtcctggtgcctcactggacactgtgattgggcctggcccaggatgccaaatgtggccccacggtggtgccatcgcgacgagccacctgtgggtgccacgctggctgtgggtggtgcggccccggcccccaggagaactggccctgggtgctgactgccatgcccaggggtgctcaaccagacccggctctgctccaggggctcaggacctgctgttaatgttgtaactttaaagatcactctttcctgtctgctcagcaaaggagtttaggcttttgatagggagcacatacattaagtgataaaatagaattcacacttgaggtgagggagtggctgggagaaggagagggctggccgggctgggttcagagggatgtacaggagttcctggcctgcaggctgctggtggggtgtggtgtgctggcgcaatgtccagtgagctgttccaggtcccaggttcgcccttttctgctactgggcattccttctggaagccccggaggagtggctggtgcctagggcccagggggcacccagcttccatccagcctaagtcttggggctccctgtgaacttcctttcgcagacatggttctgttccaggtcccgggaggggcctggaagctggtaccggccatgggttgggcagggtgagccggccatgggttgggcagggtgagccctccatggtggtgaggagggatactgtctgggatggcagggcctctgtctggagtgtccctcctgggtcccggggcggcttgttctgctgacgtgccgtgcctggcctctggcctgtgccacttgggacaccctgaggacgctgggccttccagaccagcccacgtcccctcagcacggggaccccagtcctctgctagcctgggtacaaaggacgcctcgggcagtggttatcgactggacacttggggccgaatgacgcttggcacctgggtgaccgtgacctgaccaggccacggtgcccaagggggtccttggagagcttggggcactgggcccttggggaaggggccggggcgaggggtggccaggctgaagcaggctgccttccctgccttgcctggggttgcatccccccacgccgcccaggaccaggtttggcctgagggttcggggtcccacgtgtctgggaatggaacgtgcggaggtggagctcacgtttgctgggctgtcccgggcgtttaattacgtttgtgcttcattatgaggaggcctccctttctgggatttatttgagctaatgagttggaaatgccagggtagtatttcagatgagggagcgccacacatcaccgtacgtggggcaattagtgttcctgccaaatagttatcgtggtttcttctctaattacgccgctgggtgctcccaggaggctcaggggtgagagggtggggggtctgtgtccatcggtcttgaccagtgtggtcgctgcgattctggagtttgatgggggagaggcggaaagtctggcttctggaccaccatctgcctccctctctgcctccaaggagtcctgctggggcagaccgcccacacaccccgagctgggaacgtgacctcacggcccaggcaggccttccccactggcctctctgccagccctgatttctggggccttcccggcttcacaggctgggccctgggggtgcagagcccccaggaatgtgctgggctctggggtgcccaggcctgtctctcccactccgggtgccagggggcagtggtgtctctgcccttgcgttccttatacgcactctctccttccctccaggccgaggcagcggtggcggccgtggcggtggcagacacggtccgagaatgcccccccgtggccggccctgatggcttgtcgaaggcctggggccgtggtggagtctgcacgtcagccctggtcacccccaccccgggctcggtggggggctccacaggcccctcagctgcagcctccttcttcataaggtatgtcctggggcttcctgggcagccttgtgggcagggccccatggccccggctgtgggcccctggggacctatgggccgttcttgggggacctcgggcatgcttgctgctgagacgagtggatggggagctgctccgaccacagctgctgagccgctcacagcctgccggcctctcgggccccatgcccgatgttggggggcatctcatcctcgggggagcactgccaaggaggggctctgtggccaggaccctgcctgagttggagcctggtccctgcctcttctgagctgtgcaatcttgggcaaatcaactaacctctctgtgcctcagtttcctcccgtcagctgggctcttcctcataggagtcgctgtgactgcagcaagaaaatgtctgtgaagcctggagaatgtggcccggagtggggcagctcagctgtggacattgggggctgcccgggggaggcgcaggctggggccacggagaggacaaggctggccttcaggcagcacaaggggaggggcagcagggcttgagcgggtgcccacggtgccagccgggcttgtggttggcaggtccagctccaccaggagcatcccacattgggggaccatgtctgacatcacttggttgctttcccaggccccgagctcggggtgcctggtttctctgctctcccccctgctgatccccaccactgccagaatgccaggcctgaggccctgcaggcaccaggtccttgccgactggtggtgtggatggggtgggccaggcagagggaacaggagagcagaggtggggagggggagttggcatggaggggcgtggtgtgggagcctccactgggcccttcccggcagggcctttggtcctgggacccgtggcagagcctcctctcatcctgatggtgtaaggatgcggattacaggatgtaattgccataatgcctggtaatggcaggcccagccgcgggtcagtgtcccattagcagccccacgcgggtgctgataagcttgaacatgcatcacacccagcggccagagacgagggcgtcttatcagcgccggccctggggaccgtgtggtctgattgcagagtgacggggcatatgattagggcattgtcgcacgccgtgtgccgggctgagggctgatgagcacaccatcgcgttggagcacagccagaccgcgcacgtgaccagtgtggcctcagcgccaccccaattaggtgccgagagcacggctggctgggaccctggtgggagcagatgggggtcttgcccatcctgctctggggtcccccgtgtgtgggacagcccaccccgtcacaaccggcctagtcctgaattaaagggcctgtgcggctgttctgggcacagccctgtggccgtgctcctttgggtcctgtttggcaggaggatttgaaacgtggagacttccagaaaagaaagaatagctccagtgctcagagctcccccggtccctgatgctaagccccctggtgccaaggagggttcctgacactgggaagtaagggtagggtgtcggcccccaggccggtgcgttggtgacctggagcccagcagagcggccctggctgccttttgtttgggagccgaggccggtgccgcttgccagccgcgctgcctgctgaccttgggaagttaccatagaaaccagcgcatcgggctggggacccagaggcggttctcccaaggcgggggcgctgccggctgccattacttccagcctgttaggcaccctgggtctcagcggcttctgcgaggccactgcaggtggcaggtcgtggttcaggttgtggcgggggacatcctggcaggtgggccctgtcggtggatgcctgacgtgggctggggtcggtggtgggtgacctcctctgtggggctgcagtaccctgaaccctcaggggtgagatcagagggggtgtccactcctgggttttgtgggtgtggggctgtggctctgagtggggacgagtccaccaggagacagtggagcttcagcccccgccccaggggtcttgggcacgtgctgagggtaccttctgtgctcccacctccaccctcgaagaggacctgggagggagtggcactgaccccagcccctgctctgcccttgggaagtttccagtctggagggaccgaggggcacctctgtggaggcagccttagatggcagcacgggacccgtgtagcagtcagggcagagtggcctctcagggagcgggctttgagggttgagtaggagtctggcaggcagcattgccaagtggagacggaatggggtggaggtcaggagtttgagtttttgaatcccgtgggcctggggagtctcagctctgctgctgcccacaagcaccccccagccggattagggcaccagcctcaggctgccccctgatcctttcagtggcctctgggctccttatgtccacacagggaagctgggatgtggagtgatcccatgggtgcccgggtacccgagtttcgttaatgctaacaggggcatagatagagcaggggctgagccccatgccctcaccccctgggtggggcctggggaagctgcagggattgaggcagcgcagctgtgacagagcttggcatgctggcccagcaagtgttcgggagggtggggcgcgtgggccgggtggccccggggttaggagttctccgaaggctctggtgacccccagggttaggagttccctgaaggttctggcaactctgatgacgctgtctgaggccccgctggtttgtgccggcgctgggagcctctgcagtgcctcctctgaggtacttccgtcatcatactctcacctgctcgctgccatgctggtatgggggtcccctccaagaccccaaatcaaatgtctttgagaaaactgctaagggaggttgcttccattgggtggggagcacctcatggcacttgcaggtacccaggccccccactccccaccccactgtggcctcagcagagcccccgtgtcagcctggatgcccaggcccatggacggtcaggctggcacccagcagaagtgcagcgcctgcggggagagtgcgctgcccgaggcttagctggggacccacatggaaggcactgtctggagaggtgtccccacctgtcttctggcctgtgggtgaaaatccaggacacaggaagtgtggaccacagcagggctgggagttggaggggctgatgcctcagtctccagctgcctccagctggggtccagggtccccttcgcaggtctgcaggacccagctggggtcccccgatgcctgccctggttccttggtggggcaggtccggcaggtggcaggtgcccctggggtgaggtgggggtagggagggtggggctccgtccaccagcctcgcacggcccagtgtggaagctctgggttggccataagtgattcctgcacgcgacagaacaggctcgtgtgtctccttggggtaattaagggcctcaccatcaaggccaactgcctgtgaaattaccctcttgtttggaagcggtgatttttctctgtaaaaaggaaaatatttccttttctgttgacatgaatcgatggccagggccaatgagcccaggcaaggctgtgggattgcagcaagacacctggtggctctgggggccgttcaggtgcccgctgtctcgttcatcctcgctcacgcgtgttctgagcttcttctgtgagcatctgcccccagaccccctgctggcagggacatagctgtgtaaactggtgtctcacggcagggggtagttgctatagaagcaggaggcgcaggggctggggacacccatctcagggcatcagggcaggcttcctggaggaggtgtcctgtgaggatgggggctgtttatgcaggtgaagttcctgcttttctgagtcttcccttcagagtcaaacccctcagacttgcccactgagggccgccgctccctggcagtgttgggtgtgggcagtgtctgctgtggcctgggggagacaaaccccactgctcagaaagtaagttcctgcctccacagggccgtgggccctcaagggctgttgaacccaagcgtggtagccagatgggggctgctgtgtctgatggtcgtttccatgggggcctgaatttcatcaaaggagaaagtgctcgttctggggcctcgttaatgcagtggcaggtctttgagtcataccagtgaggtaagcccgtaaaagcaggcaccgggagggcccagcaggctggggtgcagcctgttggcgatgggccccaggaggaggaggcgcctcaagttaggtcagattgtggggtggagatgtggggcgaacaaccttccagacttccagggctgatggaaccacagaggacgcccggtcccagcctctgtctaggcggcctgggccctgggtgtgcccgctgtggcccaggcatacctgagatctgtgctgcggacgctgctcctgggagggtcactggaggggcagagcccttgtgtggccgacggggcaaagggccagcctggttttggcctctgcagacctaaggctccagcctcaatctccctctggcctctccaagtgctgctccagtctccagtgcttgcccggcctccgcgtcccctggaagcttgggggtgtgggtgccgatgccctattgcccacagccttgggttgcagctggtaccttgaccctgcccagccttgggaggggctgcaggggagggtggaggagctggctctgggtgggcgtgacctctccccatccacttgaggccgagccaacaccctccagtgagggctggtgctgggcgtcccccacatccatttccagaggaggaaaggggtccagggaggctccctgtcccttataggggccaccgtggggaccgtcctcagccctgcctgtccaggtagggtggggggcttcccacctgcacctgcagggccctgcccttccccccgccccgccccaagaaacctggggtcccagccttggagcagcaccaggcagcagggtggggtagccctgtcccagtcctgcctgctagatgcggatgttttccaaagcggggccgcagcttcttcccttgcaggcagctggcgggaagctgaggtgtaacccaaggtcgtggggtggggggtctggaacaggaggctgaggctggggtggtgggcaggcaggaagaaccccaagagcagacactggtgaaatccaagcctcctcccacctgtgcccccaaatgggcagatgcagccctgcctgcctgcctctggcctcgcccaggcccctgcccagtctccctgcccgctatgggggctcactttgaggtttgggttgtggctctgccctctgcgcttcccagcgttcccctctgcccgggcttcttgccctgtggacagacgcacagacacacagacagcgtgggcgagtgtgtcggcctccatcctgtccctgatctgctgtgtgagtgatctttgggcgacgagggcacaagggcctcttccttgcagggcagttgtgaggtttacagagacgaggcttaggcacggtattgggtaaatgctggcgatgctgggtgaggtccaggggtctcaggcacacaggcccgggccccacgatgcaggtgccattgcctccccttgcaggcctccctgccgcgttgggccccaccctgtgtggctcagctaccagagggtcacgaacctgggaccccagtgaccccggaaccccgagcatgcgcggcacggggcggccatgggccccgacccctgctctgactcacacctgcatcctggggcccaggcccgtgtgcctgagacccctggacctcacccggcatcgccagcatttacccaataccgtgccagctgtgggcaaggaacccaagtccccgaggcggcgggtgggcttcccacacctggaactaccggggcttctcctgggtagccgtgggtttggttcctgggattcttcctcctggcatcccccggctccacgtcttgcctgggtggctgcaggcaccgcccaccactgccctactaaggactccaccatgtgtcatagattacttttactttccacgatgacacctcactaggaggaaagccgtccctggggtctcttaagagacagctcctattcaaaatgaaagaaattaagcaaaacgccagcgctgcagccgccgcagtgggggcagcgagaggccgggcccggctctggggtgcaggtccttccacactggggtcagttttagggagtcaagatagacgtgagaggccgagggctgtggggggggcgtggggcatgttaggggacagaggagcccagggtgggtcgggggagcgccggtggtcagcgttcaccacacccttcgccgggtggcatcctggcctctggcccgcgtgggagcgcctcctgttgggaggtggtgacacccagtgtgtgtgttcgttcacccctgtggcgtcctggtgtccctgtgctggtgggtccatgatccggggtaggggctctgggtgcctgcagcacaaaatgtgctgggagggtgtggggccctgcagaggtggggtgggtgggccacagagaagccaccccagggaatgagtaggtgtggcccagtgatgggacctgggaacacatccccagcagcagggttagcacagccagggctcagaggcgcggcgggcctgtactctgtgtgtgtgcctgtctgcgtgtgtatgtgtgtgctctgtgtgtgtatgtgtgtgagtgtgtgtgcgtgtctgtgtgtgtgcgcgtgtctgtgtgtgtgcgcgtgtctgtgtgtgcatctctgtgtgtgtgtctgcatttctctttctctgtgtatccttgtctctgtgtgagtgtctgagtatgtgtgtgtgtctctgagtgtctgtgtgcctgtgtctctctgtatatgtgtctctgtgtctttatgtgtctgtctctgtgtgtgtctctatgtctctccgtgtttctgtatgcatatgtgtctctatgtgtgcgtctctgtgtgtgtttctgtatgcgtgcacgtgtctctgggtgtgcctctgtgtgtgtctgtatgtgtatgtgtgtctgtgtgtctctgtgtttctgtatgcatgtgtgtgtttctatgtgtgtgtgtctctgtgtgtgtgtctctgcatgtatatgtctctgtgtgtttctgtatgcatgtgtgtatctctatgcatgtgtctgtgtttctgtatgcatgtgtgtgtctgtgtctctgcatgtgtttctgtgtgcatgtgtgtctctgtctccatatgcatgtgtgtgtctgtatctctatgcatgtgtgtgtctctgtatgcatgtgtgtctgtgtgtctctatgcatgtgtgcgtctgtgtgtctgtatcatgtgtgcgtctgtgtgtccctgtgtgcatgtgtctctgtgtctgtatgcatatgtgttctgtgtgtctctgtatgcgtgtgtgtctgtctctgtgtgtgtttctgtatgcgtgtgtgtgtgggcctctgtgtatgtttccatgtgcatgtgtgtctgtgtgtctctgtatgcatgtgtgtatctttgtgtctatgcgtgtgtgtgtgtctgtgtgtttctgtatgcatgtgtgtgtctgtgtgtctatgcatgtgtgtgtctctgtctctgtatgcatgtgtgtgtctgtgtttctgtatgcatgtgtgtgtatctgtgtttctgtatgcatatgtgtgactgtgtgtctctgtctctgtgcatatgtgtgtctgtgtgtttctgtatgcatatgtgtgtctgtgtttctgtatgcatgtgtgtgactgtgtctctgtgtctctgtgtgcatatgtgtgtctgtgtgtttctgtgtgcatgtgtgtgtttctgtgtgtgtctgtgtgtgtctctgtagggtgtgcgtgtcgaggtcccctgggagtccaccccagtggctcccaagcatgcactggcctcccctggagggtgtgttaaacccaagcgtcagcctctcccctggaggtcctgtggtccgggggctttgggagactctgcaccttctgggagttccctgggggcactgtgggtgcaggaatcccccacccctggcggtgctggggcaaggctgagcctcagggtgggctttggggtggggaggcgctcgccctggctgaggggcagggtggcagcgggggcacttcccagcagccctgagtgacgagggtggcaggggcccaggagctgggcagtggctccaggatggctctagggccttggtgatcggcaaggggcaaggcagcctcacctggggcctggggcttggggtgtggtaatctcgacagcaggattaattgagcccttcctgtatgtggtcactgtgctgggtgccttgagtgtgtcagtccattagggccacacagaggcctccattgtcacctcatccgactttggagatgtagaaactgaggcataggcaggccaggtggatgtgcccaggtcacagctgtgcatggctgcccacagcctgggcatcgggtgggagcagctttcactgtccgacccccggcagcggctgcaggtgggggatgagggcacaccccttggtggggggatggcattcagtgcagagcacagggaggggcgctcagcctgtgtgggtctggaccctgtcacaagcttggtgtgaatgctgggcagagtccctggggcagggacgccatggaggccccagcctgaaccgtccactgtagaaatgaagtgcaggcctcccagccacattttggactgggtttcctgggatggtggctgatgaagtcccagggtgggatcgcctggtgactcgcaggcgggtgacaggaacagctgctgtcacccaccactgatcctgcctctgcctctcctccccagggctatgcagaagctcagcctggcctccaagaggaagaagccccacccgccaccgcctccagccacccgcggcacctccacctaccccaccgacttcagcggggtcctgcagctgtggccgcccccggcgcccccctgcctgctcagggccgcctccaagaccaaggacaaccctggcagcatcgggaaggtagacgcagccccgagttcggggccctgggtggggaggccagaggcgtctgagaagacgcaggaggggtgagggagtggaggggctgccacttccttctctgggttggataagggtggtcagtggggtgccatggggagactgaggcccaggtggcagcagggagcctgggagcctgtgctgggctgggactgccgggatgggaggggagtggcgtgtcctaggggtcccaggggcatgtactaggttcagcgtggggcgggacagccaggtcacggggctcccagggactaaggttgggtttgatccagggaagccccttgcgtaggctccactgagacgcagccctgagggggctgggggcaggaggggactctctgctctccagagtcaccgtgtgcaggcgggcccctgccatgggaaagcgggatgcgtgatgggttgattctggcgccgcgctccacatgggaagactgccgcctgtggagggcacagggcctccatcagtgatgggacaggctggctcctggctgtccctggagctctgagcctggggcctgtggcttgctggttgtgccatccgagtctcggagaaatacctgccctggctggacgtggccctgccttgtgctgggagctggcagtgcctggttcgtgggcccattgagtcaggtgggctctttgtgcccatggagggtgggaagccagtcacacagctctgtgtgtgcccccggtggctttttcctgcccctcggcctgctctgcagccagccccctcccgcccagcaccccgaaagcactgcctggtgcctccaggcccgggaggctctgtgccccacatgggccatcaggctccgtgcccctctggacttggaccacgattcccaggggttcagctctccaggggacaaggtctggaggggacgctgtgcccacgttggagaccccctggcagaaggcccctgtccctgggcctgggggtgccacaggcctctcccactgccctagctgtactgggtctagggtgccaggagcacccctcgcagtcctggtgagagcctgcttgacctttacagctctgtagtcctggaggggcctcctgggcagccacaccttgggattttgttagagctcgggaggtgccaggctcgtgggagggtttggaacatgctggctacggggaagggctgtaagtgactgtgtgtctggccacgccctcagtggtgcagttgctgggggctgtgccccctgcccgcccggtgatgtagcgagcattgtacttgcagcccctggaacgctaatttcgtgacttgagccctccaacctctccagggcagccctggcctgaattgacggtggctactggtctggggcagtggtgggtccctagggagggccgccgtggggcataggggctctggggcggcctgtggggcagacctgacagctcttaccatcttcataggccatggcgggtccgggtgggggcatcaggcagttggcaccttggagctgcatgggtgtccagaggggagtgtgtggtgagaccaccaggagcctcccgatctccctgactctgggtctccaccccgagcaccccaccagttgccagggtttgaatggatcgcttgtccctctgggcactggtttccgtttgtggtaaggagggcttggcgggcatctggcatctctgtcctccggaggcgacattctgcatccaaggcccgggggcaggggaagctgtgtggcctggatcagggacttgtcattgctccgctggggttggggcaaggcccctgcctggggtgaggcgggggtggtgggtgaagcagagttgggggactaggccgggggtcactgcctccctggaaatctctttgcctagcactgctgggggtctgcggggaacaagggggctcctgatctctgtgcgtgtgcccggcacgggctgtttctccacagtcccctgggatgcgaggccagtggcatcagcctgtgttttgggcccaggcctggctggctggggcaccctgggtcctccccaccctcaacagtctccttgagacagggcaggtgggtgctggggccaggctgccgctgccctggccacgtgggctgcagagctgtgccgagagctcaggaggacgccgaggtcaggtgtgggcggtggtgggcaggcagcatccaggttccccgcccagcctgggatcggggccctggctctggcctgggcctggcactcagcctgtttgtgccatccagttggggcggggggcagaggagtcagcagctccttcaggagcccgcaacacttttcccagcgccccgcgtttcttaggggacagcttctgccccacttcctcctgggggcagccttggccgggcttctcccttctctccatggcagtcacacccccaccctgctccggagtgctcagtgcttccccagcaacaaggagccctgggtcaccagccttccagcccctccaccctgcacaccccccagctccccgggtgttattagcactaatgtcacatagtcagaaatgccgcctgaaaggcgtttaatattgtcacagaaaagaagttagattacgttcaatttctgacattaatgtgctacttaagataattcatcacagtgtggtataaaaaagacatccctgtctgggtgggtgctgagcagcgcccttccccctccctgcctgggctacctcttcagagctggaagcccttttttaatgcaaaatgtgttttttctctcccaggcagctattccgtggggctttgtaatatctgaacatttaggggagaggcttgctgtgccttttcctgcaaagaccctgtcatttccctgcagtaatgacagggttctctttcggcagacaatggcctgcgctgggaccagggcagtgtggggcaggctagatgggcggtgcccccactgtgggctgctccatcccctccctggggaggcccacaccccccttcctcctggttgtgagcccgctctgcgattaatgccgctggtggaaagggtggccggcagacgtagagagccaaaccgtgagcctctccacgccactccttcccgctaggaagtctctcaaatctgcagagcccatttggctcctgaagtggtgaggagttcacactggaaaaaaaattgccaaaaattaccgggaagtgcacgttttcgtctgctttgtggtggcgtctggaaatgaaatagttttgatcacgtcgtcgggggaataaaagaatcgattcttgcctaatggagcccaggttctgagtagtacaatagaaaagtgtttcttcatgctgctccccggagagcgggcactcccgactccagcggcttgcatatcaatgtgccccatgcccagggggagtaggtgccgcctggtgcgaactacccatggtaaaccaattttgccggcgttatgtatctgtcacttacaattaaatccgtgaaaaatattggctctgaaatgagtctcgggtaatttgatttacgctgtagtggagaaatcagagatttcagcgcagagtggactgtggtgtcctccagcaggaaatggggcctgtctctggctctgcgttggagccctggttcagggtggccctcgtgtgcgcagcctctgccgggtcagagccgccgcctcctggcatcgacgcaccagacccacctgtgtggggtgtccctgctgtggatgggtttcggagtgtttgcagtgattgctctgggctccggcatcctgggtcctgcccctccccggcgtctgccccctctcagggtactggggctggtgtcagggtcttcccgagtccggtgcctgtatgtggcccagtttgagatctgtgtgtgtgctttggagacgccattgcttctgcccagcaccagggctgcctggttccctgctggctcgggaggtcagtctggaagcccaacccaccctcagcctgccccccagcctcagtctccccaagcctgcagtggggccggtgaggccgaggcgtcagaatttgtatcttcccctggatgggatccttcttatcttgcccgtccccgtttgcattcgaatgggcttccccctgctttctgctgactctagtccggcaggccacagggtgccagggttcggttccctcagctggccagggtcggaggcagccatgcccctggatggctcccctgacagcgccagccctctgcggctctcacacctctgtggggcagttcattcccttatcttgcaagtgctccccctcagcctggggagcagcctgcgagggctgggccagggggccatgctcctccctcctgccctctcctggactgagctgctctgcaggacctgagcggctgtcctcttctcacggaggcgcccggagcccgccgccccctcattctctgtgccgcacattcggtgctgacaggctgtgcaccggccttgcctctccctggccctcaccttctccctgctctgctgacctcatatgggatctgctctcgcctggagcaggggcgcggtgtccacattcctgcggtgggggtgccagtgtgaggcctggcccgctgtccccacctgagctgggcccctcctgccctgtaattagtggccggctgggcggaggcagcttctcaggtgccgcccacctctgccccaggtgaaggttatgctgcggatctggcccgcacagggggcccagcgctcggccgaggccatgtccttcctgaaggtggaccctcggaagaagcaggtgatcctctacgatcccgccgccggtcccccaggcagcgcaggcccccggcgagccgccactgctgcagttcccaagatgtttgccttcgatgccgtcttcccccaggactccgagcaggtacgggcaggcggactgggcgtcctcccggagacccggagccgggctgctggctcagcacatgggtccgatctgcgcccgcttctccgtgcagggcgcagaggaagcgtgagcgaggggcccgctgcctgcggcgcctgcctgcttacctccctcatcgtcctggccagcgtccttgggtgtctccatccgcccctgccgaggctctgggccaagtccacagggaaaggcctggttttccggagcccgccctcccgggaagctttccgagcagctgttgggctctgggctctgggggcgcccggtgctccctgcccatgctgagccgtgcaccgtgtggctgcgtgtgcgtctctctgcgcgtggtggtctgcccctgcgcccggcggctggacttctgggctttgcgggtgtgtgtctgcacgtgtctggccagtccctcctacgtgtgtcctgggtcctgttcatgtgtgttctgtgctttccgtgtgcacatgggatctgtccttggtcccaggtgtgcagcccaatctccttgtgggtcgactgcctgcatgtgccaggacagaccggcctcaggcccacagacgtggcagaaggaaggggccacagccctgcctgattctcttgcccccctaggccgaagtctgctcggggaccgtggccgacgtgctccagtcggtggtcagtggggctgatggctgcattttttcctttggccacatgagcctgggtaagcacccttgccccaccctagatgggtcctgctggccaccccctcccatcctcatcacggtggttgctggcagcttctgatgggaaaggaggctggtcctacacatgggccgtggtgggcatatggggtgaggggcttgtggagaggaagctgaacccctgccgaactgaaaggcagagggcttaggatggatccaaagaggcccctgagatctcggtgcccctggttggcccccggggacgccagtagccataaaggctccttgcgtggtgtgtggtggggcctgacgcctgcgtggcccccaggcaagtcgtacaccatgatcgggaaggacagctcaccccagagcctgggcatcgtgccctgcgccatctcctggctcttcaggctcatcgaggagcgcagggagaggacgggcacccgcttctccgtccgggtctcagccgtggaggtgtgcgggcgcgaccagagcctgcgggacctgctggccgaggtggcccctggcagcctccaggacacccagtctccgggagtgtacctgcgggaggaccccgtgtgtggggcgcaggtgcgcctgcctactgtcccaccttgggggaggggggctgcacttggccctgagccactgaagacgccgctgcctctgcctttcctgcagctccagaaccaaagcgagctgcgggcacccacggccgagaaggcggctttctacctggatgcggccctggcggcccgcagcaccagccgagcgggctgtggcgaggacgcccgacgcagctcccacatgttgttcacgctgcacgtctaccagtaccgcatggagaagtgcggccggggaggaagtaggtgccacacccgcactcccgggcccctgtgggatgcgtgtcagcagagacccaggcacaggggcctgtcatccagtggctcctggggatgtccctggggttgtccccagcttgggcctggggtggggatgtggagcaggatctgggggcccctggctacaccatcatttgcttgccttgtggttccagtgtccggaggccgcagccgcctgcacctcatcgacctgggcagctgtgaggcggcggctggcagggccggggaggctgctgggggtcccctgtgtctgtccctgtcggccctgggcagcgtcatcttggccctggtcaacggagccaagcatgtgccgtatcggtgagtgtagggcctgggcaggtgccgaccagggtggccccttggtgacctggtaaatccgtgtctggtgtgcccggtgctgctgtggcccccagctcctcagggctttgctcctccaccacctgacaggcctcgctgcccgtgggctgcctggggccccacgctgggctggtgccggagctgggtgggaaccagactgatcccagggctgcccttggccagcctgtccccgaagctcccttcccaaggccttggcatctgaaccgcctcgacccgcagggaccacaggctcaccatgctgctgcgtgaatccctggccaccgctggctgccgcaccaccatgatcgcccacgtgtcggatgcgccagcccagcacgcagagacactcagcaccgtgcagctcgccgcccgcatccaccgcctgcgcaggaagaaggccaaggtgctccccacctcctgcccgccccatctcggggccgtctcggctcctgtgtccactgcaggcctctgctggcctggttggggtgggggtcagcaggtggcctggagcctgggtagatgtcctatgtgttctgatgtcatgaggctatgcccatgtggccctccctggggggtggggagcccagcctgaggtccctggctgcagtgggcagaatcggggcttgctgtatgtggcttgtggtggcctcactccagcctgctgcccccgcacaggccctggggtgctcaggagagccgcaccacctctgcaggggcttcctagggacccctctctggggctggagggtggagtttggggcactctggggttacacggcccttggtgtgagtcctggccactggcctgggcacacatgcttgtcttttgagcttcccgttccctcccagcgcggggtgacaccgttttccttgtaaagttgctaagaatggtcacttaagttcttcccctgagactcagttccgctcccagcgtttggtgggacatggttggtggtgcctgctgtagttttcatcacagtgaccgcagcattggccctgtgctctggggagggtcggggaagcgggggcgtgtaggggagactgggctcggcagctccacttttcttcccccagtacgcctccagctcctctggcggggagagctcctgtgaggaaggccgggcccgtcggcccccgcacctgcggcccttccacccacgcactgtggccctggaccccgaccgcacgcctccctgcctgcccggtgaccccgattactcctccagcagcgagcagtcctgtgacacggtcatctacgtggggcccggtggggcggcgctgtcagaccgggagctcaccgacaacgaaggtccgcctgacttcgtgcccatcatccctgccctgagccgccaccggccctccaagggtccccgagacgcagaccacttccgctgcagcaccttcgcggagctgcaggagcggctggaatgcatggacggcaacgagggtccctcaggaggtccaggtggcaccgacggagctcaggccagccccgcccgagggggccggaagccctcgccaccagaggctgcatcccccaggaaggccgtgggcaccccgatggctgccagcacccctcgaggcagttctggtccagacacccaccagggtacccctgagccctgcaaggccattgtctggggtgaccagagagaggacagcagcgcttggcctgagctgctggtcccggaaaaggctgcagtgagtggaggcaggaggccactgcccagcccggctcccccacctcctcagttgctggaagcctgcagagccccagaagagcctgggggagggggcactgatggagtggcacggacccctcccgtgggcatgagtgggcaggtggctgggtccccgatgcttcctggggccacctgcccccgcctggctgctggcagtcgctgtccggagcggggcctgctcaccaccacagtgaccctgcagcggccagtggagctcaacggcgaggacgagctggtgttcacggtggtggaggagctgtccctgggggcgcttgccggagctgggcggcccaccagcctggctagcttcgacagtgactgctccctgcgggccctggcctcggggtcccggccagtcagcatcatcagcagcatcaatgatgagtttgacgcctacacctctcaggcccctgagggggggcccctggagggggcagcctgggccggcagcagtcacggctcctccatcagctcctggctcagcgaggtcagcgtctgcactgccgacagccgtgaccccacgccgcagccccgcttcagccccgactcgctggcagggcttgaccctgggggcccccctgccctggatggttccctgggggatggaagctctgggttcctggggccagacagacctgacagtcctgggccaacctggggtccgtgccctggggaagtggctgcagtggccccatcccgacccggcagggagccccaggccgggccctcgcggtgggcatccgcagcccagaccatccactccagcctcccccggaaaccgaggactgcctctgccaccacccgtgtgggctgtgctcgcctgggccagagcccacctggccgtggaggcctgtttgaggacccatggctgctccgggtaggggagtgtgatacccaggcagcttctgctggcagggcccccagccccacacttggctccccccggctgcctgaggcccaggtgatgctagcctgtgcccagagagtggtggacgggtgtgaggtggcagccagggcggcccgcaggccagaggctgtggctcggatcccaccgctgcggaggggtgccaccacgctgggtgtgacaacgccagctgtgtcctggggagatgctcccacggaggtggtggcctgctcggggagcctgaaggcctcccccaccagcaagaagggtctggctcccaaggcgggcttcctcccgaggcccagtggggcggcccccccggccccacccacgcggaagtccagcctggagcagaggagcagcccggcctcggcccctccgcatgctgtgaacccggcgcgggtcggggctgctgctgtccttcgaggggaggaggagcccagacccagcagccgggctgaccactctgtccccagggccacgtccagcctgaaggcccgggccagcaaggtagaagcagcacaccgtcttgccggacacgcgtctctggagcggtacgaaggcctggcgcacagcagcagcaagggccgggaagcccctgggcggcctccccgggctgtacccaagctgggtgtgccaccctccagccccacacacggtccagctcccgcctgtaggagcggcgcagccaaggctgtgggggcccccaagccccctgttggtggaggcaagggccgtggcctagtggctggtgggtcgcgggctctggggccttcggtgaagctgtctacggcctctgtgacgggcaggagccctggcggccctgtggccggtcccagagcagccccacgggccgggcccagtgtcggggcgaaggctggccggggtaccgtcatgggcacaaagcaggcgctccgggctgctcacagccgcgtccatgagctgtcagccagtggagccccgggccgaggtggctcctcgtggggctcggcggactcagacagcggccatgacagcggcgtgaacgtgggggaggagcggccacccacgggcccggccctgccctccccctacagcaaggtgaccgccccacggcggccccagcgctacagcagcggccatggcagcgacaacagcagcgtgctgagtggagagctgccgcccgccatgggccgcaccgcccttttccaccacagcggtggcagcagtggctatgagagcctgcggcgcgacagcgaggccaccggcagcgcctcctccgcccctgactccatgagcgagagtggggctgcctccccaggcgcccgcacccgcagcctcaagtcccccaagaagagggccacaggtgggtgcagaggtgcacagccctctacagtttacgggctttctgtgtgtagatgtgcacagccctctacagtttacagggccaggagatgctggacagatgggcacagccttcaaggtcccagacccacacagccgtggacggtttacagactcgcctggggctttttgtgtgtggaggtgcacggccctctgcagtttataaaccccctgtacttgcccttctctggccccaccctgccctggggggctgatcctggtctgtgtctgggtgagcacaagggcagccctgcacaggtcgccaggctggggcactggactcgggtttgggtcccgggcctcgtgcctccctggcgagtgtcgagctgcctggaaggcccccgccagggctgccccaagggacagaactgctcaggtcatggcagggaaagtgggaggccctggtggtggtgggggcgcccttgagagctgtgggcctggcttggggtcggcttcctccctgccctgggcagagcgccagcctgaggattcctggactggatcccgaaggcctccctgtcaggactcgggccggctccgcagcgtccccgcaggggctgtgcttgggctgggccccgcctctgttcaccctgtgcccggctctccgttccaggtctgcagcggcggcgcctgattcccgccccactgcccgacaccactgccctgggccgtaagcccagcctccccgggcagtgggtggacctgcccccgcccctggctggctccctgaaggagccgttcgagatcaaggtgtacgagatcgatgacgtggagcgccttcagcggccccgccccaccccgagggaggcccccacccaggtagggcctttggtgggctggggtctatgacccctggtggggagcctgccgcggatggcagagtgagccatttgatgggctcgccaggcctctgggggtgtggctgggcagcccctgacctcactttctgtccacgttcctcccaggacgcaaaggtaggagcggccctgcccagcccaagcctgttgcagctccgacactccccttgggcagtgggtgggtggctggggggtcctgaggccactgctgctgtccgctggaattctcccctgtcgtggggagggtggtcctagagccgagccaggacccagacgggcatgggtgggctgccccaggtccgccccctgcccgcccttggagccccactgtgtgcctgccaaggcctggcaggtgaagggaggcgggggccacatcagggctgcttgggggtctctggggagagggtcccatgcctgagcccccgcccgccctgcctcccagggtctggcgtgcgtcagtacaaggctgcggctggcggagcgcaggcagcagcggctgcgggaggtgcaggccaagcacaagcacctgtgtgaggagctggccgagacccagggccggctgatgctggagcctggccgctggctggagcagtgtgagtcccgcccgcccacggacccagcccggcccaccgtgtgccctgacagctgccctcccctcccagagccctgttgctctcctgtacctcgtggtgggaaggctggaaggcagggtcggccgggccaagatgcctttcctggggcctctggggggccaggtggctgcccccagcctcgggcctgacgcaggtgcccctcccctctcctcccctccccagttgaggtggacccggagctggagcccgagtcggccgagtacctggcggccctggagcgagccacggcggccctggagcagtgcgtgaacctgtgcaaggcgcacgtcatgatggtcacctgcttcgacatcagcgttgcagccagtgctgccatcccggggccgcaggaggtggacgtctgaggctgggcgccggacaagaggagggggcgtgcagcgggctggaggacgggacgtgggacggagcgaggatgtggtgggggctgcggggggaggatgcggaggggtttctgtgcaggacgggagtctcagagaggagacggagtgtgggggagggagggccggccacgcggtggacagagcgagggtgccagggtgaccagaagaccgtcaccacccgacagcaacgcaagtgcctttgaccttgatttggacttttctcccttttgcatttggtgctacagacttgagacaccagcagaagttgtgttcagcccggccccgctgcgcctgtccgggccggggctggcgccggttgtgtttgtgtccaccttgccttctttgcagccaagcagtttttgtggagtggagtgggacttacctgcacgccccaggggtctttcaggattcaggatgacttttcttttacaatggtttcctctcggcagagcccgggttgtgggggatctgtgtggggttctcaacgcagatccatcctggggtctcccgggcagggatggctgacctcgagtcccctcccttcccgagaacccgctctgtcccgagggcagctaacaagggctgagccccaggtacaggttgcctcttccacggcaggaatttttaccaaaaccacaagcaaaaaacaaaacagaccaccacgaccaacaacaaagatggggggtagggttttgtaaaggttctgttaggttcatatttttatatcattttgcccataaatgcggaatttgccgtgggaatttgaagacaaatgatctatgtttttatggttttctagggaaggtgttctgggggccgggctctctccagctgtgggaggcctgctccctctggggggcaccctgggcagggtgggggggccttgggaggcgcttcttgccaaatgcagacgaggggtgagcctgccagcgtttgcgacgtccccgcacgacaggctcatactttctgaggatcgtgcatagcataggacgtctgaacctttgtacaaatgtgtagatgacatcttgctacagcttttatttgtgaattaaagatgcatcgatggttcccacggctgccgagttcactgggcgtcggcagactcctcacgccctggtgtgccgccctctgagggtccctggggtgacgggcagtaagcgtgggaaggacacatccacggggacccagggcttcgggtgctgtgccagggcctgccttgcagcccctgtggggcccacggtgccatgagggcccttcagagaaggtggaacacgacagagctgggattcaagcccacgcttcctttctgatctgctttcttgttgactctgctgagatcttagggtcccgaggctggggcagggagccaggcttgggggctgggctggcgggaaacagccctgtgtaagcggcccctggctcccttgtctctgggttatgctgtgtggggaagtcgaggcaggagtgatggcagcatttccctcccagagtcttcttgccatcctctgccctctgcctacctttgctcatgggctcaggacccccgaaccacaagagccccctcccggggcagcctggatggaggctcttccctggaggactcaggcctgggtctgtcttgaccccagtttgctgggctttcccgtggtcagaggccccagaccctttgggggatccccagccctttgactgctgtgagctcatggcctcacctgacctgtacatgtgccctctggggccaccttagctgttgctctggttgcctcctggcctcttcggagtcctatctgcttctcatttggtaggtccccagcggaactagtttgcttccttaagcctgttactctgtccccatgccagtaccccccgcctgcctggcctgcgaaggttgtgtctgggcacctgcccctttctgcggctttgcactggcttccagctgctccactccaccttcaacccgaggtcctggccatgaggccccaccatcccccgtgctgtgatcccctgcccagaggctggctgtgcagcccctccctcccttggggactccccctgtccccggctaggtgcccctccctggctccaggcgggggatggtggggcccctccttggtggaggctcctaggcctctctgccatggcacgtcacaccttgtgcggtctctgcctgtctcccggcctggcggggtctgagtcatcaccttccccgatcctgggcacagggataggcccagcagggctgaggagacactggctgaagaaggaataaaagaatacgtgaatgacagcatccccttaaagaggctccggctgcggtggaagcaggtccaggacagctctgagccgtctgcagagagcctcccgccggccctgcactgtggtcccacacagacacagtccttcgtgtggccacagggccccccaggtcaggccacagggtcacccgcacccaggcccctagtgtccatcgcaggtggcccttgggactccagcctctgggattggggttgcaggccagcctgggaggctgctggggcccctgatcctccagccccagccctgcttttgttggaggccagcgctgcgtcccagcagaaactcagactaatgtggagggcagggttgttcccgagaagccgagggccacgcatgccggctctgtgctgggtttggagaacttggcgagggggtcgggtccgggtggggtgtgatggagcttggggtgtggaggggtgatcctctcaggaccctgctctcaggagagcctgagaagcccaccaggcctgtgtcctggaaacctggtgcagctggctgtgacccctgacctgcacagaggcactggccaggcactctgtccatgggatccaggacagtgctggggtctgagtggggttgggtgggtcagggtacctcattctcagggaccggggtgatgctggtcccaggagggaggctggggagctgccctagagcccagaccactgcggggtgccggctcttgctcccttcttgccctgtacctgctcacctgcaggggatgggtgggtgctgaggcgtgtctgggtgggtccctttctttcatagagcacaccctgccccctccccatccctctgtcattggaggggtccagagcctgcttcttgctggggagcctggtcctccctccctggacctgggtcctccctgcctggaccccggtcctcgctgcctggaccccggtcctccctgcctggacccccgtcctccctgtctggaccccggtcctcctgcctgccgggctggcgtggctggggccttggggatggtggcctttgggcaggccaggccgggcccatttcccacagttcaggcctggctctcagagggcagtgcctgttttacaggacgtggaatccactgtcttggggccagcccaggagctggggcggcctttcatctgggacatcaaagccctcagccctgtcattaggggctggaaagctggctggggagcggcccaagtaggagtcacccattttatggatgggaaagcggcagccgccccggacccagctctttgactgaaactgaagctaaggcagcggcaccaatgcagcctgcagggagcctccacctcctgcttccgggacatttggggaaactgaggccctgagagggcaaaggagcctccacctcctgcttccgggacacttggggaaactgaggccctgagagggcaagggagcctctgcctcctgcttccgggacatttggggaaactgcggccctgagagggcaagggctgcttgagcctccagcaggtgttccttgaggattaggggggcggatttggagtgtgcaggggcaggatgggaggggctcacaggggagggtcagggtcagctgaggtggggagaaatggcagcctacggggagccacgcagctgctgatggtggatggccagggctgaggtgggtttggggttaggggagtgggcgcaggaaaggatcttgctgggctgtgccgggcactggcaaggtcctcccaggtggtgtctcttgtagcctctgaggctggcctggcacctggccagcctgcccctgccatggagtgaggtgcccacctgactcacccagtaagtccaggcctgccctgacggccctgcccacaccagccctagcacgggaggccacgttgtggggtggggtgaccaggggcagggggtcatgaggtggctaagaggaggccagagctgggtgggctgggcaggccagtgggacaggagctgagctacatggcctggggggcccgcagagccgctccacagtccgccctgctcgcagagtggcggagggtccgtgagccacggtctgatttcccggggccccgccaggctgtctgccccgctccttgctggagggcgggggggttccctattccaaggactgggatccgcaggaggcggaagagcagaggcccctcatccctggactctagggtcctcctatctggctgggcgtggtaggcgtctgggaaactgactgcagcttcagtagcaggcgctgggctcagaggttccctgtgagcctcctcctgttcaccatcccagggaccacaagtgcaacccatagcgatggccatggggatgtgacactagggtgggatgggaacagtggcagcaatgacagtgggagtgctggcagaggagcgttggtggcagggaggctggtggctgtggctggggtggggccattggcagagcagcagcagtactagggatggtggcagcagagatccaaccagcctggctgatggggcagtgtcgcccctcctggcctgctggtcgcttggctgccctcgggcctgtgtgttcctcatgaggccagcaggacgtggcccgagcctggtcctttcctgacacccttttccctgggaactgggagtgaggtcacagcagcctccacagggttctcactgggtcctgagccccagcagctgaaggggggaatgggggccgcctggagtgcccaagatgggggccctaaataaccagcagcggggtcattgccggatgatgccacgttctcccggggtcccgggccgggaggggaggctctgccagtccccctgtgtctcgagcctcagtctccctctctgccgaggttcctgttcacgtgtgcggtcatgtgtgtgaacatggctcagcacctgtcctcatctgcttccccccaccagggccgcccccggctaccgtgaaatggacggtgctctgggctctccagaaggggaccagtctcggcccccacaccctggttccctgggaatccgaggaggcccctgccctgtgactgcgccccacgccccagggcctgtctgcagccctggcgggagggtgattcctggggtggaggccccctgtctgctcctctcctgggaacgagccccgccccacggtgcctgggggctgggatgtgctcccagcaaacaggaagcccagggtgacttctccctcctgacattgtgtttaccaaggcgggatccaggcccgtttccacacaggaaacccaggaggctggaagaggctgggaaggaattccctgggccagctaagacgctccggcttcctgtaggacaggcaggcagtgtggggtgggggtggagtggggtgggggtagaggtgtggggtgggtgggtttggggttgagggatgggtagaggtgggagtgggggtagaggtgtggggtgggtgtgggtggtatgaatagagagatggggtggggataggagtggggtgggggtaggggtgggttgggggagtaaagggatggggtggggtgagggtaggtgtggggggatggggttggggtacggatggggtgggagggtagagagatggggtggggtgagggtgggtgtggggagattgggtgggggtagagatgggggtagatggatggggtggggtagagggatggggtgggtgtggaggatggggtggggtggggtgggtgttgggggtacaggtgaagggatggggtggggtggggtgggtgtggaggatggggttgggtggggtgggtgttgggggtacaggtgataagcagctaggagtccagggaggctcctggggctccgggtggccgtggtggaacccccttcagagctctggatttggtggcagccttgaacgtccctgtgtccccatgttgtcaccgggacctgcaggcccaggcccaggtctgtctcccttcagacaggccaaggctgaggggcacagtgtctccctctgcagagtccctgtggccggcacaggggacgcgtgagcctggacatttgtgatttcagggcagaggcttccaggagggctgggagcagagtggggccctgaaggtgctcgctccacacctgggcctggggcagccagaaggtcccccctaaactccctcctggccaccttgtcaggaggaggtgtcatgtcccaaatgtgggtcccccccaccttcccccgtctgcctgcgcccagctgcaccagaccttggccttcgggggtgctgtttgtttcagaatcatcttttaaaactcagccttcttttgggtttgcagaaaaaccctgaggctcacacagagcccccacacccgaccgcaggctccagtgccccctcccacgggcatgcagcgaggcggtggcgacggccccaactcaggtcgcccgagttcctgtccgctgccccttccgggctccgcctctggaggcagagacgtaaagcacctggaattctgcacgggagatttgtctcctctctcatttattaatttatccaaatactttcggcagcgtggacttagagatgtttgttttgtactttgggttacattcaatactgttagtttcatgactaaagctgttccagctctggccagtgggagcctttcagctgggtggcgtcggttttgagtcctcaaccattgcccccaggtccccatggcccccagacgtgagctggtgctgcctggttcctaggcctgcgggcatgtgcgtccccttcccccgccccccacacgcgtggctgacatgtccctgccaggatgtgtgattatatatatatagaaattagaaattactagaaagggtctcactgtcttccaggctggagtgcagtggtgcgatcatagctcactgcagtctcaagctcccaggttcaaatgatcctccagcctcagcctcccacgtagctgggaccacaggtgtgccaccatgcttggctagttttgtatttttttgcaaagagggggtctcattttgtttcccaggctggtctggaactcttgggctcaagcaatcctcctgcctcggcctcccgaagtgctgagaatacaggcatgagccattgccccggcccttggataacgcttcacaccagttgcttcgcacagtccttagctctctgcttgacagcccccgagcccacaggcctgggagtctccacccctctgaagccgcagaagtgaggggatgtaatggctgaggcccgggcgtggtggggggtcgaggtctccaagcacccgggtggaaggaagtgtatctgggccccgtgagcagacgggagctcctgctgggaggaactgtacctgggaagagggaccccacccctgcccaggcccctgagcagcccaggaccctcccccaaggaggtctgaggtgagatgaggcccctggagatgccccaggagggtgctgtccagggtcacagccccgtgccaggctggggcctccctggtgaactcggtggcccggagtggatgaatggcatgcgggaggcgcctgctggctgccagggcgggcgatgctgggctagttgccactgtggcacagcctggccctggggtaatgacattcctgagaaccctcagggtgacatcactgcgtagctgccttcacactgttgtcaccatcacgggagtgtgaggtcagatggacgtgctgtccctggggtgtcaggccccctgccagtgctggccagtctgccctgcctgccatacggggcttcagccggctttctgaagcatcccgtggacctggcgggggcggcctgggggtggggagggctgagactgctgccacttccttgccattcctggggggccgcagggtcaccatttgctcccactgctgacctggaggaaggcagcctctctcctcggtgggctcctggttatctcagccctttggggaaacacttggtccaggttcgggaaacggctctgctgccctcaaggggaagcccatgtgcctcaccgaggaaactcccaggcggggccgttggtaacactggaaccctgaagggaccttgcatagctgggcaggaagggaccaggggcttgaggggcgcaggggtggggcctggccggccactgcacttcaggtcctgggcaggcgcctcctttctgtgccttgatttcccctcctgtagcaggagcagctgtctgctgcgtctgagctggctgatttggaataaatctctgccgtttctccagccccaggggcggcgggccatatttctcgcagcctcagcggctgtcccgcaaagctaatctgcctggcagaggggtgacactctaaatcctgtgcccaggctgatttgtgggcctgcctgtgctggtgcagggctcgctggcatctttatgaggcaggatgagcctcgctgagagccagggcaggctgggtgtgatctacagcctgggcggcccccgcctgccagcagccgccgctcacgcccactgggcagggtgctctggcccaggctgagggcagccaggtgtctgactcctgttgttcctgctccgggagccttggaattcacctgcaggaaggaggtttcacagcacacagctatccagggggcgcttcctgagcatcgtggcctgggctctgggccgggctgagctgagagggccagatgagggagacccaggtcctgcctgtagggaacccaggcttcctgggccatgggcaggcgacacctctctgccaaggcaggagggatcagtccattctggcctggaggtggctgagccaggagggcatctgcctctgagacagcctgcaaagcatcggtgctggaaatcgcctgggttccaaccccagctctgccacttcccacctgggctgccggaggagttccctgagatgggcagggatggggcctggctggcctggcgggggcctggagagcaagggggccatgcactctgtctcaggggggaccccagtgaggcccccctgcacctgtgttcgttgtttcctcctcagcagcgcagaaggctcctgttagctttacccaacgggctggctgagcacctgggagggcagttcctcagggctggctgctgtgtgaggggagccagggtccctgggacagtacagggggtgaggaggcaggtagcaggccccctacagcctcacagtgccacggggctggcggcatggccagggctctgagccgttggtgcaggagggcgcccaggcccagttagtccgaggtgggacctggaggctggtgcaggccactgtttacttacttcccgttatgctgatctgcctgagagattcagtccccggctgcgcgtgtcaggccatgcagtttgttaataaggcacagaggagagtaaaacacctcctctaggtggccagatttatcacttggtgtgtgcacacatgagcaggtgcacacatacatgagcacacacatacatgagcacacacacacacacatgggcacatgcacgtagggacacatgtacacacatgcacacatgggcacacatgcacgtagaggcacacccgtacacatacatgcacacacgggcgcacatgcacctagggacacacacgtgcacacacgtgcacacacgggtgcacatgcacataggggcgcacatgcacacacgggcacacatgcacctagggacacacatgtacacacatacatgcacacgggcacacaggcacgtaggggcacacccgcacacacgcatgcacacgggcacacatgcacttagggacacacatgtacacacacatgcgcacatgggcgcatgcatgcacacacacacacgtgcactcaggagtcatgggacccgatgccctgctcttatgtccatcttcttggagccctggcatgggggctcccccaccagtccccacctccagctcttcctggcaagcccgtggggaggggaggaacttggcctgcgttcccacagactggcacagggagcaaatctgcccagcaaaggttgggtggcctgcagacccaagcccactctgctggacacctgggctcaggtgctagaccgggggctgctcttgcgggcagaggaggcctctgagctgctgccgggagaaggaggctgggctccagggtcgggggttcagggctgtgggtttggggatctgggggtcctgggtctgaggatctgaggtgggaggacctgggaatctgtgagtttggggattgaagcttcagctcagagcccagtgctgctttggagtgtcccctgaaggaacctggagtagagcaccagcattttcttccagaagcttcttttgggccactattgtctcagactggtacccggccaggacatgcatgggaaggtggcctctggtggcctgtggccagctgtgcttggtgacttccaggccagagcctaggtagactggcccaaaccctcagagggtccccccagggcagatgggcttcccggtgtaggctgtatctgtggagcccagggaagggggcgtgcgggagggcaagggggctgctgagggtgggatgtgggtggaggaggcaggatggaaggcaggggcagggctgagacctggcagtaatggggccacactcagaaggacccacactgttatgcccagtcgtcgccaccttgaagttcataacgactcttggataaggtgcccagggtttctgttacgctgtgggccccacccaaaattatgtggctggttctgaagaggggactctgggagcgggaaaggcaggcacagaggctgaggtgggagtgctggggaggccgggggtccacgctagctgtctccattcctgattcctgccctgggggcagagggtggggctggtcgggcctgcagctcactgtcctgaaccccagttgcctccatcccgtgcctcctccctgctccccgccatgagccaggctgcagaggtgggctgtactcccagactcagcatcaaaaactgccctgtgacctaggaaagccccttggcctcgcactggtgaaatgacactgacctttgatttttgcactttaaagggtggaggttggaaaggtctggcgagagccacagcctggccttgcaggagccagctccgacctgtgacctcagccccctgggcctcagtttccccattatggaaatgggaacttggaggcttagggctccctgcacagtggaggtgggtgggtccctgaatggggagagcagaggctttggggcaagaagttttggtgggtgagaggcagaggtggggaatgcaggcaggggcctccccttgcacctgcattcaggggaacagaggacgtgtgggccaagaccctaggaggtctgaggactggtcccaggttggggtgggcatggtggctcggccaccgtggggaggcagagggctgctcgtaaatccacgctgctgtcagctgaacggcaattgcggattgaggcggccatcggggctgacctcctgggtctgacgggtccatcacagagcagcaccgcagggagaggcggctctgcctgggaacccacctgcacggaccacacggcccagggcctgccagttcctgcctcccgttcctgggtggggctcacctagtgtcacagagacacggagtgtcgggcagtgactggcctcagtgcccagaccagctgggctatctgagtgcaaattctgcctgctgtgtgaccccaggtgtgctactgaacctctctgtgctcctctgaaactggagatccgtattcacccctacctcactggggctcagttagatgatttgacccggagtatgcagcttagtggtgcctggcacataaggaacgccaatggatttggctccaatggggatggcacggacaggggtaggatgatgtgtgcacagtgcagcctcccgtcgggtccacggccaggctctgctcccaccagctgtgtggactcaacatggagcctgggaaatagaaaaaggcctgtgaagtgcccggagccagcggcacagggtgggggcaccaggagctgctgcctggtcctctctagggcagtgactatttgctgccattgccacggggatttatcggggcccctccatgtccaggcgtgggcaggtatccgtgtcaccccgtgttacagaccaggaaggccaggtccagggcaggccggcctgtgcaaggctgacgggaggaaggagagccaggcctctccctgcctcgcctcgcagcagagccctgggtctgggcaggaggacgggcggccacaaggagggccagacccaccctggggccacactgggttgcgtctgcccctggggtgagcctggtggagccggaggggcactgcagaggggcagaggggtctcctcgcactcggcatggactctgcccctgctcctgagactggttggccttgagggctcctccgggagcctggtgccctcactcttcagaacagctcagcacccacagcctggccagctggagcagctgggtggtggttcagatgggatggtggggtcagtgggacaggctctggcttctgggggcaaggaatgagctggaggcaggggaaaaggaaggggctgggcgttgggcgggctggcacatgggatgtgcctgctgaggcctgtgggcaggtcttggtctggggacagccctgcccctgtgtgtacctggctccctgctccaggcagctccccaatctcaggctcagctacccggggccctctgccctcgtctttctgcccagctcttgggggctgtcctgcttctgtctcccaagggcctcacccagagctgaggcaggggtggggatgccccctgcctgtggctggttggcctgctctctctcctgctccctttgctgtgagttgggtgaggagggggctccgccgcacttgagagcttctagcagcagcgcaccaggcacaggcatcgtggcgtcgggtggcaatacatggggtgtgaacatagagccggggcaggttgagcagactcgcaaatgagctcccagcccccagggaggccttgtgggagaccccagcccactcccagggacctaccccagtgcacccctggggaaatcaaggctggggtggtctcctctcgcaaggctgctcagccctctcctccccaaccaccgaggcctctgctgggcgagatctcacagccttcaaaggcagagccctggtgcccttctcttggcatctgtgcccacttctcggcccccaccccggccactcccccccaccctgtggatgtgtctttcatctgtccctttgtggccctcagccctgtcctcctccctgcactctccctgggccacctgcccctgccctggggcttcacgtccccctgggccaccttggcccccagaccccatccctgtgccccacatctgcagttccatcgtttctctggtatctgccccatgtccctccggcccccagatctctcagacttgttctcccctgtgcacccctcctgggggccctgtttcatcctcttccggaaccggggcatcaacttgggttccctcctcaccctcagtgcctccacccagccccagtgccatggcagggtcgggaccctcaagctctcagggctggtccaggaagagcctctgtccaggtgacctgggcacagggggagcatggcagtggcgggggcaggtgggaagggattggcttaaaatgcagcattcacttaaaaacacaaagaacatttgttcaccatgaagtcaggtcctgctctggttggtctgtttttggtttttacctggttttttggtaattacctggtttgctttgagctgcttccaggcatcagccagccccatatcctggtggggtttcctggggccccatttatgctcccttggaagtaccagagggtcttcttttctcttaaagaaacaaatatttgcacagttcagcgctgggaaggcctctggccgaggtggcccgcgcaccctgagccatgaggggtcagggctgggcagaggggagggggtggatgaacggcttctgcagagacagtcttggctccacaatctcctcagctcaggagtgtggatgtgccatcctggagcaggtgcctgtctctccatggtcctggctgggtgccgtgggttccggacggcagggcacctgcccatccagggctccggagcagcgaggctaggctgggccttcagctctgtccttgctgggcagcgatttcctcttctggacaatggggagagctgtccctcgtcctggagggtgaagtgggtggtgtgcgtgatgatccccggtgcccagcacatggtgggctcagtgaagccagacttttctagttcttctttagttccctagacctaagctctcagctcgtgctgtgtcagggctgtgttgagggagggaagtcaggtgtagactgaagctcttaagactcttaagagcttctacggtccagggtgtcacctacggtccagcaggtgactgatggtctagcagacgattaggccagtagagaggcagagaaagtgcgggggactcagaggaagggaagtgcttccatctgggccaggggtggttagggaagacttcccggaagaggaggtgcttaggggaacctggaagggcagagagaaccagagatgcaggggtgagggtccttctggcaggtgtctgtttcaggggatgtctgtgttcggtgaggccagggctgagctctactgttggctgagctgtgggggcggccaggcagggcccagcatgccaggctgaggatggggccaaggggggcacggcatgctggcccccctgcttggtgttcactcttggggactggacagtggtcctttcaacgagccccctcgcagtccctgccctggggtctctccatagaccactctgcacacgcagaccctcctgctagcggaccgggccacagcgaggagtgaagaccctgtgcagagttctcgtgcggccaaggacagcagcccacctgagacaggtgccctgtagtagtggcgggagtcagagacaccccagggacagcagcaggggctgcttgcggtttggaagtcccacctgtgcccagaccaccagcagggtctctccttcccaaaccaccccctttccaattctgggggcgtcagagactgctgggggcatggggtgaggcagggaagggtggtgcgggaggctgagtgggagggagagggtgggatgaggccctgcatgctggacaggactctgatgcatcacccatcccagggaatctgagtctgaaacacagaaaggacccacagccattgggtgtccccgggccttagcttgctgggcccagggcaggccgggctgcttcttgcccggggaactcagcagacccctggatcgctccggggtgggtgagaggctgtggagggaaccctgtcctggccggctgacctcacagccctctcctgcagacggggcagtcgaggagtaaaagaatgaaaagcagtcaaacagccccaggagacgcaggtgaggctgggcgacgagcggaagctggagatggggccgcatggtgggcagcagcagggcaggcttgtggggtgaaggaggctggggcatccggcatggcagaggcagcttgagtttggcggaagggtgaggcgtggggcctgggcccacaggaggccagcgtggtttgggggcctggttgggtctgagatgctttgggtggtccgggggacgtgtcccataggcagctccaggtggaagctttgggctgaggcagaggctgcctatgcactcaccagctcgttaattcatccttcattcttgccgggagctgttggggaggccatgctgggggccggctcctgctggctgacaggagccagttgttccacagatttgtcattcaatagtgtagaatcagatcatgtcctcgttctcgccacggcgcggaaagctaacaagagtcagcccggctgcaatctgcagtgctggcggttcccgttgaatgagtgaaattggtgtgagggtgagataggcggtcgttgaacagagagcacacatcagacctcacgacaatgagcttcttgggaaaagagacctggcttcctttgttgactcgcgggagtggcagctgcggggctggctggaaatgagagcagagccaaggagccttcagggctcagacttcaccagggagagttgtgtatctgtttgtgttatttctaaactgtgtgtacaggtctttcatggcggtaacatgtataatcaacgtgcattcgcatacacaagcatctgttcttttctctgagccagttgttaaaacatttaccagcaccgctgtgggggctggggagaaggtgctttggaggggggtgggtgggacaccttagggtggggagagggtgtgtaggatgagcccaggtagagaaagagaaggcaagggcaggggaggtggtgtctaaattagggcagagcttaccaaggacaggccaaggcaaggaagggggaaggtggccgtggtcatggctgggcgggaaggagggtgcaggaggcggggccgtggtgccgggctagaaggaggcagccacggggttctggtctactgactttcatttccttttctttcttgaagcgtgttccgggcagtccatccaccccccatttctgcctttgcttgtcccgtgcccacaggtgcccctgacaagaacctggtgtgagtggggtgtctgcagttagcttgcagccaggacgaaacatgaatgcacttgtgggtctgcgagcgaagctggtgatgttctctgccaggcagcggctccctggtctccttccaaggttgggcagacatcgcctgcctggagctgggccagaggctgagaaaggcaagggagggtctcagcccccagctcactgcaggaacttgttgcacccatggggactgagaggcagggctgggtcaaggaccagggcctggtggagaggtgggggcctggctgccccagccctgctcagacatgctgttaggccttgggagagccccttcccctctctgggcctcaccatccccactggatgaagtgggggctgggatgctggccttgaggttgatcccagtggtgagatggggtggaattgctgtcctcacgactccaccaacccaccattccctgtccactgttttattattcacttgataaatatctattcagtgcccacttgatgacaggaagtagtacaagtatagtccttgctgtcctggggccaaccccctctcccatatgcccatctatctacctatctctctgttcatcctttctctcagtctgtcagtcattcgccaatctatttttcatactcccatctattgcctcagcccttctctcatctacccatccatccatccatccatcatctatccatatatccactcattatccatccatccacccatcatccatcatccaggcatcatccatcatccattcattcatcatccattcatttatcatcattcattcatccatctattatccattcatccatgattcatccatctatcatccatctagcatccctccatcattcatccattcatcatccatctttcatctatccatccatctattcatcgtctagctattatctttctatccatcatccatcctctattcatcagttcatcccatcgtctacccatccttctatccatatgtcgtccatctatccgccatccatccacctattcatccattcatccatctatccatcatctgtccatccatctacccatccatcaaccagctatcctctattccttcatccactcacccattcatacactcacccttcctctctccctccattcacccacccagttacccattccttcctttctttctctctccttctacccatccatctatccacccacttatccacctacctgctcatccatccatccatctatctgtccatccatccatccatccatccctctttccattcatccttccatttctccctccctttctctctccatccatccatttactcacccacctatccacccacttatccaatggcaatcaagacttgcttcgtgctggactcagggctgggaatgggggtgatagaaatgaggtagacctggttcctgcccttgtagaccttttagcctttgggagaggcatctgtggacttccttactgcttacagcatgggagatatgcttgtgatgtctgcacaggtttggaggcattcaggccacttgggtctcaacggagcctgagctgggctgggcttggccaggctgctctgcaggggaggataccctgatggacagggctcccctcagtggcagtgactctctagtttgctgtattgtctgttggggctgcatttgagaaggtgtgtcctggaacgtgacccatctccccggagcccagcctaggttaggcttaggtgaccccgagggcttggagaggccctgagaaatgactccgtgggtcaggtgagtatggagagaactgtacccaaggttgcccagggagtccagccactggccccatcctctcccctgggaggccgatagctgcctgctgctttccatttggggcagatggactctgtccccaaaggaccctttgccaggtcaccagagctatggcggcatctgcctcctgcctgctgcagagccctgcgtagagctgtccccataagtggcatctggagggccatgtctgttgagagggtgggatattggcatctggcagatccgagtctggctctgacatctttgccggcaaggccctcagccttccttagcctcatttttcacatccataaagtgggaatggctgtgctggagtctgtgtttaagcagccccaggcggcctggagcacatggcgcatgtgtgcgtcagaagggctgcctggggggctcagggaggctctggtgctggggtgcaggaagcttggggacttgggcttagcaagtcactcttgggggtgcctcaggcaactctgttgctctcctagacctgtgggatggatccgtggtgtctgcacctgcacctacatacaaggatggcatagtcctccggaccaaacacattcgatgaggacacgcttttcagtgagagaacagcagcagcaggaacaagcatccgttatgcagacctgcctgtccccgattctcccagacacggagcggcagaggtgtccttctctttctggcaaggtttcagggtagaggcacggtgctcggggtcccacggctggtgggtggcccctgtgcttctcgctttgggatttgctgtccccgagctgcccatcatcgttttctgggtacctgagatgcagtgtggtgagttgggcgtggcctggacacaggctgagcaggtcagggcactgggagctggcctggcaccggctgctgggctggtgaccaaccaacgcagaaccctcaggaaagaggtggggagctgtgcaccagctgtctcggggtgatttgtggggaagccgatgtgtggctgcgtcctgaatcacactgggggtgttgcacacgcccaccaacagccttgttcctaaattatcttttatgatcgccagcaaatctgcgggtagggggcatttgtacccaaacgaagccgttatttgtggtggcagacatggcattaattattgacgcgcccggccacctccagttaaaattcatggtccagccactctgcaaatattgattctgtcccaagttgatgttttccccttaacattattataatgagggataaaaatcaaattgccttcactgaaactcaatcattcttccgtgccattcctcattgatctttctttccccaggttttaccataaattattctattcaattaagtaaactcacacataatggcattctgcaaactgaataatttattgactatgtttggcaaaaggctggtttggagtgggctggggaagggagggggcttggtcctccatgttcccagggctggtggggctgggcaggagctgcggtgggggtgagggtaggggtgggggtggggctggaggccgtgggggtgtctgggcctggggtcctggcggccacagtcaggagctaagtgtcgtccccctgcccatctgcctactgtgcagcctgggccttggcctcatgcctgataccaaaatctgccttcgtctgcttgggccttcgtaacaaatgcgcagacggggcagctgaaacagcggacctttgtggctcacagttctggaaactggaagtctgagctcaaagtgctggcgggttgctgtctgctgaggcctgtcttctgggtgtgccgacggttcctccgtgctgtgtcctcacggggccttccctctgtgcactcatgtgaccctggtgtccaaatatcttcttcgaaggacaccagccagatttgattggggcccatgaacagcctcattttaatttagtcacctttttttttgagatggagtcttgctctgtcgcccaggctggagtgcagtggtgtgatctcggctcacagatgccggtgcccccacttctgggacaacaggaaggctttgagggtctgaaggtcacaggtgcaggctccagagcaggggcgatgggccccacccgtaatgcacccttcccccacctgctctgggccctccacacccttgggagagacccctgggcctgcccggttctggacgtgccaattagagcctcttagcagaggcctggccaggctcgggcacctgggcaccctctgtggatggggacgtggattagggcctgtgtccagcctgatcttggtgggggcatcagccgggaggtgttctgtgtcctggcagcagggcctgtctgtgcctggggcctccaagtacagacccctcaggaaggaggcagagggagtgtggggcgccccaggcctttgtctcagaaaagcgccccagctccgcggctgcattccagttgagtctgagcctgagtcccactccggcagccacagtgcacccagtgggtgggaggcgtggccggggctcggtgcggccccgtgtgtgactggccgtggtggctgtggcttccttgctgccacaaggcctgggctagagctggcccctcctggctggtgctgccgaggagctgcgctgggtgcttcatggatggttacctccagctggtcatgccaggcagggtgtccctcatggggttccggcacgtgagtggcaccctgggggactgctgcaaccaaggctgttggcactgcaggcagctgggcctgtctgtgcgctggccaggccctccctggaagacccaggagcgggttcatctcagccttcaccttgggctgcagagatgagcactccagggaggggaaactgaggccaaggggcccagcaagtgcagagagggggccttctccagccatgggccctgccaccccccacaggtgctgccagagacaaggtgtggagcacccccgccacaccccttttctgcctcagtccacgtgccgccgatacaggactctgcaggacaggccccaactgaggccccggctggtctgtggttcctgcctggccttgggtgtcactgagcttcaggggtgcatctgtcctcagagaagcaggaggggagccacaggaggtgaaggtggagaaagggtgccgaggcggtggagactgtggatggtccgtctcctgccctggacagagggttctgggggcctcgctgacaccagccctgcagcccccagccccacctggcccaccacctctttgcactagggatctctgagtgatttttctccccagtgaagagtggaaaccagctgctgttcagatttcttctctgaaccgattccgtcactgcttcctcccagagcccaggccctctccctggctgttacatatttagtttggacagagtctgggatgtgtgtagctggtagaggggacacggatgcagcttcctctgagctggctttgaggcttcctgggtgagttcagcgggcttctggggtccccaaggcagagacgcctgcctgccttctgccaggctggtggcacagctggccctcacccagcgggcagcacgtgcgtggtttcagacagaagcatggcaggtgtggggttttatggggagcacttccgtatcctcttcctgctgtgcttgagctgtggggagctgctgctggcccttcacgagtctctgggctaagccgggcagttcctccgccagcatggagccgtgctggcgacagcctggtgaatgccaagcagcttggcgcccagcccaactgttaagggtctcatttgcatcaggcagcccagcgccggcttgtccagccctcccgatggccgtcctgggggtgcttggcgtcacccgcgtggaggcagattgtcacgctcggcagctccccagctccgggggcttttacgactggcatcaggtcctgctaattacagggacacatgtgtgccgggtgtgcgtgggagtgtgtgtgggagcatgcgtgggatcgtttatttgagctggatgaggactgaccgacagctgatggttagagggggcagatgggtcaccttccagcttagggtactcctctctgtaggacacgcctggagacagagatgggcaaggtgcttgcgggctgctccctgggtgagtgttagcaagacaggaaaccggggatgcccgggcttcagggagcacatggggtggggatggggttacaagatgctgcacagatgatgctggcaaaaaggcaagagtaacacatggcatgagagagggcagagaaagttctagaaagagaaagcagaggttactttcagctaggagaaccagagaaagcctggaagagacgtgctatggctttgcaaacccacccttggcccctttgtgcccaggaggctgtaggaggcagaggtgctaacagggtcagaggccagaggaggacaggggtgtgttcctgtctccgcctccttggctccctccctggcctccacggtcctggctctccagccctcccgactcctgcaggctcatccatggggtgcgggcccctttcccgtctgtgcctgggtcacagcccaccagagagctcccatgtctaaagccagcagcaggagtttggggctgcaggaagcgcagctgtttttagggattagcgagcattgccagcacctgcttgggttgtgcttcctggccatgccacacctggtggtggcagtgggtgctggggcctttccatgggcccctttgttctatcccacagggctgtgggcaggagagtagccaggacgatgcagtttggtgcattgaagctgccatcagaggagagctcctgatggaaagtgctggggatgcctcgcaggctggcctcacggggccgcagcagggagatcatgagggagaagctctctgtcgtagtggggagttctctggttagtctctttcctcctttcatgcccatcctttctccctcccttccttgctgccttcctttattccactgagctatcctatcttacattattcatctacccatccatccattcatccattcatccatgcatccatccatccatccatgcatccatccatctatccatccatccatccatccatccatccatccatccatccatgcatccacccacctatctgttcatccatccatccatccatccatccatccatccatccatccatgcatccatccacttatctcttcatccatctatccatgcatccatccatccatgcatccatccacctgtctgttcatccatccttccatgcaaccatccatccatgcatccatccatccatgcatcatccatccatccatccatccatccatccatccatgcatccacccacctatctgttcatccatccatccatccatacatacatacatacatccacctatctcttcatccatctgtccatgcatctatccatccatgcatcctccatccatccacccatgcatccacccatccatccatccatccatccatccatccatccatccatctgtctatccatccatccatccatctatccattcatccatccatctatccattcatccatccatgcatccatccacctatctgttcatccatccatccatccatccatccatccatccatccatccatccatctatccatccatccatgcatccacccacctatctgttcatccatccatccatccatccatccatccacttatctcttcatccatctatccatgcatccatccatccatgcatccatccacctgtctgttcatccatccttccatgcaaccatccatccatgcatccatccatccatgcatcctccatccatccatgcatcatccatccatccatccatccgtccatccatccatccatccatccatccatacatacatacatgcatacatccacctatctcttcatccatctgtccatgcatccatccatccatgcatcctccatccatccacccatgcatccacctatccatccatccatccatccatccatccatccatccatctgtccatccatccatccatctatccattcatccatccatgcatccatccacctatctgttcatccatcctttcatgcatccatccatccatgcatccatccatccatgcatccatccacctatctgttcatccatccttccatgcatccatccatccatgcatccatccatccacctatctgttcatccatctttccatgcacccatccatccatgcatccatccacccatctgttcatccatccatccttgtatccatccatccatgcatccatccacctatctgttcatccatccatccatccatccatccatccatccatccatccatctttccttcctttcgtatccatccacctagtcatccttcttttcacccgttacctctttcaacagaaccatgcccagtttagggcctagcccactggtcactagcccatgtaggccattatggtccagagtgctgtgggcccttagggagaacaggaactggaaaggtccagagggtgccccaatgcagctcggaacccgggtgtctgccctgggaggacacaggaaggactgggtctggtgttttgagggttgacaggcagtgagccaggcaggggcagggcatcctggggtgagggcttcgggggaggagagtggcagtgtagggggcaagggacaggtgacctgagggacgttgccccatgctgagatgtcctctgcttacggggaaggccaagccacggacgcagcaccttggtccaagcacacaccttagatcctggagggtcctggatgcatctggtcatggactcaccttgctgcttgctggcaccctccccaggtgtcatgtcgcatctgccctatgtttgtgggtgattgtgaccctttcatgggtggggcagcatgatcggggcagatctctcagctcccttccccggcgtgaccctccgtctttctctttgtcagttctgacatttactcattttttgtctacagagagtggatgagagctctctgccactgtccgggagggctggggctgggtgaggtctgggggctgggtgaggtctgagggctggctggcagctaggaggagggagacatgacgctgacggccctgcattgctgcttcctccagctgaatctaccaccctgacttgtgagtgtcgagggctttctggggagctgctgggactagagaggcgagatcagcaggtgggtgggcctggcctctcagctggcccaggcccttcctctgctcaagcccccggtgagtggagtccctgagctgggtgaccatgagcttgcctgcccggcatggtgtgtgtgcagggctgggagctgggggtagaaacttgagctctgtgccttggtctgcagtggcctgcaaggcctggtgcctccaggccccgactgcgactgcacagcctgagcctgggacaccatctggggccttgcagggctgggccactgctggtcaccacacactgtcctggtcagagtgacccccaggtgatctctgtcctcttcacagaagggtctcctggagaaagccctggagcagacaccagccctggctcgctgcagccttcgagccccactctctcctctggacctcagtttcgccatccatccaatggtgaccactcagtcactgccagatcctgagcagatccgtcctggccctggggagtggaccatcagggggcagggctggccagtgagcagagagctggcggtgacatgggctcagcacagagcaccacgtggggcctgggaggagccatgagagccggcagccctgcctgtcctccagatgaaagcgaggcccgcagcctgagagggagggaggagacgctaattacgcccagcgcggggctccccaggcagcctcagccacaggatcaaacaccgccttcctcagccacgcgcccggtagtgccaagtccaattacaagtctaaccagggctggtgtgggcctcatggaaattcagcaattagacccacctccagcagctcctgatgggcctgctgtgtgtgcatgtgtgtgcccctgtgcctgtgtgcaagtgtgcatgcacatgcccatggatggacacacacagtgtgtgtgtgtgtgtgtgtgtgaagggaagcagggtgaggggactgctcatttaggaggagaggccaaaggaggccaggccccagtcaggccaggagaaggggtccacatgcttgggagatggtgagccagcagggctgctgcctgctgtactggatggaacacgaggccctttgcaggggaggagactgcagctcaggaacagagaaacccccttccccagctctagtggctgagctgctggctcaggcccttggggcttcctggtggaccctcagaagaggggcgcctgggtgctggccttgggtgcagtgtcagcctggatcagggagggaagatggctctgggcatggatggggatggctgggcctggcaggggctctttcatgggtgcatcccaggctcccagcctgtaccctatcctttctagatggtagtctcagccctgcccaagcctgcccctgagatccatcttctcccagccctgagacaaccccttgtgggcctccgtgtctgcccgactggccatatcacagtggtaatgagggcaggtaacgagggcccacagcgtcctgcgccatccacgtggtacagctggtctgcctccctgctgcctcggcaccccggaagccagggcgagcagcttgggtgtctgtgggtgtggggttcggttagagaagctcctaagttctcaggagttctgctggccactgtggcacctggggagtccgcaggacagcccagccctcagcacacagccccagccatttggggggatgctgtgagggtggaccttcccctcctttcccgcctgcccacccttcacctggccaggcctcctccccatgtgcgatgtcctcccagcagtcgcccctcctgctcctcggtcctcacgtccccaggctcccctgcacccctgacaccctctcccctccccctacctccgcagggaggaggtgagactccactccaggggaggggctcggacactggaccagattgaggactagctaaaacagggccgaggtgaaagcagctttcagtcagacctgcccaccagtgtgccatgtcagtttaccattgccatggcaacaccctggagttaccacccctttccgtggcaacgacccaatgactattaccccatccctagaaattcctgcacaaaccaccccttaatctgcatgccattaaaaatgggtaaaaacatgacggcagaactgtcctgagctgctgttccctgcctatggggaagccctgccctgcaggagcagtcacggagctgcgacaccaccagagctgggacaccaccagagctgcgagaccaccagagctgtgacaccaccagagccgggacaccaccagagccgggacaccaccagagccgggacaccaccagagctccgagaccaccagagctgccacaccaccagagctgtgacaccaccagagccgtgacaccaccagagccgggacaccaccagagccgggacaccaccagagccgcgagaccaccagagccgtgacaccaccagagccgggacaccaccagagctgggacaccaccagagctgcgagaccaccagagctgggacaccaccagagctgccacaccaccagagctgcgacagcaccagagccgggacaccagcagagccgggacaccaccagagccgcaacaccaccagagctgcgacaccagcagagccgcgacaccagcagagccgggacaccaccagagccgtgacaccagcagagccgggacaccaccagagctgcgagaccaccagggccgggacaccaccagggccgggacaccaccagagctgcgagaccaccagggccgggacaccaccagagccgggacaccaccagagctgcgagaccaccagggccgtgacaccaccagagccgggacaccaccagagctgggacaccaccagagctgcgagaccaccagagctgggacaccaccagagctgccacaccaccagagctgcgacaccagcagagccgcgacaccagcagagccgggacaccagcagagccgggacaccaccagagccgtgacaccagcagagccgggacaccaccagggccgggacaccagcagagccgggacaccaccagagccgtgacaccagcagagccgggacaccaccagggccgggacaccaccagagctgcgagaccaccagggccgggacaccaccagagccgggacaccaccagagctgggacaccaccagagctgcgagaccaccagagccgtgacaccaccagagccgtgacaccagcagagctgggacaccaccagagctgtgagaccaccagagccgggacaccaccagagccgggacaccaccagagctgcgagaccaccagagccgtgacaccagcagagccgggacaccaccagagccgggacaccaccagagccgggacaccaccagagctccgagaccaccagagctgccacaccaccagagctgtgacaccaccagagctgtgacaccaccagagccgggacaccaccagagccgggacaccaccagagctgcgagaccaccagagctgggacaccaccagagctgggacaccaccagagccgggacaccaccagagctccgagaccaccagagctgccacaccaccagagctgtgacaccaccagagccgggacaccaccagagccgggacaccaccagagccgggacaccaccagagctgtgacactgtggcttcagtaaagctgtttcttctaccactggcttgcccttgcattctttcctgggtgaagccaaaaacccagagggctaaactccactttcgggctcgcctgcctgcatcataaccatcaggcctggagagccgggtctcttgagagtaaactgccgtgagattctacaggaactctgcctctcctctgggctgagctgttctgcctcagtttcctcactaacaaaatggggtgacatcttgaggtggcccctctcggtgctgccagcctctctgctccccactctttttgggcagccctcaaggccctcgtacagcatctggggggcgggtcacactgcatacggcaggggtggggggggtcacagacagaggtgctaaatcgatgcaggacgtccgccccaaagacacgcttgtgctccctttggagagtcctgcatccttcgccctctgttcatctgtctgtttgggtcctggggatgagtctaggtggcggccatctccggatgtccccaggttgctctgtgtggggaagggtggggaggctgctgggaactggactctcctggagagaggcagggccagtgggctgtgggtgctggggcttggcacggtgctccccagcctggtggccccctctgcagtggatggagtcgggatcctgggggcagtgagtctgggaccccgtcttgggaagtcagccagccccaggagctgatttggccaacctggcctcaattgagcaccaagggggcctgagggagcaccgagggggcctcctgggagtttgtcacatgatggaggcctcgagccgtggcccggctctgtctgctcgcgccccctcacccacggctggctattgtggatggtgatgttcctgttacaactgagggatctccatagaaacccaacaaggtctaattagacacaagtaagtgcttcccaaatgcattttaattacagctctgctgaaatgaacgtcaaactgaggtttcagttgctgcgtgtgtgaaccgaattggcgccttctccttttccagccatcagtatgccttttgtgcgattttgtgttagcacccagcaggatggggtgtcagagcctcagagtccccagggagtgtccccgtcccagcccagaggggaagcggcactggggcccaggggcagtggtggggaccctgggatgcagagggaagaacctggggttccggggggcagggctgggggagggattgagggagtgcccggcattgctgctggcaccaggggggtgtctgtgcatgaggaggggctgagaagagtcagctggtccttgcagaagggggcccctgggaggggcccacccagacaggccaggtgccaagtagcatggggagtccttgtggcgtgggtcttggggggcgaggcctgggccacattgctgggtgggccttcagcagggaggagctcagggggtctcctgaggggatttccttcctcccttacaagagacctggggccagggtatgactggccacccaaattcgcacccagggtcccttcagcgcgggctgggcgggcagccgagagctgggctcaatctctccgtcacacctgcctctcagacgcgcatcatgggattctgatccccaccagaagctcagaatgtgacaaatgagcagaaagaagatcccggggtgttgaaggcagaatttattgtggagaaattgctctgcaactctactattgtaggctttagaaatagacttttcagtacataaatcccgtggctccagcctcacagataagcccggcccatccgtctggaagaattcacagatgacaaatggagggtggtggctggtgtgcatttgtgccgtaggcgggagctcaggacaggccgagagcccacagccccacctacggtctcaagccagctgggtcttccactcgctgcccagcagcacctgagcccatccagcgctctgctgcttctaaggaaatggacatctggggtcagcccaggcctcaccagggaggaggcagagcccagggaggaggaaggatgcaaagcaggaggaagaggccggatgcggtggctcacgcctgtaatcccagcactgtgggaggccgaggtgggtggatcacctgaggtcaggagttcaagagcagcctggccaacatggagaaaccctgtctctactatgtctctactaaaaatagaaaaattagccaggcgtggtggtggatgcctgtaatcccagctactctggaggctgaggcaggagaattgcttgaaccaggagacagagcagaggttgtggtgagccaagctcctgccactgcactccagcctgggccacaagagcaagactccatctcaaaaatcaaacaaacaaaacaaaacaaaatcataaaaacccaaggtgggaggaagagccggctggccggggtggccctggaggctgagccggagccgcactgctctcgcaggtgactagttctgtgatcgtgggcgggatattttgcttctctttgccctggtttcttcatctgtaaaggggctgcatctctccctgtccaagttcaacgttaggtagcgttctcctagaagtgcaccctgggaccaggattcaagggcaagcagttaatttggagggtgatttggggtcaccggcagatagaagggtgcaggatgtggaaggggccagcgatgatgggggcttagccagcaggtccctgggcaggcaatagcgcagcccctttgggggcctctgggagagaccgagaaacatggcggagtcgtcccacccgagggagggagtgagtgacatcctttatccctgccctcatgggctgggggctgcccctggagggcgagtgcctgaggcagggcaaggtcatcacagcacatgggaaaggcagggctgagagattagcatcggcaccacctgtgttggccactgaagctgctccacaccacggcggctggagagcgcaggtccatgcaccctggggtacctgagggcaggcctggcacacacagcccctggcacagcgggcgctcccccagccagccagacccagctgggacagatctaggccctcaggtttccaggcctcacctgtggccagacgtttagctcaggctcagggtggccctgggactgggctgagaagggaatggtgagaggtaggactggaggcccagagaggacccggggtggggacggcgcagctgtgtgcatgcagctgtgtgttgtgagaggtagggttggagaccgagagaggacccaggagtggggatggcacagctgcgtgttcagggcagcaaggtggctgcagggacgcggccccatccacaggcggccaaggggatgcttctcatgaagttccaaggtgggcaaaaggcatgaggctggaacccctcccagggaaccccctccagaggcccaggcaggtgaggagatggcaccccatgccggcacctaggctcccagggccaccccatcccgcccgcctggctctgctctgggccagctcgggttgggcacagaatgggaggccccggtgttctgagagattcgactctgtttctatgaatattgtcatcagcaccatgctgccaagggtaggcggagtccccagatggccccacagtctccatcatgaactcctgaagggatgctctgctctgtgggacaaggacatttgcagatgtggtaaagggagatggtctgggcggcccgacctcgtcacaccagcctgttgaagccagtgttttctctggctggtgggagagcagaagtcagagatttgaagcagaaggattccaggtaccattgctggctgcagttgtgtgtgtagggggatgcgacaggcagtccccagctgctgagcccctaatagccagtgagaaagcaggacctccccgatccccccgcagctcaagaaacggaactctaccaatcacctggaggatcctggatcaagtggagccccatggagcctccggtgagaactcaccgcagctgacacccgattctgggctacgcagagaacccggccgtgcgggaagtccggcctgcaggtggggagctcatccatgccctggtttaagacgctaagtgtatggcttaagacgctaagtgtatgacagttgtcacacagcacaggaaatgaatacatgtccccgatgtgtttttctggaaaacacgccttgcatttggcgtcctgtggccgctgcaaccagtgatcgcaaacgatgagcagggggcatcctctcaacgccccagggtccagaggtctgaaatccgtgtccctgggccacagccaaggtgcctgcaggcattgccccctctgggtgctgctgccgggacccttccctgcctctcccggcccgtggtggccccaggcgtccttggcgtgtggccccatccccccatctctgcctctgtcttctcacagcctcctcctctatgtgcatgaaacctccctctgcctcctttgcatacgatacacacagttgcgtttcgggttcaccaggatcacccaggctaatccagaataaccgccccatcccaggatccttagcattatgcaaaccctctttaccaaataaggccacactcacaggtcctaaggataagatctggtacctttgggattaccattcagcctcaaaaatgatggaattcctgctgggtgcagtggcttatgcctgtcatcccatcactttgggaggccaatgtgggtggaccacctaaggttagaagtttaagaccagcctggccaacatggtgaaatcccgtctctactaaaaacacaaaaattagctgggcgtgatagcgggtacctatagtcccagctactagggaggctgaggcaggagaatcacttgaacctgagaggcagaggttgcagtgagctgagattgtgccactgcactcctgcctgggcaacaaagtgacactccatctcaaaaaaaaaaaaaagaaaaaatggaattccttcaatgattttctttgcagaatagttaaatctcttctagttttctttttaaacattcacttcccgccacagccttcctcaagtatgattttcccagcatgctctgcagtgagtgattggtggacacgcccgcccattctgcaggagctagactttcgcctgtgaacctgaaccgctcaagaagacacccgtcaggttgtattcaggagcagctttttccaggaaagtttccattgctgtcagttttattttgtgttaattatttccaccataagagtcactgtgattgggatgaaggctgggcgtgtggttcttagttctggcacagagacatagatgctgcctgggtcagctgggtgagtagggaggtgagtgtgtagggaggtgagtgtgcagggaggtgagtgtgtaggaaggtcagtgtgtagggaggtgtgtgtgtagggaggtcagcatgtagggaggtgagtgtgtggggaggtgtgtgtagggagatgagtgtgtagggaggtgagtgtgtaggaaggtcagtgtgtagggaggtgagtgtgtaggaaggtcagcatgtagggaggtgattgtgtagggaggtgagtgtgtggggaggtgagtgtgtagggaggtgtgtagggaggtgagtgtgtagggaggtgtgtgtgtaggaggtgttttgggagttgtgtgtgtggggaggtgagtgtgtagggaggtgagtgtgtagggaggtgagtgtgtaggggaggttagtgtatagggaggtgagtgtgtaggggaggtgagtgtgtaggggaggtcagtgtatagggaggtcagtgtgtagggaagtgagtgtgtaggggggtgtgtggggagatgaatgtgtagggaggtgagtgtgtaggggaggttagtgtatagggaggtcagtgtgtagggaggtgagtgtgtagggaggtcagtgtgtagggaagtgtgtagggggtgagtgtgtggggagatgaatgtgtgggaggtgagtgtgtagggaggtgagtgtgtggggagatgaatgtgtggggaggtgagtgtagggaggtgagcgtgtagggggtgagtgtgtggggggatgaatgtgtggggaggtgagtgtgtagggaggcgagtgtgtagggaggtgagtgtgtagggaagtgtgtggggagatgaatgtgtggggaggtgagtgtgtagggaggtgagtgtgtagggaggtgagtgtgtgggaaggttaatgtggagcggaagttagtgggaattgctgtgttttatgcccctcacacctcatgcctgcctgctgtctgcctcttaacaccttcgaatgaactggaaagaatggctggcaaggcctgcaggacactgaccctaccggccacatgctccggtgcacagtggatggcgggtatggcagatggtgggcggtcctcttggtagcccctgctctcctacctcctcatgtggctccagcccctccccagcaagtcccccaacccctccgactgtgggtatcataggaaggggccgtgctgggctgaggatctgctgggtctgtaatgacttgggagagacactgacatcagctggcaggacccaagtccacaggccaggaggggtgagaggggggcatgggtcatccacagatgctgcaggccgtcacacaggcactggagcctcaggtcggggtggacacgaagggcttccgtggactcaagtcgctgccccttggggtgcctggggctcggagccctgccgtgagcacgcacactatgccccagtgaatttctgattgcaaaagacatcgggcatcgggcgggggcactcggctcccatctgcagccgccccttttgtcaggggcgatcagggaggggctgggctttccttcccccaggacttggaagaaagacggagctttagtcctttcagccacaaaatccccctcctcaacagatgtggaggagaggaaaatgctagtagccctggggagttggcaggggtggagaggacacgggggagcgggcctttcccaggtcacctcaccctggctggaggcagcttctcgctttagagcctccctcgtgtggggcagtcgtggcccacgagccaattcccccggctgccctctccccgcttaactactctctggctctggaggaccccgggaggtgcgggatgcccactggggacaactgtacatggaaggtgacagattccaccccaaggcctctcccagtctaggctgcccccatcacaacagcggccccagccgggcagtgtctgcatcccggcctcttcctaagccttttacaaacatcaactcttttgagcctcgttgagaaatagatactaatattatccccattttgtattagagaaacaggcacgggagactgaatagctcagtatcttgactaaatatctgaagcttctggaagctgggatttgagcaaagacttgaggctgcagagccgctccctgcctggcatgtgcggcaccggcacggtgaggtggccctggtccgggtggcactgcagcagcgtggtgaggtggccctggtccgggtggcactgcagcagcgtggtgaggtggccctggtccgggtggcactgcagcagcgtggtgaggtggccctggtccgggtggcactgcagcagcgtggtgaggtggccctggtccgggtggcactgcagcagcgtggtgaggtggccctggtccgggtggcactgcagcagcgtggtgaggtggccctggtccgggtggcactgcagcagcgtggtgaggtggccctggtccgggtggcactgcagcagcgtggtgaggtggccctggtccgggtggcactgcagcagcgtggtgaggtggccctggtccgggtggcactgcagcagtgtggtgaggtggccctggtccgggtggcactgcagcagtgtggtgaggtgattccggtccgggtggcactgcagcagtgtggtgaggtggccctggtccgggtggcactgcagcagcgtggtgaggtggccctggtccgggtggcactgcagcagtgtggtgaggtggccctggtccgggtggcactgcagcagtgtggtgaggtgattccggtccgggtggcactgcagcagtgtggtgaggtgattccggtccgggtggcactgcagcagtgtggcgaggtggccctggtccgggtggcactgtgctggcacagtgaggcagccctcgtccaggtggttgcaggctgcccgccccaaggtggacgagggaatgtgacaggagctgcccagggctcccagtgcccccaggctgtgtatacagtgacctcactggtctgaggcatcatccaggccggggttgcatattatttgcatattatttgcatctccgttggtttcttggggaagccaagtctgctgctggtctggtgcctgcacctcatgacaggttgggtctggaacccaggcctttggctccaagttctctgtgatctgccaggatgtgggtggcactgagcggtccctggggagggagtcaggaggcaggagcagaagccagaccaggtacagatgaggcagagacagtcccctctgtggggctggggtgagcagctgacagaggtgtctgctggcctgaactctcatcctccagactgggtgagggagtggagagtgctctcggggcccactgaggacgacagcctgaactcccagccctgggccccctgaagtgaagtggcggctggtatgctcccatgtcgggggctcttcccaagtagggagtggtcatgaaggggcccccctgggtcctgggggctgtggatggacagaccagagcccacatggtggcagcggtgatgattttgctcagccgttcctcctcaccttgggctctcttgggggattagcctcgtaaacaagcagttctcaccctctcagggctcagggcccttccctgtcgttcctgatttccgctcagccccggggaggcctgtctgggccagtggcaggtcccctggagcccgcgccttggagggcagtgcagaggcctggactgcgcctgtggggaggggagtgcagggaaccgcgccttcggctgagggttggaggccccgcgttgtcctgctggctgggggacctggggcacgtcctggctcctccctgggcctcagttttcacattttgttcaatgcagggctgggtggtgaagtcctggctgagggaatgtgacaggtgcctacccgggcccctcatctcccaggacttgggggactgaggagcaagcatcctccgtgtagacacgtgaggccaggagacacccgcaaggtcaggtctggaatatggaggtttctggatgaccaagcagctgcttcttaaaaactctacttttgaaagggactgctttgcatcagaatctctccagagtgaagggtggacccgctggtttctgaagccgctgcagacgtgggtttgcagattggcccaatctcagccccgctggtgagttggggctaacagggcctggtacaggctgcaaggctaatttaggatccaatgagatgagacgtgtagggtgcccagtgccacctgtgaggcattgctgttgggagagcagaatgttctggagccattaggctccaccaggcagggaggacacctcctggaagcctctgacctgcctcatgggtccagcctggtctttcacagctggaagcaggggctggctgtgccttttcactgaaaagggcggcatttttgttctttcttgaaaatataagcattactgttctttaaagtagatgtagaattcaggtcttcgagattttttacagagggattttcataatatacatgtgaccaccaattcttaaacatttactatgcaaactgttttaaagttaaaaaaaaaaaaaaaaagcaaatggttctgttaaaaaaaaaaaaaggtaccaaaaacccgtaagcagcaaagctggaattcgggcccaggtgtgtgggacactgcctctctgtctgctccggtccttccatgagtccctgctgagctggcaccaagagtcccttcccagccccccaaccccccaggcccccagcccctcactgtcctctggcctctcattatctcagttccgcacatggaaaatcaataaatagtttgcatagtgttctcccctcctgccttttatcaatatttaatgacaggctgcgggatgcttttggtgtgcatccttctggggcccctcctaatgggatagcgacagaggtctctgcaggtgcccgggctcacagatcgcctcctggatgaggcccgggtggccgcgattggctgcgcgggcagcaggcttggagtcgggggaactcggtgatgaattttaacaacctgggaagactctggcaccggccgctgtgcaattagcggcctgcggatgtcagggtgggttccagatgggaggcgcgggggagggggctcctctttgccagcttggctgggagggtgcacgtggggtaggctggagtcagacatggtgcggggcggggggctcttcccagccgtgtgtcctctctcacagactcagagggaggtggtatttaatttggctcagcagctgcccagaaaccctgaccccttcagggctgcacatcctatgtgaagcggggtccacccggccccctcccccaatgacgtagaagctgatcatcccctttcagagttcaagcctctctgagagaagctgaccctgatccgcatccattagggcggtggctttgggctgaagtccacattggctggtaacagggtcagtaaataaggcggctcggtgacagttccggaggtacagatgaatacataacgtcagcttcctgcctgtccccataaccaggaggggtggcaaggctagccgtgtgtggggggctcactcaatgctgctgtgagtctctgggtctggattccacatctatacgtatttcgcccccgccccgcaggaggcccagcctgcggcggtggctgcttccccgagacttgagcacgagtgtgtgtggggccaacactggccaggaaggaggtggctactgaactgatgacagctggtccctctgatatacggaggctctgggcttggggattattccgcctgtggatttatcgcccttccggaaggcagcccaatgggcctgtgggcttggcctcaaggaatgtttggctttggggtgagagggcttggagggggatgggcttgctcctttgggggccaggctcattccctcggaagcaggacagccccgaggcctccccagggtcctcttctgggacaagctccctttgtctttgaggacatgggaagaccccgagagggagctgtcgtgggccgccgacaaaagcccactttacactcaccagcttggcgggagctctgcgtgtggtccaaagccgtgtcccctctgtggcgggcggcatggcgggggcagctggggcccctctatcctcccgcggctgcacgtgcttccctgcgaaaagcagggtgaagcgacgtctcggggccaggaccctgctctgtagcggggcggggggtcctccagagggagaggaggaaggaaagggcgttgggctgaggggattggaatctggggtcacagggctctgccagggctcctttgccagccacctgccccggctgggaactcagccaccctgtgtctctgttcccatctgtatctggggactgcagaaactgcctcctaggaagtcaggaacatggggcacactgggggccctttgagttcccctctgccctgctggctctcggcccatcctgactctccccaccggagctcctggagccgaccctgcatgggccccacccaactctctcaggctcggacctgctggtgactctccacgctcaggacccactgtctccgcaggccatctgtgtaccctgcatccgcacaggtgccctccccaggtccccagaactcctgcctctcaggccgggctgccccagggaagggagcacagccaggaacccggtctgcaaatgaaacgctggtcagagcctccccaccaggccacgtggtgggtggcatgcaggctccctgggctcttaggcacccccggtggcattgacagctggggagagaggtggtctcaaggactatggagtccttcctgaaagtctctgctcctacgcagcggaaacgagtgagactgggagtcagcccatggcgaggagctggggtgggggaacatggggacccgagacccaggcaaaggccaccagtgctccccaggcgtgtagcctgagcctttggcccccagaagggggtgcggtgggggcaccccctgggcaaacctgcagcatagaacagcacagagggccggggcccgggtaggtggatgtggagaggtgttccggagggtctcggatgctatgaagagatgagaggtgttcagacgccatgaagaggggggatgccgccctgtgggtggagggtggtctggaaggccccaggctgaggggcagccctggtgggtgtgggctggggaagcctccgggcagtggctggcctggtgcccttgagctgctctacccctcatggtaccaggacccttggcgcccagatgtgctgggagcctgcaccctgcggaggggggccaggcccctcctccccgctttgtcctctgcagccaccttgggccgccaccctctgacctgctggggggttgtctctgtgcgtcatctgggtggcctgagcccggctctgatgacttcacatggagccacctgccaacagagacgctggcaaagcagctgctctgggacctgacagaaaagataaaaatgatggaatgtttgttctctgacatggaaaaccaggctcccacatttagggcaattggagaaagatcttcctgctcacctcggagcacaggtgaaagacctgctctcttgcacacctgctgctccctgggccaggcacagccgcctcccgtcttctgatggtgctgtggctgtggcctggctctgcctgcatggagcgttgtgccagttagggggtctctatggtgtcagggagcttcgggctcccctgggctctgtgcacaggcctcttggtggggctggcaggacaaaaggagaggaagaaatcgaagttagtctcaaactgctagaccacagatcccatgggcgggtcattcaatgtggtgggggacagtaggtggtgtgaccaaggccatcacacaggggcacctgagggtgggaacatgcggccagcctgtccctcaggcctgcctggggtcctcaacccagcatgggtcagggagtgctggcctgcagcccaagagacggggactccactcctggccttctgcgtctttgcttggaaggctcttatggctttgtggcccatccccaagtgccagctccttgggtacagcctcctgtgtcagggtcagtgcggggtcatggcacagggctgccctgaagggtgcagaggagaccaaagccacaagctaggtctcttgagggcagctgcctctcggacccttcaaaatgggttgggccctgaccctggtctcggaccaaccctgcccctccctgctgaggtatagatggagctgtcagggacttggaggccagcgtcttctcccccactccccactgttggaggcccccagcagactccctcagttttcttgctaaggcctctgccacgcggggtggtggctgtgcaccctacggcacgtgccctgtacaagcccctctgggcccctgctgtggccttcaccgttggccaagttcccgctctgggtcactctgctgatggctgagggggcagggtgtgagggcgtggtccactcccagactcctactctccccaaagcccctccccgaccctgccctcccgcctctgcaggcagcctgccgcccccgcccccaccccagctgcctcctcctttctctgacaacctcctgcctggggtgtcctggaactgcgccagggggaccaggtgaccttggacacggcgtagctgcctgggccaccccctttccttggtaatttgcgcagactccggagggagcatgagcagctgagtgctgggggaggggctttcctcttcctgtctgtcatgtccagcctgtgaagagcacgctggctgagctggcgagaggggtgggggcgtcctggggctgcttctgctctgatgaaggcacccactgtcactgtcccggccctcgctgagtgttcccggacccgtgggcccgcgtctgtgccaggccttggggagctccagcctcggagcctcttcccgttctcagacctcagtgcgaggaggaaatcgggtgagttgaggttaatgtttccattaaacctggatggattttccctgcgtggaaggagctgttacgcgccagggctctgagcagcatggacggggccccagcgcagccacgctcccgaacgaatgccctcctgggagggcccggctgcctgcctgccccctgtgcctctgccgccaggcctcgccctccctcctctcctctcttgtgaataaagggcctcaaccccacctacccggtgtgctgagggtcctgctatacttaaactgtagttaaagcaaaaacaaacaaacaaaaacaaaaaaaacatgcaaaacccctgtggcaacagcttgtcccgtggatatcatctccactaatccatgtctcctgctcggggtcctgcggtttccaggcctgtatctgcgggtacttattttccatttcctcccgagagtttagcctgctaatgagattttggtgtctggtatcttggcacatgtctccaaagagatttatggggcttccctctcctggcccctcacttgtccttggcaggaagctcaaggggttcgatgtaatctgctccagggccctggggagggggcagaatgtgctggaaggcagatctgggtggggtctgcggccagaagctggatgtctgctctggaggagccaggctggtggcgtgtagtctgtggtggccctgggataaccagagaggggtgtgggtggggggtcccctagaccaccggccacctcggagccagtctacagacttggtgtctccgccagcgccagtgatctgagccgagcgccccctgctggtgtttgggcttcccagtcccacttcacagtgggggctcccggctcagacccacccatccatgccacagcactcagcctctgctcaggggctggatctggccgggaccttgggtgctcgggggccccatgctctccagggacagggaccttcggctccacctgctgcctcaggtggtctcatccatgtggcttcagcccattttccaggcaggggacagagcagcagtgaccacagggctgtacagacacctggggcagaaggagctgtgggcccctgcctggtccagaggtttccaggccgcaagcctgtccctggctgctgaacgccggctgggctcggcctgggtggaggagaggccacaaggcttgggtcagggagggcctgaccttgctgtgaccttgggcacgtctccctactctcaacagagtggggctaagagcagtgctgtcgttggtgggatggagggaagatgcctcccagggggcgttgctgacccatggtgggtagatgcccaccatcaccccagctgcatttcctcctgggatctggagactgctcagagtgaaggtgggtgtgactccccggggctgctcggagtgaaggtgggtgtggctccctggggctgctctgagtgaaggcaggtgtggctccctggggctgctctgagtgaaggcaggtgtggctccctggggcagctcagagtgaaggcggttgtgactccccggggctgctcggagtgaaggcggttgtgactcccgggggcagctcagagtgaaggtgggtgtggctccctggggctgctctgagtgaaagcaggtgtggctccctggggctgctcggagtgaaggcaggtgtggctccccggggctgctctgagtgaaggcaggtgtgactccccggggctgctctgagtgaaggcaggtgtggctccctggggctgctctgagtgaaggcaggtgtggctccctggggcagctcagagtgaaggcggttgtgactccccggggctgctcggagtgaaggcggttgtgactcccgggggcagctcagagtgaaggcgggtgtggctccctggggctgctctgagtgaaagcaggtgtggctccctggggctgctcggagtgaaggcaggtgtggctccccggggctgctcggagtgaaggcaggtgtgactccccggggcagctcagagtgaaggcaggtgtggctccctggggctgctctgagtgaaggcaggtgtggctcccgcgggctgctcagagtgaaggtgggtgtggctcccaggggcagctcagagtgaaggcaggtgtggctcccgagggctgctcagagtgaaggcgggtgtggctcccgcgggctgctcagagtgaaggtgggtgtggctcccaggggcagctcagagtgaaggcaggtgtggctcccgcgggctgcttagagtgaaggcaggtgtggctccctggggctgctctgagtgaaggcaggtgtggctcccggggctgctctgagtgaaggtgggtgtgacttgcttcagatctcattgacgtggatcttgggcaagtggttttcactctctggagccagttttcttacctgggaattgggttaaatcccggtggccttgggctgtggtggaagttagacaggacagccacatgccacacacctgacagcctgacagatgtgtcactgatggtcactggtgggttatgtggggctactcctctgcctctgactctaggatcccattagttgtttaccaaagtagcatgtccaccagggtccttctgggtatacggcttgcttccaactctctcactgatattttaggtccgctaacacttggagaaatcttttggtgtgaattattctcagcagctgcagggcaccctggttcactttcccgtttctcaagctccaatggtgcccgacactgtttcctggggaggaagctgatgtgcctttaggtggacgcctgtgtgaggctagcccgggccgagctggagctaccagccttctgcgggcatgcatgcctggcctgcctcagcaaacacacgataaatccatttccccaggccgcctgctcccacttcccagatagccgggctcatactcacatttatgtttcattttgtctggctaatattgtcttagataaattagggggagcagattagtgtttgatttagtggtaggaactccgatgagcctaacgtttcgttttagtggtgccggggatgggatgagggtccctggttcctcatagcccttgtggtggtggctcctgaaccaggaggggtcatttgcatgggcccaggctctcagtgcagacccagcaggtctctctggccgctgggacagtggtcagatgaggtggcccctgtggggcctgggggcacagaggtgccacagtgagccagcctggccccttgctagcaataggcttgtgctagaagaaagacagaactgacctgcaggtgtcagcagctgagcctccttgtcctccctcctctgcacgctttcctgtgcctgtgttattaagggggccaggccaggaagtgctaaattagttatgagatgcagggctccagggattcaatggggttgtgtcctcgcttcctgtgcatttcctgtgtgctgggcatggcccagagagactcacagacagaggcctgccctggagactcccaggctgcagtggccagagaaggatcccaggggtcttatgcttgtgcaactttggggggtcttctttaagaaagaaaatttaaaagtagaaatatctaattggttctaggccttgcaagaacccgtgtcagtgggggctttgcggctgagctttcattaggggctgaatgaattgccccatgtagggccgtcagcctgatgagaccatcactgtctccagggatggggactcacaggttaacagtgacagaaactctcacagtagctggggctgaaggatttgctggatgagacctgggcatcctgtggaatctaaggatggttgaatccccaggatgggaggcagctgggatttaggggccaccagggccaaggcccagaggtctccttcccaggtcaggcctcagctctctcactggtttgttccacgtgtggcaaatgtgtggctggaggctccccaattttgcaccttacacctctggccaccagagataaattgacttttgtttcctagttcaagttccagtaaccctggaaaagtgctctgattggcccagcctgaatcaggtggctcccttaggatcactcagctggggccagggcagtggggtcacagtgcactaacctagcaggtttgcaatagctgtggggtggagaacaggaagtagttcctggaaaggggtaagtcatactgatctcctttctgactaagccaaggctactgtgggggctcagaggaaggtgtgacttaactctgctttgagaacaatggacagtttcgtagaggttgggccatttgggctgagtcttgcagtatcaataggaattcactaggcagagctggagactaaggtgactctagggggaggcatggagaggtagaattgcttgggaagagtaacttgttcaaggtgattggagcgtagactttggtggtggcaggagggtggagtgaatgggcaggaagctgggtacgaggtggaaaggccttggacttgactctagaaatactaggaagccaccagagggcttgagcagaggtgacgtgaccagatccttcctgtgttcctgtgaggatgggtagacagggccccctgggagctcacagaggtggagtactttgcccaaggtggcgagaggggacgcccgcagcctgggtcccagtgcagcccttgttcccatgggtccagattcctgagcctcacccacccctccctcaccactgccacctggccagtagccacaggtggcttccagagcactctcttaccgtcccccagggttttctgggtactgaccttctctctctcacttgggatacccacccctatcagggaaatcaggggaggcactattgtctcctttacagaggagtaaactgaggctgggttaacattacttgttcaagtcactcagctaagacgggcagtgctgggatttgaacccagctctgcctggcttctgagcctgagctgacttcagtgcccggcccccagatctgcacaccagtgtgccccaactgcctggtgagtggccaggccagagggaagcagggagcagggtgggcccaaggcgaggctcagcgagaaggcaggagcagtagccgtggggcagcacttggggtatgtgggccatggggaaatgggcaccaggggtagagcccctttggggggctgtggagggggagcagcggggagtgcaaggggatgtgacacaagccccttctgagggaggacttggtggccggttgctcttgagtggtgcctgcctcaaggcctgggctgtgtcctgccctcctgctgccccggccacctctgacagaccctgctaactgtggtcagcctggcagggctggcatggcagagcaggcctgtggtgccaccctgacctggccactgtggtccttatcctgggtcaggagccgtccccgccccaggcccatgttttccatctgccggggaccctgcccaggaggggcacatgtaatgctagcctcgttgtgcagggcggctcctggctgaggccttgactgaacttgcatctacatttagactgaaatgcaccgagaggctgggcctgctgtgtcccaggggctgcggacggggtgtccatcctgcctgggtaggatgcatctgcagggtgcctcccaccacacgctaaagtggggtcatcacccctgggtggcctgggtcaccaagatgctaccccacccagcctgatgggatgcctgagctccaagcctgccccctcacaggggagatgatggccccacgaaggcccccctgggtgcttgtggtggccgctcactcagtctctctctctccaaagcggcctgcccgtccgcgaagtcacttagctgggatctaatcgggtttcacaggggcataaattacttggctagaggttgttcccgggtgtttccaccccgggcctgttatttacacaccgtgcggtaatgtagtcacggccttgggtgcgcagtatttatggtgtttgatcggcttccagcccaggccgcctgtccaggaacatttgttgagatgttgtgcagagccgctggggacctctgccacaggcgggcatcaatctacctggagctcctgcggcagccctgcagagcctcaaaagggcagggcgggcctgtggtgccaccctgagctggtcactgtctgcagatggcagctctaggagtgatggctgaggacgaacaagggtgcgaactgtcactgacatttccgtggggcgtggacgtgacacatcccgaatgccatacctggctgtggacagtcgcaccgttaaaggcagcagcgctaactgccgttcacggagcacccactgtctgctaagctcagtggaagatcctttgttttattctctccgtgagtgcttgtcgcagccctgcaaggtaggtgtccctgatgggaaactgaggctcagtcactgcaggtgacttcccaaaggaacacagcctgggagctccatgtggcagcttcctctggctcttacaaggggaaggatgagctcccgttggttgctggggtcccgcccctttgccttcatgtctgtgatggtggaaatgcttcataaggagtgtaaagtggtttttgttcccgacccagagagatctggtcacggtaattctgtatctgcttgcctatatttatcccccaagtccggctggtgacagggaagcagatgatcagtgccaggcctgataaattggacccagggctgaggcgggagagaaaccctgttttattgttgaagacaaagccgtcgggcaggaggcatatgttgtgttggagccctcgctgcgacggaggccctgggcctcagagcaatcagggctttcacgagcaccccccacccactacctacgtgggaggcaaggacccccattagcccggctggctgtgggggaggggctgacagaatgtcagtggggtggaggggagaggaggtgatcaatgaggacttattgacttgcatctttccccacgacttgattaagaccactatggagatgaggcctgaggagggggctagggccagagccccgggccagtgtggcttaggggatcttttatgtttggagggcaggaagggaacagagagctgccggctttgtcagatgcctgaagagtattgatccatattagaaatgataatgagccaattctgctgggctgggaggccttaaccatttcattgcttacaaggctgtcctggtggggatgttggaggaggctcagcctctagctgctcctcaccatgtttctcctcgctcaggtctgcagcttcccaggccacgacctgagtccactgatggtcctggaggtctggccagaggggcaagggcagcaaaggagaggagcacaggactgggagctggagcctggttctgggattggctagaccctgcggggtttgccaagcacctggtgggtgcctgacattctgtgcatctcctcgggcacctctaaggtggtcaggatgacccttactgctataatgacagatgagatgaaggcatggaggctcatagttgccaagaggccaggcctctgcctgcccctccagcactctgggacgtgatgctgcccctcagacctgccacttgctgatggagctttgacttttgttgagtcatttaccccatctgggacccactttcctcatctgtaaaatgacaaccacagcaggcttgctgagataattcagagaacaatgacaagggctcatacagtccagccctgcaccagcacttggtggtggggcctggcctgagcctaaagcttgactctagctctgtgtccactttagtgaacatttaaagttgaggagtctgagtttgctcctccatggagggaggacatgccattcatctttctaaatggttgtgagaatcaaatgagtctatgcatggggagtacctaacatgtagttggtggttaacagaagatggctgtcatcattgtcattgtcaccatcaccataatcatcatatcaccatcacaacaccctcaccaccatcatcattaccatcatgatcatcactgtcacatcatcaccatcattaccatcatcattaccatcaccataacactccatcaacatcaccaccatcatcaccatcgccattacactccatcatcaacatcaccaccatcaccatcaccaccaccatcatcaccatcaccattacactccatcaacatcatcaacaccatcatcatcaccatgaccatcaccccatcatcatcatcaccatcatcaccgtcaccgtcatcatcaccatcaccattacactccgtcatcaccaccaccatcatcatcaccatcaccattacactccatcatcaccaccatcattaccatcaccatcatcaccatcatcatcataatcaatattatcaccatcacatcactctcaccaccatcatcaccattaccatcatcaccaccatcaccatcatcatcactattgcatcatcgtcaccaccaccatccttaccattacacaccaccatgagcatatcaccaccatcattaccatcatcttcatcaccattatcatcaccatcacatcatcatcattatagctataccatcactgtcatcagcattactatcacatcatcatcaccatcattgccatcatcatcaccatcatcattgccatcattatcatcaccatcatcaccatcactatcatatcaccatcattataatcactatcactgtcatcatcatcgttatcaccatcacatcattaccatcacatcaccatcatcaccatcatcatcatggtcattgtcatcattattatcatccctgtcattgtcatcatctcttcattatcatcaacttggcagagattgtggttttgttcccatcccagagagatctgaagatgctaattccatccttgcctctatttatcccccaagtccggcctgcaagggaggctgctaatctggctgctgagtatgccagatccatgggatccagggatcaagtggctcaaccccctgggatccatgcactggcatttgtctgtggagtccagtggtaggtcttcccactaccaggacaccaggctgggtaggcaggcagcatggggaaagcttgagggtcaaggctgtgaagctgtggtgactgatgtggggtctgctgatggggagggggtgcttgtgcaggtggtatggggcttactctactgctgctccccaggagtaggaggaggggctccagcttaggatgacatatttggctgctttctacacaaagaagatgcctttgttcaagctcaggctggtgctggagagagcatcatcctgacctgggcacagctagggaacatctcttctggggtatcatcttatgaaccattagaggctttggcttgggcagaactgggttttagttccatcctgaccctgacttgctgatatggtttggctgtgtccccacccaagtctcatcttgaattgtagttcccataatccccacacgggaggtaattgaatcataggggtgatgattttataagggtcttccccccttttcttggctctcattatctctcctgctgccctatgaagaggtgccttttgccataattataagtttcctgagggctccccagccctgcagaactgtgagtccattaaacctctttcttttataagttacccagtcttgggcagttctttatagcagtatgagaatggactaatacaataaatttgtagcaagagtggggtgctgctataaagatatccaaaaatgtggtaacaggcagaactgggtaacaggcagaggttggaacagtttggaggtctcagaagaagacaggaagatgtgggaaagtttagaacttcctagagacttgttgaatggctttgaccaagttgctaatagtgatatggacaataaagtccagatgatggtctcagatggagacgagaaacttgttggtaactggagtaaaagtcactcttgctatgttttagcaaagaaactggaagctttttgctcctgccctagagatctgtggaactttgaacttgagagagatgatttagggtatctgacagaagaaatttctaagcaacaaagcattcgagaggtgacagagcataaaagtttggaaaatttgcagcctgatgatgcagcagaaaagaaaaacccatgttctggggagaaattcaagctgcagaaatttacataagtaatgaggagccaaatgttaatcacaaagacaatggggaaaatgtctccaggtcatgtcagaagtcttcacagcagcccctcccatcacaggcctggaggctttggaggaaaaaatggtctttttggccaggtgcagggccttgctgcttcatgtagttttgggacttgatgccctgcattccagccatggctaaaaggggacaacatacagctcaggctgttgcttcagagggtgcaagctccaagccttggcagcttccgtgtggtgttgagcctgcaggtgcacaaaagtcaataattgaggtttgggaacctctgcctagatttcagaggatgtatggaaatgcctgaatgtccagacataagtctgttgcaggggtggagcccttgcagagaacctctgctagggcagtgtggaagggaaatgtggggttggagccctcacacagagtccccactggggcactgcccagtggagctgtgagaagaggaccactgtcctccagaccccagaatggtagatccaccaacagctcagcttgcactgtgcctggaaaagctgcacagcccatgaaagcagccagtatgggggctgtaccctgcaaagcagcagaggtggagctgctcaaggctgtgggagcccacttcttgcatcagcgtgacctggatgtgagacgtagagtcaaaggagactgttttggaactttaagatttaatgactgccctattggatttcagacttcatggggcctgtagtcccttccttttggccaatttctcccatttggaatgggtgtatttacccaatgcctgtagccccattgtatttaggaagtaactaacttgcttttcattttacaggctaacaggtagaagggacttgccttgtctcagatgagactttggacttggacttttgggttaatgctggaatgagctaagactttgggggactgttgagaaggcatgattgctttttaaatgtgaggacatgagttttggaaggggccagggcagaatgatatggtttggctgtgtccccacccaaatctcaccttgaattatatttcccataatccccacatgttgtgagaaggacctggtgggaggtaattgaatcatgggggtgatggttttataaggggattttcccccctttgctcagcattcattctctctccttccaccctgtgaagaggtgccttccaccatgattgtaaatttcctgaggcctccccagccctgtggaactgcaagtcaattaaacctctataaattacccagtcttgggtatttcttaatagcaacgtgagagtggactaatacacttgccctcactccacatcttgccattcagcaagtccctaggatgtcgacacagcactgcaccttctctgttgcagggcctgccctcccttcctgcctgcctgcctgcctgcctgcctgcctgcctgccttccttccttccttccttccttccttccttccttccttccttccttccttccttccttccttccttctttcctctttctgtgttaggtttgcagctcctgttagcccttaagtggagacattgaatggaaggtggatttctcaagtctgaagctcagggagaggcccttgctagaggtgtgtacttttagagtcctcagtatgcagctgaagtttgagccacagtcttggtgagacctcaagggaggatgtagacagacaggcgaggaagccaagtctaggagctggaaggagatgagagggcaacaaaaggcctcagaaagagtggctgctgaggtgggggtgagccaggtgagtgtgggggacacctgcaggaggtggtgctgcaaggagaagagaccacccacgtcacaggctacccatgtcacaggctgtgagagatcaggagggtggggcctaagactgctggctggcttggtggccctcactgatgtgagccactggggtcttggtgaccagtggggtggggcagggaggaaacaggctggtgacagtggctgaaggacatgggaggagtagctgggactgcgatgatggaccattctttccagaagaagagcaaagaaatgcgggtagtagctgaagagagatgtgggtgaggaagaatagcataaagaaacaactggacatcaatagtgggaacaagtagagggggagaaactgaagtgcaggagagggaggctaattgctggaggaataagtgggttttcccttctcttgtttcttctcaaaatgttcttttcactcttggttttcagtcttttgactataatgagctcagttgtgtgtgtgtgtgtgtgtgtgtgtgtgtgtgtttatatattcattctttttggggtttgctgatattctaggatctgtaactgacattttcttcaatactttgaaaaatacttggccatcatatctctgaatatttttttctgctcttttacattctcttttcttttttgattccgctaacacatatcccaggccatctgagaccactgaggcactgttctgaagtgtaggttttgtaattattcagatacaacaagggcaatagaccaggggatgaccgccattgaaatggtttgttactcacagctcccaagaggaggggtcatgccacaccatgcagggccacacagggcagcaccaggagtggccaagggggaagaaggagtgacggaaaagcacgggaaggtccggccaggcaagcaggctgacgattggctcatttcagtcattttggtgggctctggggtacaggtgctgtctctagtggtctggtacctgccctggggtaatcagggtgggacttgtggccaccctgctgagtgtgaaagcccatagaggaggtggcatgggtgcaggttctggattagctggtttgcgtatggaagttgtgccccagtgtttacactctctaggaactgactaggcctgggaggtggcggagagcagtttctccagggtcagcagggtcctgggtgtcaaaaagatatgtttaacacacttatttttcatgttctagaaatcttcaatctctttgttcttcagatgacatagaaatttctgtctttaagcttgctgactctcctatctccaatctgttgttaaacctatccagtgttttaaaaaaaattcagctattatatttttcagctctggaattaccctttaaacctgggacgtatttataattgctgacataaagcaatttttctgtttctttgtttggctagtcattttttattgtaaattagacattgtaaatggtaccttgtggaaactctggattctgttatcttcctctgagaagtgctgatttttgtcccagtagcctgtgcagatctcgattttatgctttgttgaaacaggtcctggaggcccatggcgtttacccagcctctaccttggtgacgcaaagtccccacactctgtctcccctgtggacctgggggctcagtgttggcgttttgaggatgtgtctggagcagggctctgagcatggttgtgtctcagctgcctgctccacctgccaagctcgcctcctgacttgggttggtcctgagccccaccaccttccagtgctgctaactgctacgctctctgtcctgcctttgccctggagaagggcacttggtcctgccctctgaatgcaaggccccaccagggaccgtgaaccctacactcccctccggaccctctctctggaatcctgccccccacagtcctgtcccctcagtgcctgagctctggtttctgcctcctgggctcagcttgctgccacaccctgcctgggctccactcctgcatgagtggtggggaaattgtcctgggtggagggctgggccaacgtggcgctcatctcacaggctttccttttctccaggatcacagtcacatgctgcctgcaccaacacccgaagaccatcacctagtatattcccccagcgctggggttgcttatggtgggaggaaatgcacgggcggcagagggcaagggcgtggtcattctgatagaccacgggtgccgaggtgggcacaggaggaagggcgggcaggagaggaagtgtaaagtgtcactggctcaatgaggacacgcggtcctggtcgggaggaaggctgggggctggaagttgcggagggtgggagtgcggagcatggcagggcagcggccgtggagcggatgctggaggtgggtttgtgggtgatgacagcccaggctgcagcctcaggaggagaggacggtcactgggtcagggggcagatggactggccgtcccatgatgctcagaggctgtgagtacgttggctggctggggttgccatagccagtaccacagaccggtggggcaaaagcagaaatgaactttctcacgatgttggaggccggaactctgaggccctggaattgcagggctggtttcctctctggccccgtcctgggcttacagatgccacctcctccctgttcctccgggtggtgtgcctatgtcctaatctactatcaggacacccctcggatgcaaacagggccaccctcatgacctccctttaatggaatcagctctttaaagagcctatccccaaatacagtcccattctgaggtcctggagtttagggctctgatatctgaattttgggaggtggataccatcctgtccctcccagcgagtggcccaaagctgaagccattgatgagtgactgacaagcagcagccatggcggagggaccaatcctgagctggagttggggctgtgggggcctgaaggactgtaggggttctggggagagccagatgtcagctgtagcgagaagagaaagactgccagacgtgcggctgaggaggagccaggctacgcctgccctcaggcccccgagagtgtggaggcccctggccatgcaccggaggagcctctgatggatgcttcataagagtggtgcccacactgcagccacctccgctgccagggacccctccggtgaacacgttggctcctcctcagggaaggggcaagtttcgtggcttgaccggagggccctaggtgagcagtgccgcgttgtctttggaggaggtttctcctttggcctcggtttgtcctctgtgtcatgggggtgattgtccctgaactttctggctgctcagggctggatttaggctctggggaggccatgggggtgtttcttgaagaccgaagccatgctcgaggctgtgactcctgcgagacagggcctgaggggaagccccggggtgagtgggtctgtttgaggctggctgggtgtatgggccactgtctcaatccctttggctcaagctggtgatcatgaagtgacctcccatgcctaacttattttggatgggtctgaaggccacagcacaagcatcagggtgctggaggcactgccaggaggggtgggagaacaaggctgccctgggagtcctggagaggggccccaaacatgggtggaggtggcctctgggctggccctgaaggctgcaggggtgggggtgtagttggcctatgccctgtgggggagggagctggtgagtcctgggccagggcagggcagggggcagagctatgagaaaggacggcagaaggggtgtgaagagaaagtgaggggctcaggtgccaaggccttggaggtggtggggctgggggcaggcgctgcagttctcagcatgagacggggggcagcaaggaccccacctgcgctggcaggccctgctgcccctctagccaggaggagaatgctttttcatagggggaggaaggagaaaaatgacttcgggctcctggcaacttcagcaatcagctccttgtcaagcaaataaaatgcttttgaatgtccagattaatgattgatcagcacaacgcgagcctgttggaagcttccagttggcccacgtgggggtccccgctgcaggcgctggtaaagtgacaccccgttagtcacttctctgcgtgtgcttgggagaagcccacacacacatgctggtgcctgacgtggggttatttctgtgctgaggaggcaggaaacggcagaggaggcagcttccagggcagggagcactggggcggcctggcccaggagggtgcttcatggccatgggacaaggcccacaccaggccctggtgacgctgggcgagagcctctgtgtgggcgaggaggctggggctggccggtccactcgcccagaaatgccagaggtgcccaatgccatgcggcctgggggatgcttggacccggagtgatgacagtggctggtcatttgcaccttgaattaagcagaataaatcaaataagagaacaaagccgattcttgttttgatgcttattttatttttgaatgcaacacccatatagaaaaggacatgcatcataaatgtacaacaggatgtgtaacttcagagcccgcatctgtgtgactgccatccagatcacccggtagagttccccagcctcattcccctccccctgcacccttccagcagagcccctgcacctgcggtcactcttgcctcctccttatatgggcaacacttctgtcctagcaaccctaaacaagctggtgtggctttccccgtcggggccagggtgggggtttatgtaaatagaataaagctaggtgattgctttgttccttgtttctttcacctgctgttttgtctgatgtgcagccaaccttgataacattgcatcttcctgtataggggtgtgaaataatctcagtgtgttgagttcttggtttctctagctatagtccgttggcttccatggctccaccatgttccatcatgcgaacatacaacaggcttctcatccattctgctgttgatgaacacttgggtggtatctgaattggctgagtggcccatgctactgtgaacactctcgcccatgtgcccacttgtcctagggtccctccccaggagtggaattgccaggtcatgagatgtgcgcctcttcaacccttttagataatgccaatctgttattgtttctaattaatagactatttttttagtctggacgcggtggctcacgcctgtaatctcagcactttgagacaccaagctgggcagatcacctggggtcaggagttcaagaccagcctggccaacatggcgaaacccaatctctactaaaaacaaaacaaaaattagctgggcatagtggcacatgcctgtaatcccagctacttgggaggctgaggcaggagaatagcttgaacctgggaggtggaggttgcagtgagccaagattgcgccactgcactccagcctgggtgacagagtgagactccatctcaaaaaaaaaaaaaaaaaaaaaagaaaagaaaaaaagactattttttgagcagttataggtttacaaaaaaaaaaaaaattcttccttgagggtatccgggcagctctaggctctttatgctactattcacattatacagtcagtttgttaagcttcccatagacacagaaccaagtgctgttggggttttgggtggaatattattgaaccaaagcaattcaggaagaactggcatcttcacaggttgtatcttccaatacaggagcatgttttatcttgttatttggtgttccttatttctgtcaatacaatttttagtctcagataaatttgttagatatattcctagatgcccaatattctttgatgcttttaaattacatttttttacttgtttgttgatgtagaaatacaatttgaatttgtttttcctgtttttgtttgtttgtttggttggttttgtctcctgttgcattttggacactgtctttagattggttttctagtttattcatctttctttagctgtataaaatctgctgttaaaacttatgcattggccgggcatggtggctcacacctgtaatcccagcactttgggaggctgaggcgggcggatcatgaggtcaggagatcaagaccatcctggccaacacggtgaaaccccgtctctactaaaaaaaaaaaaaaaaaaaaaaaaaaaaaaaaattagccgggcgtggtggcgggtgcctgtagtcccagctactcgggaggctgaggcaggagaatggcgcgaacccgggaggcggagcttgcagtgagctgagatcgcgccactgcactccagcttgggcgacagagccagactctgtctcaaacaacaacaacaacaaaaaaaaaaacaacttaggcattgagttctaatttttggttaattttcagttttaaatatttttatttggttcttttccaaatcttctctgacatgttttatagttttcagtctcctgtgatatgtttgaatttttgaatcttttaaacttagcaagcatcgttatttgatgtgatctgatcttctgcttataattccaaaacctgaagtctttgtgcatctgtttctattgtcttttgtttttgctggctcttgattgtgaatttaatttcattttgtgtgtggttatctttgtgtgctagagattgtattgaaaaattgcttgtaagaataatttgagccttaggatgatagttcctctcctttcctctcctctcctctcctctcctctcctgtcccctcctctcctctcctctcctctcctcccctctcctcttctgtcccctcccctcctctcctctcctctcccctcctctcctctcccctcccctcccctcccctctgctcccctcccctcccctcccctcccctcttcttttcttttcttttcttgatgagtttcactttgttgcccaggctggagtgtagtggtgtgagctcagctaactgtaacctccacctcccgggttcaagcgattctcctgcctcagcctcctgagtagctgggattacaggcatgtgccaccatacccggctaatttttgtatttttagtagaggcagagtttcaccatgttggccaggctggtctccaactcctgacctcaagtataccaaagtcctgggattacaggcatgagccacggcacctggccaatagtacctttctttaaggatggtgttggtttgctttttgcaggtgcctagtggggcactacctgtctggaagtattttacacgaagtttaagccttgagatttcctggagcaggacctctgaagtcaccatcacaaatggcaggcccacacaaggactgatttacttctgactcacccatggccttcaggcttagagttggggccttgtcggattcctctctcttaccaactctgggctttgactctgttgtccctaatgccatgctgataaataattaataactggctcttcataaaaaaaaacagttttgatctgtagcacctgccaattcccatggtgtaaacactcctgccatggctgacttcaagttaccaacacaacatcactgagtgtgggattggaaaaagatgcccatggctggctcttaagagtcctctgagccttgctggttctccctcacctgccattgagggggctgatgggtgcaacagtcattcctgaggctgcaaagttctttaaagcagaagcagctgactcttgcttatgttttgcagtacttgctgggctctcaactcctccaaggttttggcctggtagtgcattctttgctacctgatttgctcttttctgctttaaagaagattggaaaaaaattttttttttgagacagggtctcactctgtcacctaggctgatcgtggctcactgcatcctccacctctcaggctcaagggatcctcctacctcagccccccaagtagctaagaccacaggtgtgcgccaccacattaggctaggttattattattttttttttgtatttttggtagtagagacggggtttctctatattgtccaggctggtcctgagctcctggccacgagtgagccacccaccttgacctcccaaagtgctgggattataggcatgggccaccatgcctggccaattgaaatattttaatccagcttttctagttgtgttcagtggaagagttggtcctagtcactaatctgctacttatggacagagacatctcctattttctgttgtaaggacaggaaaaagcagaaaatatagaaaaggaaataaagagcaaccatctctcaatagtactgctgcccaacaagaacactgctgacatttggaaactgttttccaatttgattcttattggaaagcataacaaccagccagggcctgtgctgctggagcgggcagttatgtgcagggagacagctggttacggctggctcctggcctcgacggagcttctcagcctcttggagcctctgtcccctcagctgctgaaggaacacatctcctgcacttctcaagttgctgccggtgcgaaggtgactccagattctgcagtttgggctccgtagctgctcagcaaatgtcagcaggtccagaagcaaggctcctcagctgcagagtgaatgcaaatgtccccattgtaaatggccgtggggcccagggctctgcaaccttggatgcccaggatcagaccagctgtccgccgctttggaatctgggtttatgggggacccgggcctcataaatgtcaaagcgtgcattctcggcagtccaggagtcggaaaacgtgtctctgaggggagcattccttccatgcacacagctgcctggctcacgtttttatcctcgagccataattagtcctttcccctgaccctgaattcctgccccggccagaagcatgctgtggccctggggcccgcggctcctggtggtcggtgccccttctgctctcctgcagctgcggcaggtggaagagctgtcgggggtgggaagggggcttggagggataaggatgggctggggagggctcccaaggcagtggacactgtgggctctggggactgcatggctgtggagggggcatgtgctgttgggctcccagcctcttggggtcctctctgtgccaagatagagcctgttaccctccctgagcaggtgtgagcagacacctgtcccctgccctgcatgggaagtgaacgatccactaagtggggaggtcagggtcagatccccggccttcccatgcaggatgactgctcaggcccaggacagtgggtggtcaacagaaaccccatccctgcccatagagggtgcttcccagttcacagtgacacagcctggcctgctcctcttccagccacccaaggcaagacacagagcaggaggctgaggctggtgtgagggaaagggggatgcagcaaggggatacctcaaccttgcccgagctacagacaggtgaggacttctccctcacctggtgttttccactgcattctgaagagcaggtgacacccaccccagggtggatccaggatggatctctgggtttcctgccatctacaatgaccctcctcatttcccctggctagctgccccctaggatggagaatgcatcatggtcactgacacttggcgcccttttccagcctcaatggcctggcagagccagtggggacacagcaataatgtgggtggcagtaataacagcagctgaaccacctgagcaccatcctgacgaggcatagcctgagctctgtgaacagtgaagtccatctggtctctcagtggcctgagagtgactctaactattatcctcattctctgaaggaggaaaacaaggcaaggggatttaaataatttttaaaggtcagataccttcacaaaggctgaagtgggagtcagatgatagtgtctgggtggagaccccatactcttaccctcaactctgagccatctgctatacaacatctatttgctgagtggaaggtgtgtagcctgaaccatgctcacttctggtccagagctctttcctcagggccctgggacattcacgtttagtgtacagtggtatatgtatgctgaattcctacattaggccagccacatagtcagcactgattgctaaaagaataactgaataaggataaatgcttgaggggatggataccccattctccatgatgcgattatttcacattccctgcttgtatcaaaacatctcatgtaccccataaatatatacacctactatgtactcacaaaaattaaaaattaaaaaagatacaagttaaacatctggccagttataatgatatgaaaagtaataaggacaaaatataaataaaagattataagcaacaatagcaaaaagcataattggataaaaggaaaaaaaaatcccattccatgatgaagaaactaaggttctagggagccaggaagtggggtccgggctcctggctgagctcttaacccagagccctagcagttacattttccacagaaggacagaatgagcacatgggagaggcttacttgaagtccccttgccatcaaggggcaagggtggcacctacctctctttgggcagggccctgatcctgctggatgggggctgccagggctgctgctgagcagactcctaggctgattcctggacctgattttcattgacgctgcaaagacctcagcagagcgcctttgcgccctgatgagattgacacacagctcaaacacactgcatccttgtgggggtggaggagatgcacagaccctggcagaatgcaagagaagcctgtttaatgtgtcgacaggaagtatcaacctgcagcagaattgcaatgcagtctgtcctgggaggccaggggctgggcaggcggggcaggcgtttgccttgcctcgtgggccactcccaggatgactcctagcctggccaggatgaaggctttggccagcgttgacgctgtttcccaatgcagagatcactctgacacaggccagcattgcctcggaggtggcccagagctgggcgggagggagacaggcagatagcagggaagaatgagccatctctgtcccctcagctggggtgcccagattcagaggtctcatggtgatggctgccttcctggacctactcctggttgggctcagagactggtccagggaagggcctacacagcactctacagtgcaagagatgccgtcttggccctggggcctttgagagtccgcccctccagaggagctggggccacagggtgccctggccggggagtcaggaggcctgcagtgccagggccctcttgctggccgtggggtgtgtgccactgtgagcgagcggaagtgtgtgcatgtgtgagtgggtgagagtgtgtgtgttgtgcattgatgtgagtgtgagagtgtgtgtgtccccgaggaggggacagatgtctatgggagggctccgctctggactgagagcacaagtctgtgagtcaggacctcccggagccgtggtccggggctgtgtgcttggggtggtgagaggcccctggcacctccagcggctcccagtcctgtgtgggtcctgcagcctgtggtgcacagggcagtggggaatggtcctgggggccacacgaagccttggggaagtgctgcatttccaggctgcagagggctttggggtgccgactgctgaacgaggggctccctgcactgcggtcaccctgtggcagtgtcgggatgggaggacagggcctttgggggctgctgggccctgctcaccctccctgggcagcctgagccgggaggtcaggttgggggtgctgggctcccagattcagccccaggaggcgtccgggctgccatgctcaccccggccccgcccggaacaagggctcagagggagaatgaacggcagccgcctggtttgcacataatttgttctggggcagagttgcggctgttaaaagcctcggtgaaaaagcctctgggaatgtgacagcctgagacagggaaaatcagcccagggtccctcctcgggttcacactgctggaacctctgcaacctgcctggcaatttggatgtcaccaaaatctgccctgcggttggacgctggtggctgagggtgagtccaccgggcctgctgaggaggagagcggagcagggcatcatgggcaggggggtgctggagagggctggggggcatgtggggagcagctggcccctctggtggcccagggcacctctggagagggagaggcctgaatgggggctcctgtctccacccaaggctgtggggagaccaggactccccaccagtgaggaggggccatttttggagctgcctgctctgccgagtgagcttgtggcaggcacaaagtggacaaacagacaagcatctgagtggtggctgcccaggcctccaggccctgggggacagcagctcctcgctcaggaggaaatgctgtcccctctgggcaggggtgtctgtatctaaaggagttgggacacctgggctctgccggggctggtggctgggctggtccgtgcccctcttgggggtcagacagtggcagggcctgcagagcctgggtgtccttgtggtgctggcaggttgcagagggtggtgcatgagtttgcgggaggaccacagccggcgcccacacggcagacgtgggttctctcatgtcatggcttgaagacggctcaaggcgtgggcagggctgctttctcctgaggcctctctccttggcctacggatggccaccttccctctgtgtgcgtcccagtctcctcttcttacaaggaccccagtcagactgtatcagaccccaccccagtgacctcattccaccttaataacctcgataaagacccaatctctaaaggcagtcgcaccccgagggccgccttcagcataggaagttgggaaaacgtaattcagcccaggagaggtgggaagtgggccaggcactcaggggcggggatatccaggaggcctggcttgacctggccttgccgcaggcatcgctggtgggccctcctcaacctctgcctgcaggctcaggaagtttgttgtgaagcaaacaatccctgcgctccgaaggcgcttcttcaggccgagatccaaaaatctgacccccagaacctccaatgaccaactctttttcctcatgatgccaccaccgtcctcaccattattgtcatcggcgtcattgtcacctccattgattgagcccctaccagctgccagggctgggcaggttccttctcacaggtggcctcatacaatgcgccagcagccctggaggtggggcagctgtgccactgccccatgagagaacaatctgtcatgagtgggttctgcccatgaggacccagccaaagggaggtggccaggatcaggcagggccagcaccagagcctcaggcttgggcctaagcctaccacggggacccaggccgccctctccacagctcagggtgaggctggatcttcctcgctggtgggcacgcacgcaggcgggcaggctgagaggtgggtgctggcctggtctgccaggaagggtggcctcagctgcccgccccaaccctcaccagtggaagagaggaacgaggagaggtcatgaatgactggaactgccctcccgtgacctgccagatgaccatccaggttaaattgagatctgagtttcataaaagcaaattaaatagacatacatgtatattttgataattaaaagttttgaaccagccattcactcaagggtagttctggggaatttgtgcccatgagaccctccccctggtgggacagaaggagctaggagtgggaggccaggggaggcctgtctccctcatcccccatgtccagggaaagctgtgtgggcctgggccagctctctggccccatgggcactctgtgcctggtgacagcagaggtcctgctcttgggaggctctgaccccccacagcggggctgctctgggggagtgctggggagctgcggtgtccggggagggagctgggacctgctcccttgtgctggtggtgtacctgcctggcacctccctggcaccaagcgtctcataggaccctgcaacagtcccggctggggatgctgcctgcaggtttcaatggggaaactgaggctcagaggtgggatgggacctgccaccctgtgtgactggcaggacagagatggggctggattgggccccagcatggctggccctaaagtcccctgctttcatgctctgaccataaggctttcctcgtggaggttgctggggagatgagtggggttgttgcacaggcctcccgggtttaggccgcacctgggcagggacctcccagcagagatggtccccccatttggtgtggagggaccacatgagcaaggcagagtaggaggtgcattggggatctcgcggtgtagggggtggggcctgcagggggcggctgggatggggaatggggccgaggccggggggtgatggtgagggtgggagtgtgaaatggcagtgcccccacctgggcagctggagtgcatggccctgagcattgggtcctgcatggtcctgcggtggcctggtgggcccaggagaccagaaggcctgggctgatccctgagggtctgtctggtgggggtggccaagggcactcagggtcatggtgctgcagagggggtgtcagagggcagtgttggcaggagttctgagtgaggaggtgagaatgcctggtaaaggtggagggggagggaggggagggagaaagagggggtgaaaagggggaaggagggagggaggagggagaggggaggcccagtagacatcctcacccggggggcagtgagggttagggaccctgccctgcgtgagtgattgggcaggggatcctgagggcgcttccagcccctgcatggtcaggaggtcacacgcccactcacccgctcattcattcattgcgtggtcgggagctcacacgcccactcacccgctcattcattcattgcgtggtcaggaggtcacacgcccactcacccgctcattcattcattgcgaggtcgggagctcacacgcccactcacccgctcattcattcattgcgtggtcgggagctcacgcgcccactcacccgctcattcattcattgcgtggtcgggagctcacgcgcccactcacccgctcattcattcattgcgaggtcgggagctcacgcgcccactcacccgctcattcattcattgcgtggtcgggaggtcacgcgcccactcacccgctcattcattcattgcgtggtcgggagctcacgcgcccactcacccgctcattcattcattgcgtggtcgggagctcacgcgcccactcaccccctcattcattcattgcgtggtcgggagctcacgcgcccactcacccgctcattcattcattgcgaggtcgggagctcacgcgcccactcacccgctcattcattcattgcgtggtcgggagctcacgcgcccactcacccgctcattcattcattgcgtggtcgggagctcacgcgcccactcacccgctcattcattcattgcgaggtcgggagctcacgcgcccactcacccgctcattcattcattgcgtggtcgggagctcacgcgcccactcacccgctcattcattcattgcgaggtcgggagctcacgcgcccactcacccgctcattcattcattgcgtggtcgggagctcacgcgcccactcacccgctcattcattcattgcgtggtcgggagctcacgcgcccactcacccgctcattcattcattgcgtggtcgggaggtcacgcgcccactcacccgctcattcattcattgcgaggtcgggagctcacgcgcccactcacccgctcattcattcattgcgaggtcgggagctcacgcgcccactcacccgctcattcattcattgcgaggtcgggagctcacgcgcccactcacccgctcattcattcattgcgtggtcgggagctcacgcgcccactcacccgctcattcattcattgcgaggtcgggagctcacgcgcccactcacccgctcattcattcattgcgtggtcgggaggtcacgcgcccactcacccgctcattcattcattgcgtggtcgggagctcacaggcccactcacctgctcattcattcattgcgaggtcgggagctcacacgcccactcacccgctcattcattcattcctccgcgcatcatccattcatccacagtgctcactgtggcctctgggaggatgctcccactctgttgggggggcctgtggctgaggagccccctcctcagacttcgtcttgcttcccccaaacagctgccctggggcctgctgggctggagcctgcagatgggtgtgtggggagggtgcgggtgggcgggatctctcacgcctattgaggcccccatgcagggggtgccgactcccgcctgccacccaccctttgtccacggcgttcctggctgctttggctccctcagcctccagtcctttcttctcttttcacctccttttccaattaagagcccaccctgcctgccccacagacaccgtcaagcctggccccattatccagtcccctggcgggtggtctctgcaccgtgctgccctccatacgcagcagcctctgtctcaggggtctcactgccccattgggtgctgcatcctggggagcgagaggggctggtgtgactgtgcctgggccccacacctgggctccagcaaccctcgcaacacctatcctggctctgtttggcaacctaagggtggtgggccacgagcgtcccaggacctcagaattccagctcttggaaaagtgcccagggcatgaaattccctttagaacacaccctgggcccactgtccctcttgggcactctcagccctcaaggctggtggcactcactccctgccctcacaaaggctgctgctcccacctcctggccatgcctggggccagcagcaagtacattgtggccacagagccgggcagtcaggagaggccagagtgcggtagcacctgtcccacccgctattccacagtaggggacaaacggagcttggaggggttcagacggtgtcttgaaggatagagcaggttcctatctttgaggactcctcctcctgcttcctgacttctgggtggacctgaccatctcctcgtgttgcagaaaagggctctaaagcccagttgtaccacctaccagccagggaacctggtgaaatagacactgtacaatgtcttccagccttgtgcttctattctacagacgggcaccattacatcactaggaggagtgaacctgcctctggcaaacaggtccggcctgcagcacccacggcgggtggtttcctttcctaccccacagcctcccctggggccactgtgtgccctgtaaccccctccttccagcggccccacagctccagctgtctgggcaggctctcctctgactcaggtcgagagctgcagccaggccaggccctctgctgtgggcacacccgctggcatcacccctctcactgggcccagccacccctaggcctggtgcctccttggacagtgggcatggctgcccctggctgcagctggtgtcctggggctggcatcccaaagctcccgcgttctccagcaccggtggagagaaagccccgctgtccagccgagttctgatggagatggtgccaggcggcttgtgccctcctccgccctggtcctggggtctcgtggtgaagtcagctgctttagaaatcaggcgggagctgagggagtggagggctgggggccacgccctgagcttccctgggtaccccctgacggctgctctttaggagccaggctgggacttccaatataccacgagaagccagcaacctgggcttcgatctgagatctgtttagaaatgttggcaatgaattcaatattttaaaaaccaagatgtagtgagggaggctatggaaaggctaccagcaggggttaactggctgcctggcgtgagatggggtccaggtggagggggtgagaagggaggggagcaggggcaggatggaaaggactgcggtgaggcacgcgggtccatctgtgcagagctgctcgtggaggggtgtggaagcccaccccatccaccgccccactgggcctgcgcagtcaggcggtccccgggagctgagtaagggggctctgaggagagggtcctcatgacggttggggtcaccaagcccagaggaggcttccaggcagccaatttcagacttaattcaggcagccctctggggctgaccgagtgcccttctcgcccgcgttggcgagcaagaggcaggccctggtgtgctggtgcatctcctggcgggcttatgaggggctggagccctgggggactctggagcagcccctccaaaggatgccatgggcacagatgctgtgtctggctacaagaggcacttggatccccaggtttgctgctgtgtgtgcgtgcatgcagatgtgtgcatatgtgtgtatctttgtgtgcgtgtttctgtatctctgtgtgggtatgtgtgcgtctatgtatatctctgtgtatgcctgcatgtgtgtctacgtgtgtgtgtgtatctttgtaactgtgtgtgggcacacagacatatgaacgtgtgtatccgtgtctgtgtatctgcccacatgtgtctgtatgtgcgtgggtgagtgtgtgtctgtatctgtgcatgtgtgagtgtgtgtctgtatctgtgcatgtgtgagtgtgtgtctgtatctgtgtgtgtgtgtgtgtgtctgtgttggttccttcagcagggatgtcagctgtggccagggggcccgcaagccagccctaaatttgggcaaatttggcctgacctagggaagaaggaagctgtgttcactgccgctgagggtgggtgggagaagggctgagagggtgagaactgaggggccccagggggcaacagttaccctcagtggtgcaggtggggaactgaggcagagccagaggctgggagacaggaagaggtgggaagtgaccggagtgaggctgagcagagggagcgtcttcgtttcataaaaagccataaatccagccgaagctaactgtggaggaaagggtactgggcccctcctgtcttccccgaccccgtacactgacccgaggctggacgaaccctcagttcctgcccaccgagagcacgcatctgttcatgcccctaaaatatgggtgctcaggacactatcagccttggacagctgctgtttccacttgatctgtgaaatttatgccgttgggaagacaaatgttcttagccagggctgagggaaggtatgagcagccccccttccctcctgtccaattttggaggctgggaatattggcttcactctgacagctccctgactgggtggcccagaaacgacatatggctggagaattcccagcctgtaggctgaacacctccagcctttttttcctattgtattaaaatatacataatctttatcgctgtaaacatttgtaagtctgtaattcagtggccctgaatacactctcagtgttgtgcaaccatcacctctatctatacccaaagcttctcatcttcccccaacaactctgtccccattaaataataaccctctcccccaacacctctacccccattaaataacaaccccctcccccaacacctctgcccccattaaataacaaccccctcccccaacacctctgcccccattaaataacaaccccctcccccaacaactctatccccattaagtaacaatcccctcacccaacaattctgtccccattaaataacaaccctcttccccaacaactctatccccattaaataacaaccccctcccccaacacctctacccccattaaataacaacccccttccccaacaactctatcctcattaaataacaaccctctccctcaacaactctatcctcattaaataacaaccctctcccccaacaactctattcccattaaataacaactctccccccagtgactctctccccattaaataacaactctcccctctcaagacaattctgtccccatctaataacaactctctcccctgacaactctatcctcattaaataacaactctgtcttctttcttccctcagcccctgatcacctttattgtactttctgtctttatgactttgcctactctagacacctcacatgagtggaatcatgcagtatttgtccttttatatctgacttatttaactcagcataatgtcttcaaggctcagctctgtctcagcacatgtcagaatttccttccttttcggggctgaatagtattccacagtatgagtggaccacactgtgtttgtccttcatctgttgatgaacacttgggttgcttctactttctggctgttgtgacgaatgctgctacatgcatgggtgtataaatatctctccaagaccctgctttcttgtcttttgggtgtatgactaggagtagaattgctgggtcatgtggcatattcaaccttttgaagaactgccaaactgttttccacggtgaccacgccactttatatccctaccagcaatgcgcaagagttgcaatttctccacatcctcatccccagttcttttcttttctttatagctgtagccatcctagtgggtatgaagtgttttggtttgcatttccctaatgaccagtgctgttgagcatcttttcatgtgcttattggccatttgtatatcttctttggagaaatgtccattcaagttcttttttcatttttaaattgggacctctagccttattgaggtctttcttcctagatcataaagggtaggaacactgctaggctgggtcacactggtatgggtttaaaatgcaggggtcctggatccaagcatggtgagggattctggagtctgggctctgggaggctggggagcattaggacatgagagatctcttgggaggggcagtgatgggaggtgggggtgccaaggggtggcagagcctccctggctgcaagggaccatgggcagccccaggttttggagaactcccctaataggagggagcatggcatcaaggaccctggctgtaatgcttggaaggggaggactttggggacaacttttctggagctctcttatcctcccccaggcccagggcttatgctcactacacttttcctgtgcacattcactaaacaaacattcttgagcacccaggctgtgccggtggctggggcacctggagggaaccaggccaacatggctcctgtccccacagaacccacagtcttgagctgtgctgctcagtttggcagcactagccacttagttactgaaattaaagttaaatacagttaaataaagttgaggcttctgctaccagccaagatggagtaatgtgaattggatttatccttccacctgcaataagcaagaaatggacaaaaatacatgaaaaatcagttctcaaggcactgtagacaatggagtagagtaagaggctagaaacaaatcagatgaactccacagctgtcatatcttactgctggagagaatgtccatgccgtgaagcaggaagcaggaatccaggcagagccaggtggactccctgagttaaggaggagaccaaggtggtgagaattggcaggacagaggtgctgcagaggggagagcagaacacagagagaactctgagatccatagagggcccctttcaggattcagttgaggactgagcatcctctgagtatgaggaaactacctgagttgggaaaggctcagaactaaggcctggtgttcacacagggccaggaatagtgcctgttcctaacagtggggctggaaaacctcataatttctggggcattggtagaatgccttgcttcagtcgtgggatataatttgccctaggctgagcactgctccaattcttcctaaactatcttaaaagcaagaccctgaagaatcaaactgtttccaaatgacttaactgaatctcaggaaaagctcaagaatccaacacctaacaatataaaattcacaatgtctggagtccagtaaaaattaacaagtatgcaaagaagcaagaaaatgcaacccctaataaggagataaatcagcaaagacagcccaagactgacacagatgttagaatgagcaggcaagagcatgaaaatagttatgatgactgtgttccatatgatgaaaaagttaagtagagacatggaagatataacaaagacccacatcatatttctagagataaaaactgcaatgtgtaagataaaaaatacactggacggatggaattattgtcagattagatgttgaagaagaaaagatgatcacacttgaagacatagcaatagaaataatccaaaatgaaacacagaaagacaatattattttaaaagttaacagaatatcattgaactttgggaaaatgtcaagtggtctaatctgtttaattgaattatgtgaaagagaagagagagatgggaacagaaaaaaaaatacttgaaataatggccaaatattttccacatatgaaaactataaacccatagattcgagaagctcaaaaaaggcaaagtacaagaaacatagaaaaaactacaccaaggagcattataagcaaattgctcaaaagtagtgataaaatttcttgcttgcagccagaaaataaaaggcaagatttgtatagtgcaacaaaagtgagaataacagcagatttcttgtgggacacaacgtaagccagaagaaggtggatgaacatctttaaagttctgaaggaaaaaatatctttcaacctagaattctgtgaccattagaaatatctttcaaaagcaaaggcacaataatgacttttacaagtatacaaaagctgaaagaatgtctcaacagaggacctgcattgcaagaaattttaaagaaattccttcaggtggaaggaaaatgatactagttggaattatggctctacagaaaggaatgaaaagtcctgggactgacactttataggtaaatatataagatttatttttattatttaaatttatttaaatgataattaattgtttaaacaagaacaataatgtagtatgaggtttatggcatatataaagttaaaatgcatgacaacaatagcacaaagttttgaaagggaggaatgaaaatatgctattaaaatgttcttatcttgcatgtgaagtagtataatagcacctgaaggcagcctacgataagttaaaaatatatgctatgagccataaagcaaccaataaattacaaaacaaagggaaatagctaataaaacaacaaaacacataaaatggaattgtaagaaatatttcattaatcctaaagaaggcagaaaaagatgaaaaagggaaaaacaagtgggacaaatagaaaataaagagcaaaataatagacttaagcctaccaataatacattaaatgtaaacagtccaaatattccaattaagagacagagtgactaacagaattaaaaagcaagacccaactatatgctgcctataagaaacacacattaaatatgaagatacagaactcttggtttctggcctggcatgtggcatgtaaacagcttggaagtcatcactccattctcattacaagtataaagctgaacaaaccacaaaagcaactcttcttagatccttaagagaagcgaggtcacagggcaaactgctgtccctcaaattggatggacagacagacaaatacagagaattacaacttactggagcagaaacctctgcaggaaccagtgctggaacaagaaaacctaaagtgtaatcaacaaattgccagaggctcagtgtggataagcctgggagttaaaaactccagagagacccagtcacagtcccccttcccccagcttttgtgaatttttcctcctcggtctttcctccaggttcacacagtgaataccaaaggaaaatccctttgttctttccagcagggagaaggggaaaaagagccattttgagatataccagactatctgttcttaataatggtctaccttccagagaaactaaccagatcctagccttctggagttttatccatgcttaattgacctgacagaaaggaaacacccacctccagccccctccagccatcctgtcccacctaaggagggggatctgagatgcactggtgagtttcacagtccagaggcacaggctcactaaaggtaaagatacaaataagctgcaagaaagggaatgggaaaagatataccacactaacattaattaaaagaactctggagaggctgtattaacatcaacaaagtagatgtacagaatattaccagaaataaataaaatcactttgtaatgatacagaaatcaattcatcagaatgtaacaattccaaagatgtatgcacctaatgacagagcttcaaaataaatgaaacaaacactaatagaactacaaggagaattaggcacatacaattacagccagaaattttaatacccctttttcaataactgttaggacaaattgacagaaaatcaataagggcgtataagacttgaagagcagattcaactgacatttataaaatactccactcaacaacagaatacccattcttttcaagtgcacatggaacacatttactaagatagacaatattctgggccataaaacaagtccaaaaaatataaagggatccaagtcataaaaagttttatctgatcacaatgggattagattagaattgaaaaatggaaatatttctggaaaattcccccaaatttggaaatgaagtaacatatttcttggtaacttatgggtcaaaggaggaattaaaagggaaattagaaagtattttgaactaaataaaaaggaaaacacagcctataaaatgtgtgggatttagttaaatcccactatttagggggaaatttgtagcattaaatgcctatgttagaaaagaagaaatatcttaaatcaatgaccttaagaaactagaaaagagcaaatgaaacccaaagtaagaaaaaaggaagtagtgaagatcagagtgaaaaatcaatgaaatcataaacagaaagacagtagagaaaatcaatgaaaccaaaagctggttcttcgagatgattgaaaagatgaacaaacctttaggtaggctggtcagtaaaaagagagagaagacacaaatgaccagtatcgggaatgaaggaggttacataagaactgattctactgatattaagggatgataaggggatattatcaacaactctatgtcaataaattcaactactcaaaatggacaaattccctgaaagacacaaattaccaaggatgtgcaggatgaagtggataaccacacagccctgtaactattaaagaaactgggtttgtagttaaaaacctttctacaaagaaaactccacggtcaggtggctttactgatgaattctaccaaatgcaaggaagaaaataccacttaaccaataataatatgcggagtgcaaataagcatgtgaaactgctcaatatagttagtcaatcaagtggaaactaacccatagtgtgagaacaccacacacctagtagaatggctagcattaaaaagactgacataccaagtattggagatgatacggaggaactggaactcttctgtgctgctgggggaggcagggtatgtaaaatggtacaactgctttataaagcaatttgtcagtctcttaaatcattaaacatatacctaccatataatccagtcatcccacttcaagagaaatgaaaacagtccatacagagttgtatgtgaatattcacagcagctttatttgtaacaccccaaaactaggcagaacccaaacgtccatcaacagttgagtggataaataaaaggtggtgtgtccgcacaatggctgctacttggcgatagaaagtgatgaattattgatgtgcacgatgacgtggataaatggcaggtaatatactgagtaagggggacagataaaaaggaaatgtaattcacgattttataaagaatatgtatgtaattcttgaaaatgcaaactaatctataatgacagaaaatagatcaatggttgcttggggcctggagaagcgggcagggaagatggagggcaggatctccaaggggcacgaagaaggtttttggtgtgatgggaatgttctttacttttgtgatggttttgctggtgtatacatgtgttaaaacctatccaattgtatactttaattatgtgtagcttattctatgttagttatacttcagtaaagctacagagtacaatttttaaaacccaggtctgtggttacaataacatttcgagtgctcagtaaccacagtagctagtggctgccacactggacagtgcagatacagaacgtttttattactgtggacagtgctggtctcgagggaaagacacacatgacctggaccatggcgtgggctttgtctttgcaatgggaggaaaacatcagcggagtaacaagaaggaagggactcgagggccttggcagatgttggttgggctgaccaggtctgcacccaggccctgggggacctggtggggaaaaggtccttcctccccagtggggtgaggggagaggtgttggccccaagcaggatggtggcgatgccaggtggctatggtggtgagcggcccacactgctgtggaccaaagccagaggggagggtgtgaggcttgaggtggggagctcagatgctgctgaaagaaggcaggctcagggcagcccaggcaagaggggttgagccagtgatgctctctgccctgctgggatgctctccccgtcccctgctgctctgccttggggagcagagagaggaggcagaaaggggtctctggggaaggtgcgcccaccccagccagtgtactttggaagggaagtggcatcccgggtgtcagggccccccaccctggggcagaggaggagctgacctggggagcaagcagatgagagcccagggctcactaaggctttggggagcccctggttctgagccctgccttccccctccctctgccctgggctgggactctgagctcctgcttcctgcacccccatcactgtctcctttggggacagggaccagctctgggggtcaagtgctagggtgaggttgacagaggtcccgcttagctgcacggcccccacatgtagacagtgagggggagtattaactggcaggggaggcacaccccagccccctggggagggggccagctgcatgccggggacaggctgcagctggggtgacggggctgggctcattccggttggggacaacatggctcagatgggtcccacctgcaggcaagcctgtcctgagggccttggttccagtgcaggggtggcagagcctcctgctgcaccagacagggctggggcaggcggggtggctgggcggggctggggcaggcggggctggccatgtccactgcagggcctggaggacgggtcttggctcgttccccacctgaaggacagggtgggggggggggactctctcctttcgttgtcccatctgtcccttgggcaaaattgaacaaacccataaaagccaaataactctcattgtagaggacggtccaccgcccaggtctgcacagtggctcctgaggccgagttgatcaaaatgtaatcagttctaacgcaagacctatttgatgacaggtatggtgtggccgtgtgtaactatccttacaattaattaacttttcatgtcgttcattaagctccataacttatgaggccgggcactgtacagttggaagtcacagaagggaagactggagttaaaccgtgctagggtgtccctggcatgaggggcaccctgcgtggcagctcccagagctggtgtctgtgcacaagcatggtggggcttacccgacccctgcccctggctcagctggggactcatggtggagcagctgcagtcgctgtaggatcattccctttgtgactggaaataattgtatttgtgatttgcacaatgctgcaacatattgatttttcaattacgccgggaagaaatcgagaatgagatggaagggagtggcggctcctcgaggggctctgagttggggtctgcagcattgcagcgggtgaccctcagcagggggccttgggccagcgacccccagggtcttagagctacaagtgacctcagacatacgttctttgtccagctggggaaactgaggcccagggtggggacaggcctcgcccgagggctggcagtgagggtggcaccagagcttggtccctgcccctgactttagtatgtgaggccctcaccttgccctggcatgaataaatgaagttgggactagcaggaaccttctgagagggtccactgggcctgagccgtcagggaaatgcgaagttggcatacaaacttggcaaatctgttcctcatgccaacactccccctggggcttgccttcgggccttgcctctctatctccgttttaaaatgttagtcttggttgaagcgtcccttcctctggatcttctcagggcctctctgtcctggctgcccccgccccagtattggcatcttgtgggtctggccggcctgggctgctgggaggacgggtgagcccccgaggcagagcctactgtctgccttctccgcccccaagggcaaggaccgggtaaggcgtgggagctgcagagcaggaagtggctagagcttgctcacaggcagtgctgggtgccgggcttggggatgagctccggacagggggcttttggagcgctggcccaggcagtggtgctgacgcaggggtctggtatcccaggcaagaagggtggctggaggtgtctgtgggtcaccccctttctgcccttccctgtcatctgctcctatccctgggatggggttctgggcctccccagccttgggtaaggacgctggtgttggcatgagccgaactggtacttgggagaaagggctccagagcccccagcttgggggaggctgggcaagccagggcaacaagcccagggaactgagcccaccagggcagtgcagccccggggtgggggtgcttcctggagggaggctcccagcgaggcctggggttgggccagccctcccagctgcctgtggcctctgtggcacatgcccaaagacataattctgcagcacctctatgggcggcagctggggatgatggtgccaccgagcccgtgacaaagccaatgtctttttgagggtcaggcgcagtccataccaggctttaatttaaaaatcaaattcagccaggcgtggtggcgcaggcctgtaatcccagcgctttgggaggctgaggcaggcggatcacaaggtttggagttcaagaccagcctgaccaacatggtgaaaccccatctcaactaaaaatacaaaaattagccgggtgtggtggcaggcgcctgtagtcccagctactcaggaggctgagacaggagaatcgtttgaacccgggaggcggaggttgcagcgagctgagatcacgccactgcactccagcctgggtgacagagcaagactccgtctaaaaaaataaaaaataaaaatattaaaaaaataaaaatcaaattcagcctggcatggtgggtcaagcctgtaatcccagtactctgggaggctgaggtgggtggatcactggaagccaggagttcaagaccatcctggccaacatggtgaaaccccgtctctactaaaaatacaaaaattagtcgggcgtggtggcgggcgcctgtagtcccaatcactcgggaggctgaggcaggaaaattgcttgaaggtgggaggtggagcttgcagtgagccgagagcgcgccactgcactccagcctggtgaaagagcgagactccgtctcaaaaaaaaaaaaaatcaattttttttttctcagaacctgccctgctcatttataagctcatagaaagctctataggcaattgcatttcctggtgcgtgtgtgtgtgttttaaagaagtggaaaccacatgggagggaacacacgggctgccgcctgctggcttctgttccaaggaagctcctggtttctcctaagatgaaggagccactttcctgggctcaggccctctgggatctgacggccaaatttgggcctacagagtagggagtgcgggtgagggcagggaccaggaggcagaggcagtgcttctggggtctggggcgctcactcgggtacaggacatctggcttctgggtgtggctggggaggtgggaagtgagggcacttgcagggcctgttctgggagacctgccccctctcccaccctgaggtccgtagactctgcactcctcctgccttccctcccaccctagggtccagagcctctccactccactcctcccgccttcccttccaccctaggggagcacgagacagaacttaacacgcacctcaggccaacacctaccgtcatggccctgcgagggagccgagttcgtaaatgaccgcacaggtgaaggatttaattttctctcatttgtccccgtattccggctgtctcataaatcacagctgtttatgactctcttcggcacttttgtgatggctgataatggctgagtaagtggcagagaggatgaattctgcagcggattttaaacaaacgtgcacattggagccacagataatgtgaagcatcgcagcagtggggggcacctcgcaggtcacccccagagcgcagccctggcctgctgggaagggcctgctctctgggggcctggcctccctcccagaggtgggcaggggccaggggcagcttcttcccagggatattttagtcacaaggagcaagccccaccaaggctagtgggcacctgtgtgtttgagagtgtgtgcaaatatgtgcctgagtgtgtgcgtgtgggtatgactatgtgtgcacgtgtgtgtgcgcacgtgtgtgtgtgtgtgcacgtgtgtgtgcgcatgtgcacgcagtcagagtgcgcaggctcctcacctgtccagggcgcacggcccagaaagaccactgcttcttaggtcatagtgcacctatctggaggatggggcggtaccagagccccaggtcagagttctcagcagctgcagggccttgttcaatggctgagggtcaggctctggcctggagccggctcccggagaagtgccaccctctgtcccctgctgggggctggtggctgctctccctttccaagggtccctcccaaactcaccttccctcaccccagacctcctctgtgaggaactgataaagccatagtggaggtgcacacacacttcacacgtgcacacacacgcacatgcccacacacgcccacacatgcacacaccccccacacgcatacacatgcacaaacacgcccacacacacgtgcactcacacacacacgcatgcacacacatgcccatgcccacacacacgtgcacacacactcccacgcccacacatgcccacatgcccacaagcccacttccccgagacggtagccatgggttcatctggagcccattcctcaatcaccatccggtctcacagcccccgggcactgggggtggtgcccaccactgtttattttctgctaagatgcactttgccatcctaggggttgcagcatctcctcgtaaagccataaatgtaattgatattctcagcatttcgagaaaaaatacgagtattaaagatatacagtacacctcataaaattctctcatatttcttctttatggtgggttctaaaattggcaaaataaattccctaaaacccattatgctcaacgtacagtgtgttttggaggctgggagaggctgggctgggggctgcacgctcctctcctaacatggcctcagtccccgcttggccacgaggcctgttttcctagaaacctggtaaaaatgggaatggtaattgcccagctcatggtctgtgaccgcggccgggtgctgggaagcttaatctcaatgcttcctccaagaaaataaatgcttttatgatgctccccacgcaggttctgcctgactccgggatgctgccgtcccagctctgggctgagccccttttgtaattacatggggaccctgtccccatgggcgcaaacactgaggccttagctagcagagagcacaggcttcagagcggccgctcccagattcctgcactgcccccctctgcagcttcacaaacctccgcttccgcttccgcttccgcatccgcatcccggctccttccttcgtagtgatagtcacgactcctgattgcagatgcacgttttttctttattatctttctatttcaggagatgaaagctccaaagaacaggctaccacattaaaaaaaccatttacagccaactttatcgaggtatcatttccatgtaataaaatgcatacctttttttttttaaagtaggctttattttttagagcagttttagattcacagagaaattgtgcagattgtacagaaaagcgccacctacgccaagccccatcgtgaacacctcccagagtctgatgcgtttgatacattaatgaatcaacagggatacgctggtaccagctaaagctcacacataacgcagatttcctgagttttttatttatttttatttttttttaattttaattttttttttttttatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgacctcgaggccttcccctgcctcagggccgcgtctgggacacaccatgccttttggtggttgcggctcctcctcagggccccctcagctgccacagtttctcagactttgttttgatgaccttgacagttttggggagaacgggtcaggtattttgtgaacctttattggaatttgtctgctgttcttctcatggttagactggagttacaggtttttgaaggaagaccacaggggcagggcagagggccactgacgccacacccttcccagggtgcctgctctcaacacggctgtccccgttggcgctgaccttggtccctggctgaggtcgtgctgtcagctttctcctaggtgaagttaccgcccacccagcagcccgccacgacctccagcactctttggaggaaggtcacggtgcacagcccacaccgcggggtggggagtcacggtcgcctccttgggggcagaggatctgcatgaatccttccgaatccttctgcttggagactcgtcccttctcccgtgtttgctcatttgctcagtttttgggttccatcagcaacgactcacggacactcttgtcagatttcgggtgtcccagtcctcctccattttgttgctcaagctgtcctgtctttggcggtggcagctcttcagtcggcctgtgacccgtccctttggttttaacgcgtccttattttctgggatgagaagaagctccaggctcatcctgtatgtttcctgcctcagccccacatcagctgttcctccaaggagcccggtgccttttgttggaaggtcccattagacaccaagacctgggcaccgggcctgcttgctgcttgggtgtggttgcttccaggccctctcggccagcggagcagggaagtgtctgtgcgtgtactaacctgggcatgagcccatgtctaacgtgcttctgtgtgtgaccctccgtgtgagtaggggtcatcagagaaacggatgcagtgggacgttcacacccactcctgttggagattgcctggaagcctgggcgcaggtgaccacgcaggccgagaggtcccacgcccgcggagacccagggaagctggtggtgcagtgcggtctgagtccgaagccctgaaagccggagggctaatggcgttaatctcagtgtcagggccagagaaggtgagtgtcccagctcaagcagcgtggcaggaagaggggggcaaattcacctttctctgccttccgcgctattcgggtcctcagcggattgggtgacgccacccaccctggggagggcggcctgctttacagagcccactgattcaaatgctaatctcatccagaacaccctcggacatccccagaaataacgttcaacccggcaccccacggccaggggagctgacacataaagttaaccgtcacaccgcccgcgtggagagggagcccacaggaaggagctggtgctgctgtctcgaccctgaccctgggccgtgtgggtcgttctggcccctgcccctgcttgtctgtagctcccaccccacagtgaggaacctgccccaccacccaccatccatggacctaatcgctaagctgcagtgtgcagggggagcggtgtagggactgctcacctgtaccccgcggcagaagcgtgtgtctgccagggtacagggctcacgtgcgggtccatttgcttttggcttcacagactttgtcgtttgtgagggtacccaggtcagccccatcccccagcccctccctacgtctgtaatacagctgctccctgggtctgtgatacagccagaggctctcgccacacatggcccgccttccgtcctagacccccagcctcttgactgagctttaaaatttgcatacattaaggctcactcttgctgtgaagttctgtgggttttgacagatgcacagtgtcgtgtctctgccattacaatgtcgttcacgttagtttcacagccctaaaaaccccctgtgcggccgggcgcggtggctcaagcctgtaatcccagcactttgggaggccaaggtgggcggatcacgaggtcaggagatcgagaccaccctggctaacacggtgaaaccccgtctctactaaaaatacaaaaaaattagccgggcgaggtggccggtgcctgttgtcccagctgctcgggaggccgaggcaggagaatggcgtgaacccgggaggtggagcttgcagtgagctgagatcgcgccactgcactccagcctgggcgacagagcgagactccgtctcaaaaacaaaacaaaacaaaacaaacaaacaaaaccctgtgctccacctatccaaccatctcctctcacctggaacccctggccaacactgatcttactgtctccacagttttgccttttccagaaagtcatacagttggaaccatacagcactgtagtcttttctgattggcttctctcacttagcaatattcgtctaaggttcatgcctgtcttttggtggctcgatatctcactgctttttatcagtgtataatatcccattgtatggatggatctgccagaatttgtgtatccattcacccaggacatcttggttacttctaggttttggtaattatgaataaagctgctataaacatttgcatacaggcttttgtgtggacctaagtttttcaggccagttgggtaaatacttaggaatgcaactgctagatcatatggtgagactatgtttagctttgtaagaaactgccagactgttttccaaagtggctgtgccattttgtcttcccaccagcagtgaatgggagtttctgttgctgtgtattctcatagcaattggtattgtcactttttggaatttagccattctaatagggatagtggtgtctcgttgttttaatttgcatttccctcatgaaaaatgatatcaagcatccttttatatgcttatttgacatttgtcttttttgagtgaggtgtttgttcggacctttcccccattttaaaattgcgctgttcgttttctagttgttaagttttaggaagttctttgtgtgatttggatacaggtcctttaatctgacttacattttacaaaggttttctcccagcctgtgacttgtgttttcattcttttaatggtttcttttgccgggcagaagtttttaatgaaaaacacatcttaacaattttttctttcataggttgggctttgggtgttgcaatcaaaaactcatcgtcagactcaaggtcacgtaggtcccctgctttcttctagttttatggtttacatttaggcctctgatccctgttgaggtgacttttgtgaaaagcgccctcagtgtgtgtctagatttatttacttattctgcatatggatgtctaaatattacagcaccatttgttgacgagactttctctgttagagacacattttctcctttgtcaaagatcattggcatttgtgtgggtctactagtggatctctgttctattccactgatctgtttatccattcattcatcaatatttcctgtcttgatgccatcatcttataggaagttttgaaattgcgaagcgtgagtcccctagctttgtccttcaccgttgtgttggccattctatgtcttttggctttgtgtataaactctagaatcagtgtgttgatatctacaggagagtttgctgggatattgattagggttgattagatctattgattctatagcccacatttggaaaagtagacaccttaacaatattgagtcttcctatgtgaacatggactatctcttcattcatttagattttttggatatctttcgtcagaggtttgcagttttcagcatacagagcctgtacatgttttgttagatttgtgcctaggtattccacttttgggggttctgctataactagtattgttctttaaatttcaaatcctgattgtttattgctggcatataggaaaggatctgactttcatatatcaaccatgtatcttgcaaccttgctgtgtttgcttatttctttcaggagatagattcatccattcatccatttaatcatttacatgttgctatggtttggctgtgtccccacccaaatctcatcttgaattgtagctcccataattcccatgtgttgtgggagagacccggtgggagataattgaatcatcgtggcagtttcccccatactcttctcaaggtagtgaatacgtctcacgaaatctgatggttttataaggggaaaccccttttgctttttttcctcattctctcttgcatgctgccaagactgtgagggctccccagccatgtggaactgagagtcaattaagcctctttcctttataaattacccagtcgtgggtatgtctttattagcagcgtgagagcagattaatacacacatcttagattgattttccaatgtgaaaatcatacctcaaataagtccctcgtggtcatgctgtgtaattgtggttatacattgttagatttgatttgataatattttgttgattattttcatatctacattcatgagagttattggtttgtagtctcaagtttcttttcttgtaatttctttatctgttttggtattagggtaatgctgacctcttacaatgagttaggaagcatttcctctgcttctatttttcagaagaaaaattaaatcacttaacataatgatctccagttccatctgtgttattgcatataaagacagactgtagagaattggtatttattccttacatagttggtagagttcaccagtgaaaccatctgggcctagtgctttcttttttgaagataatgaagtattatttaaatttccttaacagatatagacctattaaggctttttaaaatttttaaattattttaaaaagtatttgtgggtacatagtagttgtatatacttatgaggtacatgagatgaagatgttttgatataggcatacgatgtgaaataagcacatcatggagaatggggtatccatctcctcaaggatttatcctttgaattacaaacaatcctattacattctttattttaaaatgtaaaattaagttattattaactatagtcaccctattgtgttatcaaatactaggctttattcattgtttctacttttttttttgtactgattaaccactcccacctccctcccagcccctgagtatccttctctgtctctggtaaccattcttctatgctctatgtccttgagttaaattgttttgattttttagctctcacagataagtgagaacatgagatgttgatatttctggacctgacttatttcacttaacataataacctccagttccatctgtgttattgcaaatgactggatctcattctttttttatggctgtagagtactccgttgtggatacatactgcattttctttaaccattcatctgttgatggacacttaggttgcttccaaatcttaactcttgtaaaaagtgctgaccatcataggagtgtaggtatctcttccatatactgattccctttcttttgggtatatacccagcagtgggatgtctggactatttagctttttaatttctccttgggtagtttatgtcttttaaagaattggcccatttcatcttaaatttcaaatttgtagagatagagctgttcatggtattactttattagacttttaatgtctacggaatcagcagtgacaacctctctttcatttctgatattggcaatctatgttttctttgttttttttttccttagttagtccatttcattgatcttgttaaaaaataagcttttgatttttttctatcactttcatgttttgagtttcattgaattctgctttactttttattattccttttcttttgcttgctatagtcttaaatggttctatttctagtttcctacaatggaagcgtagatgatgtattttagacttgtcttcttttctaacatgtacattcatgctataaatttcccctgagtactgcttttgctgcagcctgcacattttgataaattgtcttttcatgtattcctaaatatttaaaatttctcttgagacttctcctttgacccatgtgttatttagaagtatgttgcttaatctccagatatttggggattttccagctgtcttttctgttcctgatttctagtttatgccattgtgtcttaagagcacgacttctcttcttttaaatttgttattgcgggtcctgcggcccagaacgcggtctgtccttggcgaatgctccacgagagcttaaaagaacgtgaacctgcacgtattctgtggttgctgggtggaatgttctagaaacatcagttgatgaagttgattgatagcattcttcatgtcacctctgtccttgctgacttctgattgcttgatctaccaatgactgaaagaggagtgttgatgtctccagctatagaggtgggtttgtctgttctccttgcagctccttgagtttttgcctccggtgttgtttggaaggacgtgtctggagctgctgcagtaaagctgaagaagtggccgcgtgcagtcctaagctcctgtggcctctcggttgccagcaagtcctttccttggctgtgggccagtgactgtttgcgagaccgcagaacggcgagctacatgtgatcagccgttggaggagcctcttctccccggctcgccagccccacacgcccaccctgtctcagagagacttatttttccttcttcaatgtcgtcaggctttgcctcctgacttaccttggccaatggaacgtaagcagaagcagaagcgcctcttcaagagagtgaaacggtcctggagggagcggctcctccagcctggatgctcaactgtggcaagcgcccggctgacctacaggaaacgcggagcccgagtggaaacacacgtgtgttgtaaactgctgagacgccgagattgctggggccacagcccggcctggcatcagctgactcgaggagaaactggcacctagaattcgttgctgtcacacacaaaacctaaaatttgtggcattggctggggtggggcaggggagggggagaaactataattagaggctgggagcagcatttttatgtggtgaaacatttggcaaaacgaattctgctttactttttattattccttttcttttgcttgctatagtcttaaatggttctatttctagtttcctacaatggaagcgtagatgatgtattttagacttgtcttcttttctaacatgtacattcatgctataaatttcccctgagtactgcttttgctgcagcctgcacattttgataaattgtcttttcatgtattcctaaatatttaaaatttctcttgagacttctcctttgacccatgtgttatttagaagtatgttgcttaatctccagatatttggggattttccagctgtcttttctgttcctgatttctagtttatgccattgtgtcttaagagcacgacttctcttcttttaaatttgttattgcgggtcctgcggcccagaacgcggtctgtccttggcgaatgctccacgagagcttaaaagaacgtgaacctgcacgtattctgtggttgctgggtggaatgttctagaaacatcagttgatgaagttgattgatagcattcttcatgtcacctctgtccttgctgacttctgattgcttgatctaccaatgactgaaagaggagtgttgatgtctccagctatagaggtgggtttgtctgttctccttgcagctccttgagtttttgcctccggtgttgtttggaaggacgtgtctggagctgctgcagtaaagctgaagaagtggccgcgtgcagtcctaagctcctgtggcctctcggttgccagcaagtcctttccttggctgtgggccagtgactgtttgcgagaccgcagaacggcgagctacatgtgatcagccgttggaggagcctcttctccccggctcgccagccccacacgcccaccctgtctcagagagacttatttttccttcttcaatgtcgtcaggctttgcctcctgacttaccttggccaatggaacgtaagcagaagcagaagcgcctcttcaagagagtgaaacggtcctggagggagcggctcctccagcctggatgctcaactgtggcaagcgcccggctgacctacaggaaacgcggagcccgagtggaaacacacgtgtgttgtaaactgctgagacgccgagattgctggggccacagcccggcctggcatcagctgactcgaggagaaactggcacctagaattcgttgctgtcacacacaaaacctaaaatttgtggcattggctggggtggggcaggggagggggagaaactataattagaggctgggagcagcatttttatgtggtgaaacatttggcaaaaccgtcatctatgttttctcgggggcggaaaacataggaggctttgggctgggcacggtgactcacacctataatcccagcacttgaggaggctgaggcgggtggatcacctgaggccaggagttcgagaccagcctggacaacattgtgaaacctcgtctctactaaaaatacaaaaattagccaggcatgatgacggacgcctgtaatcccagctacttgggaggctgaggcaggagaatcgcgtgaacctgggaggcggaggttgcagtgagccaagcttgcaccacggcactccagcctgggcgacagagtgagactccgtctcaaaacaacaacaaccatcaccaccaaacagaaaacaggagattgtggattcaagcaaagaggtttggaaaccaaatgtgactggtgtgtcttggttgctattggagatacggatgagataatacaagaaagatgtgctcagatggaaattgtctggtttgcaaacagccttgaaagaggcaactgcttcttagctccaaccagtaaaggataaatgggagacatgcttgctccacaaaagccagttaggctcaggctggtggcaaaagccaggtggagagtgtaacccccgggggttatgatctctgaatagattaaggtggcagcccagcacatttctttctctttctttcttttctttcttcctttcttttcctttcctttcttttccttccttcccttcccctcccctcccctcccctcccctccccttcccttctccttccttccttccttccttcctcccttccttccttccttccttctttctttctttctttctttgaccagttctcactctgttgctcaggctggagtgcagtggcacgaacacagctcactgcagcttcaagcttctgggctcaagctatcctcccacctcagtctccccagtagctgagactacaggcgtaattttaaaattagcccagctaatttttaaagttttgtagcgatgctgtcttggcatgttgcccacactggcctcgaactcctgggcttaagagatctgcctgcctttgcctcccaaagtgctgggattacaggcatgggtcactgtacccgaccccagcaaatcttttgagtcaggtgaaattttgtaagaagagaaattgggggcattgctctcccaaggaagccccagaagttaaaagtagctgccgtaaagtcaagacagtgagacgtatctcctcacctgccgtgaactgcccaaaacagatgtgaagccagccacgtgctgagggatctgcacacccagctttgccttgcagtgactgcgaaggtgcaagatttaaaaatcacgtctgagcctccagcgttctgtggacagaaagcaggagtggtgcgggctccctgaggacataatttccaatatcctcttcagatgtagcccagagggtgatggaaaaggaagaacctcccagaggcgagctcggtgatgggccagtaatggattaggggctcacaccacggactggagtcaggtatgttgatcagccccctggggtttgcctgggacgtcgctggcttcaacactgaaagtcccacctctcaggaaacccactcgtcctggtgaaccgggccggatggtcaccatgagagcctggtttggaaacattccccacgcccaggtatggggctctcaaaaatctctgcccagcaggagcacagggctgccatccacgagcgaacacagtgccgccctttccctctccaaaaggggtgcttcttccgtccatccggggtctgtcccgccgtggtattttgtgttgtgagtggaagctaacgttcccttttagctcctggatcgggaggagatgtgttcagatgggaggctgaggctgtttcccacatgttctgtgtgcagacgtgaggggagtgaacatgaatggtgaggtgtgtgggctgctgggttatggtcaccaacgtggactcctcttctgggactttcccgccttactcacagcagtcttaaccacgcgactcgcccagagtgagcagatgttagcagcagtgggccgggctgtgtccagcaccaacctgaagagcaccacgtggtcctgccacattctttctccctcggctgcgggagggcctggatcccaggagagagaagatgcatggggcagacccatagccacctgccgcctacacggaacaccagccagaaaaaaaccttgtgttgaaagagagatcagaggcattgctcagtgattccaatcctgaatcgctgagcttctggggatgtttgtcatggcagcagaatccagcatagctgactaacacagaccatgccactaccttctcctggagaccctcactgacttcaggctgacaagcacaggggcctcctgcctccccttgggccagtcctggccttgcaggcaccgtctataccctgactctgctaccctgcacattatcttatctgcctccttttctatcgaaatattttaagcaaggggagaaacgagggtggagcagcaaccagaggagacccttgcccaggggatgcctgcccggggtctgtcctgggcagggagcagcacagccctggtggcttgggtaatgtggcagccccctccccaggagtccctgcactggccactccaggcaccaggattctttttgccttaatgaattcccctcaagtctccggttagaagtttcctgctccaatcttgaatatgcatcttttaaaatactctgcaaatttgagggcctctcatgtatcatttcaatcctccagctattagagaaattggggtatcatatagattacggaaaaattactttgggcagagaaggaggtagaagatcaaacgcttatctgtacaaataaattcagtgcgatccacaattaagcagcatttgacatttaaaaaatatttgatccatgttttggcttccagagctgcttaagggagctgcgatgtgtaaattacattcaaatcagggttaaatatagttcccagagaaagattgtatgatttaaattgcctaattatttgggggaaaaatctgttctccaataattaagagaatgaggatgttcgacttattggggagagagatcagaagtggctattcccttctgggagaccaggagatgctggcttggggaggggatggtcacccctctggggtgggggcaggcgatagagacccagcaggcaggccccaggcagggggaagaggctgcccttatctggccccaggcagcctgctggggtctgtggccaggcaggacacccagtgctcaggaaccaaccagaaaccaactagaaactggcagtctgggtgctgagccaggggcccgcagccgcgccaggcagggagtgggcgccagctctctctggcagggctggccggcatatgggagcacccaggctggggccagatgcctcgggagggggatttggcaacactgagagccagcaattagttaattagctgatatgtcttaaaagtcagtgtggggaggggtgtggatggcagcctgccttcaggaaaaattccaaaccccagcagcccctccctccagacccaagagtgtgtgtgtgtgtgtgtgtgtgtgtgtgtgtgtgtgtgtgtgtggccctggcgcagcagacagcacgggcccagctaggcagcctctgatccctgcttgacataagtgcacatgaggcgtgcaacctgggccagcgcagaagggccctgagcccccgtttcatctgtgacatgggacaaattgccacacctttcagtccgcgctgaggattaaatgtcagcatagacgggagtgcagtggtcagaatctggaggcagacctggccctgtgccctctgctgtgtgaacttggacaggttacctacctctctgaacctcagctctcaagatagtaagaacagtgacctcccaggctgcttggggggttcatcgcaaccccattcatgagggaggtttagccaggtcagtggtcgggcaggcagcaggcctgggctcctcacgccgcagatacccactgatgacctgtgaggggcctggtgtccgtccaggttccaggacatccacaaaggggtggcgaaggctcctgctcaccttcaagtgtgaaatcgggtcattcacgaggaaacgggatctttgcagaaagctgtttggcgcgtgatctagaaccacaggttccgcgggggagcgggggcctgagtcggaagaggggctgcaggccgggaggcaaggaggagccattcccagggtgggagaagagggctccaagcagaggctggtgggggcgtttgctgtgttcccggaactgcggggggccgctgggacctggcaaatgatgggaagccatgggtgggttttgagcagggaccgctgtggtctgatcagattgaagggaatggcactggccagggaggaagcagggagcggagcagtgggctggggccagacgaggtggtcgcagtggacaagtgtgcacgtgtgtgtacgagtgtgtgcgtgcaagtgtgcatgtatgatctgaatcagtctcctgactgcagccgcccgccacacacacctgcctgtaagatagagaaggcgggtcagtgtggctgctgacttttggggatggggcctacggggcttgtggagtgattgggtggagggtgggcgttggggaagaagcccagctgcctcgtgcctgcatcactggcagcaactcagtgccctgcggggcacaacctgggtgccactgcccagtggcgggccccgggccatggggagggtgccctgcaggaagccctgtacccagtgctgtgatctgtggatgatgcacgtccaggccctgggcccagcatgcagggctgccccagtccagcacacaggcagctcccgagggtctgggccacctccactcagcaccagggatggtgtggaggctggtcctgggctagtcttggctccagaaagcttcaggggcctgaggtgacctgaggctgtgctaaaattcctaggccaacctgccccgcagggcagagctgaaggtcctgcctgtcctggatcccaggccgtggagacgcgcgggaagagaggctgtggtaggcagagttcaggtctggggacactgaccgcggtgtcaggtcacttctctgccggcctaggcaggaagggaacccagcaggcagagccagcatgggatggcggggctggacgtctcaggcacgatcaggcccacgggaaagtcggaggtcagggcgccagggcctctggttgggggcttcagaggcgttgcagtcgactcctggagcagaggtgagtaagcccctgccgccctccccctgctcacagcctgacctttgagacgttcacgctcagccacggaccccgagagccatgtaagggggtctgaagcctccacccccacccagcagagccaccctctggccccagactgagcccacccagtgggtttgcccccaggtccctgctgctgttgtgtgcccccatgtcttgaaggacacaaacagttgagtggggtgggtctacctgcaatgctccgctccctcccatctgttgagcccccaccccagcatctgtctgagtgaggagatcatccctgagcccccaagccctccctggaggccctgaagggacagcagtgcttggggggatgcaggaagcctccctctcccctctgctggtgtgcacatggcttggacatcctgcccctgcccctgggggaagcgtgtggagcctgctggtggcttttgggcgggaggagtgtgagctttcattgcccaagaatccaaagggcagagcatggagggaggcgtctcacagcgccagccctcacagagccctgtggccactaaggccagcgggggcccttgccctctgcctctgcctcaatgccagcggtccttgaggctggtttggctgcccctgctctggtcatgggggctgagggatggcagcctgtgctggggggcccatgctcacggcctccatgctgtctgctgacctacactggcagggcccaggcttcctgaggactttagacatcctctcttgtccctgtcatccatggagccaggcctgggtggggcacttgcctccaagagacgccctggagcctgctctgcaacgtgcccattctgtgtctggggaatgagaaacactgagaccagctgcctgcctgcacgcagcgaggccactgaacgccaaggccaggcctcctggggggcacctggggttcctctctcacctcttccccaagatggaccattgccaaggagctcaggtgctggggacacttcctgggggcgatgcaatgaggagagggccgtgtggctgggcctaggggacctccagctagcctgtccccgtctttctcttctgccctcgggtgggccagatctatgccctgagactcactttgccccaaagcacctgaaaccccatatgcctaagactctctgctgggggaggccccttttcttcccatcccagggagaaaccaggagccctggctggtgcgggtcatgtgtccactctgggatagcccactccggccacagggcaggatgccaaggcctgagccccaggaccgtggggcaggagtggaggcagaggcaggcagtcagggtggcgtgttggggtggctgtgtggggccgtgagcacacacaccacacgggctctccacatcacccgaggcatggtgggcatgcctccctgtgccagccctgctcctctataattccagggcacacggagtggcatgccagcatgtcctctgacccttcctgtgtgttcagaactggcttcactcactttgggcttcctggttcctaggagaaggtgcaggaggtaactttggcctctccaccctccccagcgccccttggcatttgaacgtgtacgacagagagagaaagagagagagagaggagccagctggcacggggtcacgtctctctgtcagagcgcagtgagcactgctggtcttataaaacctgcgatggtaattgaatccgggcaggagtccttgatgggggctgttaaacacaggagcagggctgggcttgggtttatgggctcccggttcccagctcctctccagaaaggccagggctgagcttctgccggggtctggacgcgatggagcagggggatggacgcgatgaccccctccccgagagcagccaggggactggcctaggagccacagtctgtgcatttccacccaggggctcaggaaggccccgggaactggctccctccgtgggcgggtggtcacccttccatctatgctcccgtggcctgggttccgccctgcagtggatgggggtcggtgctgtgcctgctgctaggctcctagaggaggagacggtgggacactgaccttgtggaacgccaggaagggagggagcccaggatgggcagctgaggcccctggggtggtcaggccagtgctgaggctgggggcagagaaactgctgcccgggagggcggagggggcgtgtgcagagcaggcgggagtgttccctgctagtccagagaggttgaccgttgtccccagggtggcctggcacacctgtggctgtgcccaggtaggaaggctactgtgccttctgggaaggctgctcctgaaaaggacacgtcaccaggcatctgcccttcgaggggcctgtgccttggaactgtggagctgtgacctccctgcagagctggtgggggtggaagcagcactggcacacctggctgggtgaggggagccggggtggtgaattatttagagtcgccaaaggtgttgagttagaagctaattaaacaagctctccgcagagcagcactgtaaaagaatcataaaattccaatctcatttgttctgctcggcttgcacaggcgtagcatccccataaaaggcagccagcgctgcacagtctgtgggcagcttgcaagtgtgcggccttcaggggtgctctgcagggcagtcctgcctggctggggctgggccaggctggagaaagcactgggcatgtgctggcagctgggaggctgcggccccccaggtagccccctggtaggggcggttctcactcagggtgaaagggggacctattgtggaaaggtgaggtggtttcgctagccagcaggtggcccagggcccctctgtggtgctgctgtcctcctgccttgggtcttggaatgaggccttctggtgcccaagctgcagtgggcaaagctgctgcacccttgagttgtcgtgggtgggggcgagaggctgggcttgcagaggaaggggaggggcttctccgtactgggctgagagaggactctggggtggcggtgtgggccggggccctgctggcctctgcggtgcacctgctgtgtgcagctctgcgccaggagcccagactgcaatgtgtgcaactcccacacatctgccatagcttgtccagcagagctcagcagggggtctgcctctctgacacctgagggaggggtgcaggcaggaggggagggggctggtgcttctaaagcccgcccactcaggcatggggaggtgccctagggctcagggtgaggtgggggctcagagctcaggcctgtgtgaggggctgcctaagcgccaggctttgctgcgagaggttcaggtgggtgtgtttaggcaaatccctttagcatcagggaacttgggctgcgtcctctgcagcagacgccgtattgcctcctggacctccctctactgtgcctccgtttcctcgtttccaccattgtcacggaggcagcatgactggtgactgcgagggtgcaaggtgctcactgcgtgctgggctccctctcggctggcagaggctccacatgcccggcaggttgcagtttgcagacagagctcacatggtttccgggacctgtgtgtccccgcagcgctccagggcgtccactcagttgaaggatgggatgggacagctggaggtaaaatgggcaccagggtcattcatgctacagccgggtctgtccttctgggtctctgaccttccagaaggacagctctgccctgtgggcccctcggcactcgcatgaagcctctggggcctggaccactcccgtcctattgagggaggatgcagggtggaaagtgctcctccagcaaggatgaaggaaaagccggtggccgtgatttgccattgtcactgtcacctggatgtcctgagaaccccctggggaccagccttggaaggcccagccttagccggagaggcagtgtctggccgtcctggtagatggcccagctcctaccctcatcggcagttgggtttcatgagcctgccatgcaccgtgcgtacagggcaggtctggtcacatctggagtttggagagcccagctgtgcccctcctgggtaggactgggggtcgcctaggcctctctagagctctggaggctgaggcagggccgtgagcagtggccagggtcctagtgcttatctgggatccacagtccagctttgagccccacacacagagcccaggagcccaggcttcatctgcaatgacaggcaacaggcggacaatgtgggcacccggagcgtgggtgtgcctgctgtgatttgttatcatctcagcacaaaacaggctgatttctccagcctgggtggcctgccgtgtggtatggggctaggggacgccatcatgcggcatgtcaggcctctttgtctcctggttggaagatgttgatggattctctattgcttgtttgatcaaattgtccagaacacaaagggggagattgcggcaaaagccacatttggaaaaacaattcctcatcctgacagcagtccctggagagagggctggtcccgctgggtccccagcacaaagaccacttggaaatctggctggcaggcgaaacctgtatttagggccagagtgggctccatggccaggagcaggacaaggagaggcagcccaccaaggaagatgccctgagaccctaccctgagattcaggatttgttgcaagtgtggcctgtcatatgggagttacctgcaagttcatgggcagaggaatgcagaataaagtggtgtgatctgccattcaggctcctgtagcaaaacaccccgagcagggggcttatacattgagattgacgtctcccaggtttggaggctggaggggcaaggccctggcagacgccttgtccgtgagggcaggctgcttttgttttccagttcacggatggccgtcttctggctgtgtcctcacatggaggacggggtgacggagctctccagggtgtctttgttaggtccttaatcccattcctgagggctccacctccatgacctaatcaactcccaaaggccctgcctcccagtagcatcacgttggacatgagaacttcaacatggaatttgggggtgactcaaacgtggagaccatagcaacgtctgccctgcaaatactacacagcagataaaaagatgagctaggtcctcagggaaagacaggcgatggccatagcatctggggcattctggccgcggtaagcatggattcaacatgctgctccttgactcaatagacattgggtcttgttggtggcacagttccaggtgggtcttcctggttgagggcccagggccttccagggctctgccaccctgttgggtctcactcctacccgaggagggtggagaatcctgacgggtggtggaaatggccacatggagctgtgaggggtggggagtgtggctgggtcatgtggacacacgcaaaggcagcctgggtgctgcaggcagtcggccctgtcctcaacagtgtgcataactgagtcactggggaagaaaagagaaaccccagagtgacatgtgccattcaatgccatctaaggaaacacacaaagcacagctgcgttcccccaaacacaaatgcatgaggtgcacagggaatgttctggaatgacacacaccagtgggagaagggctgtcaccctggggaggccacttggactgaggaaggggaacaggggatttcggtgtctataaagtttgaatttttattatacaaatttattcacaaatcatttgcataattaaaaaaccaaacttgaatacattttaagagggttggtgataagaggaatgaattcacaagtgtggtcttacggggggcattggtccagcagcctggccatctccagctctccccttcaagccacctcccaggcccccagggtgtcaggggccccaggccaggcaggtgaccggagctttccagttctgccagactgaaggggtgggcaagggggagcaggtgcctctcccatcccatggtcccagctctcaggcaccatcctccacggacagcccctgcgacacctctctgggtgtagtcccgcactgtggactgatgctggggcctggccaggtgcggaacatgggtgatggagccatattctcctctctcccaggattcaagtctgcaaaatagaggggagacccctaggagcttggggactgcggaggcccctaggcccaggtgagtcatgccaggctgcgctccagagggcagacaggaggtgatgtgggcctcagggctctgatggtagcagctgctggagaaagagtggcatcaaagtggaactgggagagggctggggccagctgcgatgcagggatgggtgaggtgctggctggctgggaaccccagcctgtgggggctttggcggtgaaggtgtcttccggtggaaatgtcttgggggaggtggcctggggcagctcagaggctggctgtgtcttcctggccctgtcatccttagcatggggcgtccagagttgttgccttgtggaccaagacagcccacagcccatggcagcttccagagccagaagaagaggagtcatctctgaagagccctggactacctccttgcggatctcattggccagaactttctggctctcatgctcaccacaaggccaatcactagcaagataaaaaaggagcaccccgaagggccgagaccagctgtgcctccgggcaggggaggggctgccccttccttacctgaactcaattcattttatttttattttttaacataaaaggcaatgggaattcagtgagtggacagctagccacctctgtggctgcctgccgtgtgagcacgggccatgttctatctttgatctcctctgtgaagcgggaataacagcaggggctaggttctgacccctcagacctcacccctgagctttccaagcctgcatccatttgctcttcatccctactctcaagactttcagcatcccatctgcagatgaggactcagaggccccaggttccgtagctgagctgaggggccagaggtccagcccagaggctgttggctccgtggaaccccgggagctcccggctcccagtagtgcatgaatgtgcatgcgtgcatgtgtgtgaatgtgtgcatgcacgtgcatgtgtgtgtgcatgcatgtgtgcatgtgtgtatgtgcatgtgtgtgcacgtatcacggacaaatacacattaaagtatgagtggcacggccgtcccccctccgtcattcactcacagccacatatgcatatgtgtgtgaatgtgtgcatcgtgcatgtgtgcatgtctgagtgtgtgcatgtctgtgaatgtgtgtgtgcacgcatatgagtgcatgtgtgcatatctgtgtgtgtgcatgtctgtgaatgtgtgcgcatgcatatatgagtgcatgtgtgcatatctgtgtgtgagtgtgtaactgtgtgcatgtctgtgaatgtgtgtacgcatgcatatatgagtgcgtgtgtgcatatctgtgtgtgtgtgcatgtctgtgaatgtgtacatgcatgtgagtgcatgtgtgcatatctgtgtgtgtgcatgcatatatgagtgcatgtgtgcatatctgtgtgtgtgtgcatgtctgtgaatgtgtgcgcatgcatatatgagtgcatgtgtgcatatctgtgtgtgtgggcacgcctgtgaatgtgcgtgtgcatgcatatatgagtgcgtgtgtgcatatctgtgcgtgagtgtgtgcatgtctgtgaatgtgtacatgcatgtgagtgcatgtgtgcatatgtgtgtgtgtgggcacgcctgtgaatgtgcgtgtgcatgcatatatgagtgtgtgtgcgcatatctgtgtgtgcgtgagtatgtgcatgtctgtgaatgtatacatgcatatgagtgcatgtgtgcatatctgtgtctgtgtgcatgtctgtgaatgtgtacatgcatgtgagtgcatgtgtgcatatctgtgtgtgtgtgcgcgcatgcctgtgaatgtgcgtgtgcatgcatatatgagagtgtgtgcatatctgtgtgtgcgtgagtgtgtgcatgtctgtgaatgtgtacatgcatgtgagtgcatgtgtgcatatctgtgagtgtgtgtgggcatgcctgtgaatgtgcgtgtgcatgcatatatgagtgcatgtgtgcatatctgtgtgcttgagtatgtgcatgtctgtgaatgtatacatgcatgtgagtgcatgtgtgcatatctgtgtgagtgtgtgtgggcatgcctgtgaatgtgcgtgtgcatgcatatatgagtgtgtgtgtgcatatgcatgcacatgtatgatgagcccagctaccaaggcacctgctaagcacagcacccgcaccctggaaaccctcccacatgccatcagtgagggtcatgagtcagcagatatgatgtgcctgacgtcagtgctcctaagagaagcctaaacaattttcataggaaatgcacctagggactgcattgtataaatgcaacactaatgacagaaaatttcaaaaatactgtgcacaaagaaaaatagtctcccctgttatcacatcccccatgtcacccaccgtaaacatgttgatgtcaaaggctttcgggttttgtctgtgcacgtgttcatgttattaggtcatttttttttctcacaggttgagactgtgctgcactgctgctttgtaaacctggaagatttttatcgtgaataaatacctgccgcaacaatgcctaatgcttttgtggggttctgttatttggatgtgccactggcggtgacggctggcccctgggtggccatgtaaggtgcttccaaatctctgcgatggagacgtcacctcagctgcctctccagccacgagtcctggcacctcccctgcctcctgcttcctgctgctgcttctcagcccccaggcacattcctgctgcagggcctttgcacatcccgggattctggggctgtgccctccccaggtcttctcacagtctgtctgtcactcccctggggcctctgctccattgtttctggtctgatgataccttccaagtcagtcctctggagtggcacattcgggccacatgacatgccggcctacactgtccccagggacggtggccacttgccctctcgctgcctctcctcccatgcccacctcccaaccctggccagtgtttgaaatctccagttctggattttttttcaccccccatggccagcttggtgagaaatgacttctcattgttggagtgtgtctggctacacgcgattgtgtgtttctgtgcctcttgtcatttgcccttgttttatgaattgccactttgacctttttgctcatttgtctatccagtgcctatctcttcccaatgattcctgtgttctcagtgtaggtggctggggatgagaacgggagcttgtcctcccccatgctgagtccagcattcaggatggagtgacatctggatggccatcagcatgcaccggggctggggcttctcgaggtcagcagggtttgagggttgtcagggctgtgtgccaccagggcttggcaggtccccaggtgtggcgtttgccatgctggtgtcccctgcgccacggcacctgttccctgtgaccttcccctgttcctgcttctcaggtgaaacgtggcctggaagcttctggttatgtggaagacaacagctatagaggcctccccgtgacctcagggaccaagggctgtggagaagggctcaccgggtgcagacaggggcaggtggcctgggggtcccgagccatgacatcggtcctctgtttagccggaagggtgcctgtcattggcaccagcaggcacaggaaggagggaccttgtgtgatggcaggtggaggggtctgcatgtgtctctccctgccatggcaacctgtctgcccccgtccaccctgccttcaagtgccagagggtcaggggacagcaagggccacggtggcagcaaggaccctgcagatgttgccctgcagtgccctggagatctgtagacctggggccccacctgcagaagccaggcctgtgtgtcaggtttcgggggctctgtggccggctccagtgccattactgaggctgataactgtgccccccttcaggggtccctggggcggccgcttactcctggctgtgcaaacaccccttctttcccgaaggccgccagcctcctctgtcttgctaatagcctgttcttttaatgatcgataatcagtgtttacccagagccttcaccagcagctcctgacgcttggcttcattatgcatgcaggctttgcggaagctgcttccagctgcctgtgtggcctgctgcaggggacgtccggctggaggtcccaccttcctcccgccttggcccagcaccctccaggcctcgctcctggcccctggggcggcttcaggacgctagggtggtgacagcatctcgagaccccgcctgggcagacctcctcctgtcagctcctcctctgtctaaagagccctgcttgctgggaggggcagcacctgcctcgctggacaatgtccaggacacaggaagcacccgatcaattacagccaataaaatgttcagtaatggccactagcatgtctgcaagccggctgtggtctgggtactgtactggacacctcatgcgtgtgtcagggacaaatatgtattaaagtgtgagtggcacaaccatccctccccacctctgcctccaccacctcattccccctccacctccgcccctccctgctccccccccgcccccccacctcccgccatcagtgggggctcttgctgctgttcggctctatggcctttgatagaacccggcgggtggtgggttttggagcagaagatgcccaagaaggaagagaaggaaaggcacacggtgtgggtgggggagggagggggctgcagtggcagcgggagaggtggggcagctgagagaggaaggtggaggggcgggcacttttggaggcagaggtcaccaagggccttcagctcctgcctggggccaggccctgcagggcctcccagcgcagccctcaccaagagtcactggaaatcaagacaggccccccccccaccttacttctgccaatttagagttagatctgtacttgtttctggaagcttcttatgtgagggactggctggaaggtacatgtctggatctcaccctcgcccagtgaccgttccaccttggccagaaggtgctgatgtcatgggccgagggcctgagcgagggcctgggagtgcccaccccaccctctgcagcctcctctttcccacagcctctctgtcctccagtatccagaggccctgagctggtcaccccattgtcactttgtgttactaaagccccgggccagccatgccaccagcgttttggctcccgcgtgttggggcggggcccggcagagctctcggggcggctgtttggagtgggcgcagggcacacaggcacgatgtctctggtcatctgttccaggtgtccacaacgttgatcagctttgagagatcacgtttctgcgtttctcagacctgccttggaaggggtcttgctggggccgggagaggggctctgctggggaggggggctctgctggggaggggggcaggggtgtgggaacgggggtgtcgacagctgggcacggagcagagtccctcagacgtgctccccgcttctccccgtgactcgccacctctttctgaaagtgggttttgttctccccagcatctgtggtttctgatggattcgaaaatatttaataaatatttggcttccattttcaaaatgttctgtgctctttttaggtttccttatggaaagagactgagatattcttatttcaactcccaggagcccatgggtgccttttacttcctcccactcttaccccagactgcctggtttgtcctggtttggaggtgaaggctctggcccggagctgcagaatcggttccccagggcttgcaggagtaggccaggggcctggagggccagggggctgcaggggccaggggactgcagggaccgggggctggagggacccgggggctggaggggccggggggctgcaggggccatctgctgccggccttttcccttgaaaacaagccagtgcttcatttcccttcttttagcagcaggtgagctggccgggggcctcagagcgctggcccaggtgtgagggtcacgcttctgcggggacgccagccaaggctcacccatccccagagatgtcctgtgaggccccagcgtgactcagagcccaaacgagattgtcttgggaggtgcagagttgggagatgcaggctgagatgaaccccgggggaggggcaaggccaggcagaggtgagtgcagagagcaacggagggagggggctgccaggaaggggccctgggcaggatggaggctgtccacagcagcagcctggttggtagctgggccctaccctcaggcctcctcctccaaggcaggacggagcagtggttaggatcaccccatcctcccaaagcaaaggcatcctctgttctgggagctgagagcaccagggagcttcctcctgctgcctggcccgggtgagtgtctgggaggggctggggcagcctggttggtcaccagagtgtggtcattgtcatctgcatcccggggtgagaaaggacaagagggctgccctctgcctccctcccgtgctccctgtcctgaggctggcggctgtgagagagaagattgtcgctcagcaaacactatttcctcatccactgtccccattgatggcaggcttggccaccgggctcgatttagccggaagtggccatgtgccagctcccagctgagggctctggtgaccctcctgtgaagagcctgccttggaggctgcagtcccaaggaggaggctagactcagccctcgtcctccaatgcagctgcaatgagcctgctcctcctgctggtggaaaatgcaggtaggcacgtaagccaccaaccctgggggctcagtcaaaatcctgaggacccccaaggggcagagccgatggggccttctgaccagggtgcccagaatggatggcactgggggacacaggctaattgcgggggaacaggtgaaggtgggtgaagcagctgcgtgtttggggcagagggagaggtattgtgagggttaattttatgtgtccacgcgactgcagacatttggtggactccgatttggggtgtgtccgtgcaggtgtttctggatgagattcaggctggaatccgtagactgagcacagcagatgtccctcccccatgcgggtgggcctcgctcaatcagatgaaggcatgacgaggaaactggttgccttgcagccgggagggcggctgctttcctgctttcagatttgagctggaacatcagctccacccaggtgtcgagtctgctggtgtccggcctgatttgccaccatcagctctcccagggctccagcttactgactcggtgcaggtctgcggactcagcctccatcattgtatgagctaattcactgcaataaatctctctttccacggcctgttgattctgagtctctggagaggagagtacagcagcagtgggtgacagacaccagggacctcattggcactaaggattgtccccgaccggaatgcggagtccgggctgaaggaggtgactccccacctccctgccctgccctgtggtggggatgggtggggggaaaatgcccagttcctgagctggactctgagtgacagtggccctggttagtgggggccctctgctgggcggtggccggagggagacagggtgccaggccgggagaaatgtttagagggcatcagtgccaacttcctgggcacggtgcaggtgtggagagagctgcccccagcctgagaggatgctgggttgggcttatctccactcggaatcgagagaactcaccgtccccagagccggactggctgccatgggaggccaccccacgagaagagaggaggagccgaggcctgttgctgagggttgcggaaggcaaggaggaggacacagaggggcccttcccaggcctctgttatcacggctcatttctggagtcccagagccgggcagagccaggctcagcacagcaaggatgacggcccaagtggaagcactggcagggagagctgggacagacgcagccccagacaggctggaccccagggacggtaaagggtgcacaccgcttgccccactcgtactctgcgcccagcagctccctggatggtggccgggcaggaggctgtcctgactgatcccgcaaatgtatttacagctattgacggcctgaacgtggcctattgatccacgcctgagcctggccgggcggcgcgtgcacttggccagggcagccctgcgtgacgaatgggcagctcacagcccaccctctccgacaggtgattgtttcagtgaaaatgagaaatgatgatcagggcttaaggctgatgattgaggaagatttccagcgactttgcaggtcgtctcggtggtgctaatagccagggcctcctacagagaggcatgttccccgactaggcaggtcaccatgaatgtctgcaaagacgctgtcctggcgtggggacccgggcaggggcacaggaggcacagacgttcctgcccctttccctggctgggttgcgctgctgaggtgggccaggtggggttcactctttctggcttctaagggggttccagaccccagatgggcctggggaaatgagggctttgtgtggacagccccatgggagaggggctgttcccagccctggtgcccgcctgcctagtcctccctgggactctgggcccagccttatcattcctctcttctcttctaagatgaaaagaggattcctgcaagtggagacgaatcctcgggcccctgagctgcaggtggtgaacaaggagctgagggcctgctggttccccaggagggcaggcagggctgtgctaacgaggagaaagaaccgagtgaaggaaggcacggaggtgccagggagagaccaggaacctcctcagcttcctggcttccttcctggcccaggccccctattcccggggccctaggctgggctgaggtcccctcgccctgtgcagggcctggggctcaagttctaccagctgtagcctggggcctgaaggtccatctgatatttgaaggactcagaaggccctgggagggtgttggcaggagtagcctcagtgttgattcctcgatggcccctgagccaggttcaggagcacagagagacgtgggtgccacctctcccgagcttggagctcactcttgggggttgagatggggccaggaaggggttaaagcaggaagcatcttgcagggctgttaggaaaatgatattctgctgtttgacgtcattttaattccatttcaagggcatttaatcttatttgcccgatgactaatccccggccttgagtgaattaatgtgcggccccttctctgaggggaagcgggaccctttcagtggagacatcgcgtcaccgcgtcccgcctcttgcttggcttggcgggcagggctcctggccagaggcgggggcagccactgggtgggggctgtggtgaggacctgacccctgggtgaggaagaacgactcggcatctccttagccctggaactttccagaagcgtgcctgcctgcagtttctcctttgtgcctatgggcagaaaatgcccatttcccaggcccaggacaaaagctccagaactggatgcttcgaggcaggtgcagggacccaggtggcagggcggggagcagcgagagccagctgctgcatgtccagggctggtccacccaggccacccagcaggggcctcagccagggccgcaggggccgtgacaggtgctggcatgcaggaaggagtcaccagacttgtccacccagttggagagggccaaagagaaactggaaactgaggcacagccgggcaggggcttgctagatgcatttttcagaagggcttgatcttgtccctggactttctctgtgatcccaccttgactttcagcctcacggggctgggaccccctcccctacccccacccctgctttgccttcagtggccacaggagaagaggacccatctgccgggtgggcaagctgaactgtcacagcccccacgcagtcccacgtcccctcttgctcaggccacagacatgcacaggagatgccaggtcctgtctgccttgaagagtccaaggaaaaactttctcgttgtaatttcgggccttggggagcctctaggaggaggagagggggccagggaggctctggtggatgtgagtggagtctcgccatgtggacagccctatgatgggtgaatattccagtcctcacagtgggtgaggctgagtggtggctcctggggaccagagatggtcctggcttagctcttcggcagcagcctctgacctgcctgtgctcagtgggctccctcctgccaccccacagggctgggtgaagcttctgcttggaacatcctgcccccggcctgacccttgtggggtgatgggtccttccctgaatccaggctccccagactttaggggcccggaggcctgggatgggggagcaggcagggccgcagccccaggaggcgagatgccctggctaccttcctccacctgcccctgcatctgctttcacctctgctggtgcctctgagctttgaggaacttctgctgagtgctttaaccacccacggcctggacctggttgagcttttgggtcttctgggagcgagcatgtcctgtgagtaccccagggtgtgatttgcacgcaagaggtctgtgtggaccacggggggctgcaggggctgcaacctgggcagcctgggcttgtgggaactgcagcagctcccgggccttcccaggtggtctggcagggactggaggcataggaggggctcaagatgctcgttccaccagaatgagcctcctaacacctggacaaccaggtggcacagaggtcaacctggtgactgaaggacagtgtggcctgcaagttggagatgttggaacatctgggttaatcagaatggccctacaagcacagccattgtagctggcattggggttgaccccagcatccactgtgccccagtgttgccctgagtctgtcaccatggcacctacttccttgccatgggcttggggtggcaaggtgtgaaccagccaggcaggcttgcccaccctctgtgggctgcatgggagcaaggaaggtcatacttcatggtggttggcagccaccgtctgctcagagcggcccctacctgacacagaaggcagtactgagagcggtacttcatctgtccatccaccaatccatccatccaatcttacacccacctacccatgcttccatctacccacccatctgtatacccatttatctatccatttacccatctgcccacctacccatccatccatccatccatccatccatccatccatccatccatccaaccatccatctacctttccatccatccatgcatccatccatccatccacccacccacccatccatccatccatccatccatccatccaaccatccatctacctttccatccatccatccatccatccatccatccatccatccatccatccatccatccattccatccacccatccatctacctaaatatccatccatccatccatccatccatccatccaaccatccatcttccatccatccatccatccatccaaccatccatctacctttccatccatccatccatccatccatccatccatccatccatccaaccatccatccatccatccatccatccatccatccatccatccatccatccaaccatccatctacctttccatccatccatccatccatccatccatccatccaaccacccacccatccatccatccatccatccatccatccatccatccatctacccatctacctttccatccatccatccatccatccatccatccatccatccacccacccattccatccacccacccacccattccatccatccaacatttactttgatcccgctgcattcctgtactcagactgagtgacagttctctgtacatagcgtccagggtggtcacagagggaagttctggggtggggatggggcaggctgtggcaactcagaggaagcccctggccctagccaggtaacaataaaacaatattttttttcaaaaaaagccacctatgaaatgtgttattaaacccaatttaatacaaatgttttgaaagtccttgcatatgaaatttgaagactaaacgattatcctttgccagatccctagtttggttctggaaagtagagtctgtgcagctcgaggaatttcttaaaaatttccttagaagttctgacaactggaactgggtccccagaggcagctagaaacagggtgggtgaggattctacagtgataataattttaataaaaaatgctgtgactttatttgggtaccataggcatggagatctgttttgccaaacagtgaagcaaaaagtctgagcgtgctgagctgctctgtttgctttcagctgtgtggcactggcaggcaatgtgatctctctgaaccccggctttctcctgggcaaacggggatgctggttccagcctgcgggtggctggactcaacaggcattgcttgcatcctactgtggggccactccacaggcaggtgttgcaggagagggactgagacgcatcaccccaggtggccgtgggcggagagcgctaccctcgcgtggcctggtctgtcccagctcctggctggccccggtggaggagggcagggtgggttctctgcttcggcagggagctggctctgctgttattgggttatctcatttgcaaacaataaatgtcatgagcaggagacccttgtcagcctccccttccaggatgcaaatgtagcctttatccgcctctgccctttattaaaacaaccacggagccagcggacaaacaagacaattagctgtgaatgatgtcatctccttctactttctgtaatgaggcccaggccctggcaagggtggtggcggaagctgggagaagccaaatctgattaaagtgcgatcaagaggcaatgctgacctttcgctttcagccactgacccagcgcctgagagctggtgcgacagttgggacaacggtgcgatgtcacagcgattacctttaaccaggggatatagactgtcccccgtgaggaggcaccagtggacgtcagtccccagacccgtggggtgcgctaggcaggggccgggtggtggccgagctttgacacatctcctggggagggcacccactgatgccactgcatggtgccactgccaccatgactattagtactacaatggccgccactgctgtgtcaccaataccaccaccactgctaccattactaccaccaccaccatgactactactactaccatgaagaccgccactgctctgtgaccacggccaccaccaccaccaccaccaccaccaccaccaccgccaccaccaccaccaccaccaccaccaccaccaccaccaccaccaccaccaccactgctactattttttttttttttttttttgagacggagtatcactgtgttgccaggctggagtgcagtggcgttatctcggcccactgcaacctccatctcccgggttcaagtgactctcctgcctcagcctgttgagtaactgggattacgggtgcgcaccaccacgccgggctaatttttgtatttttagtagagacggggtttcaccgtgttggccaggctggtctcgaactcctgaccttgtgatccacccgcctcaacctcccaaagcgctgggattacaggcgtgagccaccgctactattactatcaccgccaccatgactactactgctgctgtgatgagcgcccctgctctcctaggaccaccaccgccaccaccaccaccaccaccccggctataactaccactatcactgctgccactgctactgctatcactaccattactatggtcaccaccacctgtattaataccactactactatcactcctgccactattaccaccggtagtgctgttactgctaccactgtcaccagcacgtccaccacccctcctactcccactggcaatattatcactaccaccactgctattactatcaccctcctgcacccccactgctactgttaccgctgctgctggtagcggtggacacactaaccacgtggacgacctgccaggacctcctaagcacacggtactccagctgcctcatttcctggactcacgacggtgctgtgatgagctggtggccacatctccatttcacacaggggaagctgcaccagggccctcaggggatccgccccaggccgcatgggcggggaaggggagctgagccggagccactccacctggtgccgggcctgtgccctttccagggcaaccgatgtctcagagtcctggccccagagcagagagcctctgcaccctggaaggtcctgcttgctggagtgaggggcctgcgaggaccggccctgttctcaagcccagccgtggacctgcgtgggctgcctggcgggcctcattctctctgcagtgggagaaatgtgcagtcaaccctgagcgaacgtctaaacctccaaacacaccacgactttcaaagcctcattttctatcccgagcagcctcgctctgtgagacgggcccagctgctgtgtccgtggccacctgcctggactggggttggctgctgccgacacacatgtgctctgtgtgagtgcgcatgtgtgtaccacggttgtgtggacaggagggtgggcacggaccctcggggtgggttctgtttcccggggagagacaacacccaggctctgtgggatgctgagtggagcgggaggcaggcagtgtgtgttcactgggacagaattcttccctccccacatccctttcttcctgagactcacccagattgagcgctgacgctctgcagccctgggtggccccagcagcacccccagcccagcgtcagccttggggagagtcatggttaacagcacaaactgtgaacccaaaggattcgaatcccagctctgcctcccatgagctgtgtgaccttgggcagctgacttaaactttctgagcttctgtttgctcatctgtaaaatggggcaaacggcaggatctccctcatgaggttggtgtgagggtgatacgcactaagcgtagctagcacccagcaaatgtttatgttattgttacattatcacagaaaaatgcaccagaatttaaacaacgctgacaataaatatgcagtcgatgatgacttcccagagctccagaagcaactccagcacacggagaggcgctgatgtgcctgtcaggtgctgctactgaggaagccgttgctggtctccggaagctcttgtatccccaggagtgccgtctgcctggcctccccattcctgcagtcccggttgtcatctatgtgggccaggccatgagccctccaggcaggctgtgcttcaacccatcccctgcaccaacagcagcctgctcatctccaagctcagctcagcccaagagcagaaagggagtgtgctggaagcaggttcaggaagatgagcgttcatgggccgtctgcatgccctgggctggggagctctcagtgggagccacgtggggtcgaggattgggggaggctatgcaggcccaggggcctcgggctttcgagctcaggctctggaatagccttcttcatgcacccccacacagggactgacactgatttgcaagaatgccatttcgaaatttcacatcacacttccaccatggccccagacagcaagcccggcccagccccagacaggcaggcaatgggcatctgctcatcatccagcaccctggagagagcaggaatgagtgccgtggtccaagtgcgttcactggactctaagaggggagtgggagacctttctggagacccttccctggtgtatcagtttgccagggctgccataacaaagaccgtaaactaagtagcttaaaacaacagaaatggtgttctcccacaggtgtgggaatccaaagcccaccttcgaggtatggacggggttggtttcacataggaattttggggggacagtttggcccagaacccctggagaggaagcctagaacccacagagggttagccctgaaggcaggtagagtagtgccaggtgggtgacccatcccttaggggtgcccctctggatcctgctgggccctgggaggagatggccccaagtggagctggtggcaactggccgtcccctgccagggttcccctgctggagaccgtggtggctgagtcatcgcaggtcctcaggccggtctgggtggacgtggagggtgctcaggatgtgtggctggatgcaccaaagaatgaacgagcgccctgcgggaaacacggggaggtgagccggagacccctgctctgcaagctgcccgggtctggccagcgggcactagtgtgggagttcagctggcaacccccgacagccttctgagcacggcccccttaccaggtgccgccgcttcccagcctccagccccaccccacctcggggatcctgcccaaggtctgctctgcccggaagtgaaggagaagcccgttctcttccccctcgggctggggaagagctcacagcccaggtcacgccacagaaatcccctcctcatctggccctctgactccacctttccacgctgtccgtgggaccaggggctgagccgtcagcggccgtggaccttgccttgatcccacactgggccccgagccactttctgcacatgatctctcccaaccgcatcatcatcatcttcttcccaagtccccagtgcagccctgggggcctgtcctgtgagacccctgaagagagagaccccggcagggacactctcactgtgacaatgttgaatttacctgaaggttaagaaaccctctattctggtgttccggaaaacagctgatggcagcggggagcccccttgcccgtaagatgctggaaaacactcccagatgctcctcatttccagggccaggcccgacacatgccctcgagttcttgtgtggcctcacgagtgactggctgctcaactggaaggaaaggcgtgttactcagcctcggttcagctcctcactcccctcgagccccgaaccttggctgccctcactcgagccagcagatgccttcctgagaacaggcgcaccagggccaaccacgcttggctctgacgtctctgtcctgcagactgtccccgcttccccacgccacctcctcccagctctgtggacgcctctttctaaaagagaagccctttccccttaccctggagaagcctgcagccctttggtgaggcgggggcattctcccactggattgcccttccaatccagtgtcacctgtggcgacagcccgcctcccccttgcagtaaccctcttgaataaacgcctctccttaccagtctgcctctgtcctttctttgataatgcagaggagacagaggaggccaggtgcagtccgactcaggggtggctgcaaggttggcagggacttcggtgacccctgtattagggttctccaaaaatgccaacagagcctgtgtgtgtgtgcatgcatgtgtatgcatatgtgtgtatgcatgtgtgtacgcatgtgtgtgcacacgtgtgtgtgtgtgtgtggatgtgtgtttattataagggattggctcatgtggttatggaggctgggaagtcactggatgtgccgttgccaagttggagacccaggagcgccaatgctgtgagttccagtcccatccaaagggggaagacagatgtcccagctcagcagtcagcagagtcagttctccctcgcttcaccttcttgtcctgtgcaggcctccgacctactagacagggccgcccacatggggagcacccctgctggactcagttcactgactccagtgttgatctcctccggaagcagcctcacacatacccagagtcatgtttgaccaaatgtctgggcaccttgtgtcccagtcacattgacacatgtaatgacccatcacaacccctgagagcaccggctttgtgaactgggctgctgcggatggggcggggtgggaggtgtcccagggctctggaaacctgtgtttcagggtcacatgggtgctgaggtcaccatgccactccctggccctggtggctgtgtcagccctgaccccggacttgacttgggcctcagcccttgtgttggagacgccaagtggcagcccctcgcctgctcaccttcactcttaggggcaggatgcttcggccaaagcctctgccttgacggcatcgccttgatgtgagcacacgtggctcggagaagctcagggtctcgctgcacttgggcctggccgcaggtgtgtgtgtggctgccctgtgtgcagggtgtgcatgcacagcactctgacttcccgtgcgctcccagctccccagcactctgctctgctgcatccttggggccacagcgagatgtgagatctgcagccaggatctgggagtgaccatgtgacaagaaaacctcggccccttccttcccctggggaagcccgggggcctttgcctgctcaggtctgctgggcccttgtggccacagtgagtggtcatttccacagcaggttttgtgaccgtgtcggcactgcccgatgcatgggcagagccaccagctgtcgggcagacgggcagctgaaccctggttttgaccctgggagatgggggccttcatcagctgtttgccggtagctgccctgagacttgctcctgaaacagaagagggcctggagcctgtgcagatggcctggggaggctggtgcgagggtgggcggcggggagggcagagcaggcaggggcgccggtgtgctgggatctctgaaagcaccagctccagtatttcttttgtcaaaggcaggcatgtggtttggtccctagaataaaatcccccctttagtcgccagaggcttggattttcatgcctgcactgggggtgaggctccgaggctgattcttgactcctggagttttcagcccctctgggggctcctgggagggatgaggctgcttctgccatgaggcctggacccctgcagagttggaggtgtggcccagagcggggtgggctcggtgactttcgacccttgctgtgaggtgagctcaggagggaacttcaggactgggggcataggagggagcgagaggtgagtggccagggcgggtcgcgagcacagcggggccctgggagtccaggggcatgactacaacctgggctggagcccggagggcacgtgaggggcttcacctgggagccggctggtcagaggttgagctggtggtgcgttcctgcagggccctggcagctggggcagtgagccacaaaggtgccatggctggtgaggggagcacatgcagccaggcgcaagaagcagggagcgcctgatgggatggcgaggcatgggctacaggggcctgtcctggccctggggggtgcaggggtgctggagtcatcagcttccctctgtaccacatttcagtcctcccaggaagcagaagtgatggttctcggggctccagggtgtggtggcggtgacggccccacaggctgctgtctgtgggttttcctctccttgcttggagccaccttttcccctgctgactttagctcatggtcccttcagtctgggaagatttatgggcctccttctgggtgccggggacgtgggccagatcaggtggtcttgccagagggctggcggtgggaatgggagtgatcctgacatgcaaacaggagtaccaggcagggccagagccgtagggtctgggattcagccagcctgggggcctctcctgggagctgccctgttggggttccaggggtatgaatgcccctggtgggtggccctcagtttgcttgtctttgaaatgggccgtgaccaggctccccagggtgcctgcccagtgccaggatggggtgtgaggttgggattgcagctgccaccacaagccaggcagtaggacaaacatggtctcagagggtacgcctgggcacaggtgacccggacaccatgtggggcagccgaagggggcaagaggctggggctggaatcccaccaaaggtgcctggcagcctgggcaggagagggccggggagggggctgccctctgccccagtgaccctgcattgggcagtccctgggccctgacctcagcaccgcccctggcccggcacctcgtttttccacttggacccctccctggcttcctggccatgccatcgcctcatccagcccttccctgggctatcagggctgggcctgtttatgcagctggggccagaggaaccagctccaatgccgagacaacgcaggcacagccattagtcatgggtggaaatcagaagttagacgaaccaaggtccgaacgtcagggatggcgttcgggagcgcaggtgtggggccgggccaggccgcaggctccttggtgggagccccagacttgggcccatgggcctccatcagcccagccacaccatcacctgcactgagccgagctctcccccggggctcggatccgctgggtgctgataggcccctgtccttggctcagggcaactctggggaagtctggaatcctttgaatggtgcagattgctgtgactcacggctgtggggccatgagggactggcggccgcccagcctgcaacctcgttttgaaacctcagggtagacccctgtgcagccccaggccaccctggtcactgccctcaactgggtcctcatgcccgagcatgctgtcctgggccatgaccctgcccacgggctcttcctgcccctagcccagggactcagagtcacacagtggatgggaccccacagtcatgtaggccacattctgattgtgtggtggcccacacgcctccagaaatggggcttgctgtttgccagaggccagagggcacaaagaggtctcggattaggcccctatatcccaaagaaggatggctctatatcccaaagaaggacggctctatatcccaaagaaggatggctctatatcccaaagaaggatggctctagatcccaaagaaggacggctctatatcccaaagaaggatggctctatatcccaaagaaggacggctctatatcccaaagaaggacggctctatatcccaaagaaggatggctctatatcccaaagaagcgtagctctatatcccaaagaaggacggctctatatcccaaagaaggatggctctagatcccaaagaaggatggctctagatcccaaagaaggacggctctatatcccaaagaaggacggctctagatcccaaagaaggatggctctatatcccaaagaaggacggctctatatcccaaagaaggacggctctatatcccaaagaaggacggctctatatcccaaagaagtcccccttggctgcccacccaagggaaatggaaagttgattggcagcatctgccaagtcctggggagggtaccctatcccggagccctgtgggccggcagctggtgctggtgccctgcagctgaccaggcccaggcttgggctgctggcatccctcctgagggcacctgcgtaatgatagcacgattagacccataccctgcagggacaattcagagaggcagaaactgtcattgctaattggtaattccataaattagacagtaaagacagatgttgtgagtattggaaaaacgctgtcaaataattgggttattctcataagaggagaggcgatttgctacctgtcaaacagcatttcacccctgcctgttgcctgcctagctggatagaggctggctggggaggggccccaggacccagggccccttagaattctccagggccccaacatcagggggcagggagccctactgccagctgggagaggcctaggcttccccattccccataggccccttccttactgtctttcccagggtggacctcctctctgccccccaggctcacatgagcagcccccttgcccggaagctctctgtcttcctgtgcaccttctagtcctgggagaccctactgatggcatacctccagcaggaagccttcccggccccatgcagatgcggggcctatagcctcaactgcagctttgggggaagcttcagggcatggggggtcttgttacttctttccctcagcatgagccctacctgcccagtgctcctggaggtgaggaatcacatctgcacaatgccgtgggctccatcccacctcccacaggcctgccctgatgccaactgggagatgaagtcacaggtgagagggctcgttctggggcttcagctcctcctgcaaggctgcagactcagtgtgcacgagacacatcttgcctggagcagacagcctcgggacagggagctcatgccttacctggagagtctggccttcagctcgatgctctgcctgctgagaagcttgcttgccccactggggcctcccttgttagagccttccctagcatgggggagtgaagggccctgtagagaaggctggacgtgggcttcacgtgggacctggacaggggctgccttgcctccctgtgtcgagttgagctgcttctccatcctgggccccaggccccagggagctgcaccctggccacttggcagattctgggacagcctcaggcagtccagagtttggacaaggagagggctgctctggggtaggcagtggccaggcattgctctctgctgcacccctccaactctatgcacagttggcaggaagctgggtctctgggcctgacagccctgagtgatctgtgggagagacagtgtggagagatggacagggctgcaaacatatctgaagagaagcaggaagagacctggggtgaccccaggtggagctgcctctgccctcccctgattgcctgctctggcccatcttctccaggtaacaaatggccctgaagcccacctctggcatgcttgcagccccttggcagtgctgggatgtaggctgggtagggaatcctttatagaagcccagagcaacagatgaacttggggagggctcccctatggaagcgactttgggactgagtcagggcagggaagagcactgcaggcagggacacggcaagtgcaaaagccttggggtggcagggagtgccaggagcatgcagggctatggcagggtggcagggagtgccaggagcatgcagggctatggcagggtggcagggagtgctaggagcatgcaggagtgtggtgggtggggtggttgaagggagagggacagtgtggcagtgatagggggccccaggggtggatggagcagttcatttggaaacaatacagtccattgatcaaaaagaatctcaaaggaaattttaaaattacccaaaacagtataaaaaacaagcgaactacaaactaataacccctcatgaatacagacataaaatccttaccaaaatattagcaaacagaagtcagtagtatataaaaagaatatacactatgactcagtgggtttattccagggatgcaaggctggtttaatatttgaaatcagtcaatatcattcatcatgttaacaagctaaagaagaaaaaaaaaatcacatgatagtgtcaatctatgaagaaaaatcatttaacaaaatccagcactcattcatgataaattatcagcaaactgggaatagaggatgatacggtttgaatatagtttgtcccctccaaaactcatgttgaaatttgattgctattatgatggtgttggggagtaggacctaatgggaagtgtttgggtcatggggatggatccctaatgaatagattaatgccatctaaccacagtgcattctccttctctcaggactgggttagtgattgtgacagtgagttgctataaagtgagatttctctttgtgtttgcttttgcattgcacatgcctgcttgccttcccgcttcaccatgtctcgatatagcacaaggcccccaccagaagctgaacaggggctgatgctgtgctcttggactttccagccaccagaatcgtgagccaaataaacctcttttctttataaattacccagcctcttaggttctgttataacaacactaagtagactaagacagaggtgaagttcctcgtttgctaaagaacatctacaaaaaccctacagctaactttatatacttaaaattataactaactatgtaattaatactgaatttctttccccaagattggaacaagtatatatatatatacttaaaattataactaactatgtaattaatactgaatttcttttcccaagattggaacaagtcaaagatgtgtaatttcaccattcttattcaacatagtgctggaagttctagctcttgcaataagacaatgaaagcaaataaaagacatagtatatatatctgaaaggaaggaatatgactatccctacttgcggaggttgtctacatagaaaatctgaaggaattgacaaaatattcctagaactaatcaggaattcagcaaagtttcagtgtacaagataaacatacaaaactcaattgtatttctatatcctagcaatgaacatgcagatgctgaaattaaaaatagaataccatttacaactactcaaaaaatgaaatagttataaattcaacaaaacatgtacaggacttgtgctgaacagtatacaacattgatgaaagaaatcaaagatataaataagtagagagaatgactatgttcatggattagaagacaacatagtaaagaggccaattctccccaaattgatatgtgggtttaatgctattcctataaaaatcccagcaagcttattttgtagacacaaacaagataattataaaatttacacgaaaacaagaaagacttagaatagctgaaacaattttgaaaaagaataaaaaaaaatcctgccatccaatttcaagactttttagatagctatattagtctagatggtggtatttggtcaattggctgagggatggacccacaaaccaatggactagaacgagagaactcaggagtggagctacacaatagtacccaaatgatttttgacaaagtgagatctcacaaagtgcaaaagtaatttaatggaggacaaatagccttttagcaaatgttacttgagcagaaagagagcctcagtctaaacatatcacacgttatacaaaaattaactcaaattggacaaatagtttaagtgtaacaggtgaatccaagaaacttttagaaaaaagcataggagaaaacctttgggaactaggggtaggcaaagagttcatagacttgacaccaaaaacatggtccttaaaggaagcattgataaattggacttcatcaaaattaaaaattgtcactctatgatagaatctgttaagaggatgaacaagctacagaataagagaaaatatctgaaaccacatacctgacaaaggattagtatctagtatatacaaagtactctcaaaactcaacagtaaacaaaccttaacaacccaattagaaaatgtgcaagacccctgcagagacatttcattgaagagagaagatagatggcaaataaacagatgaaaagatgtttgacgtcattagctacggaggaaatgcaaattaaaacacaaggagatgtcactacacacctgtcagaatgactaacttttacaaagaatgaaaacaccaaatgctggtgaggatgtggagaagctggatgggaatgtaacacagtattgccactctagaaagacagtttggcaatttctttaaaaactcaattaccctatgatgcagttgttatattcctggtcttgtattccagagatatgaagacatgttcacataaaacatgtacattactgattagagcagctttattcaccatagccctaaactgaagtcaacccagatgtccttcgatgggtaaatgattagacaaaccatggtgcctccacaccatggagcaccactcagccaggaaaaggagcgagctagtgacacgtccagccacctgggtgaatctctagagaattatgctgagtgaaaaatgccagtccccaaagcttacatactgtatgtatggtttcatgtatataacgttcttgaaatggcaaatttatagaaagggaagaagagactggtggttagcagaaattaaggagtgggtgcagggggtgagaggaaaagtgggtgtagctacaaaagagcaccctgagggtccctgaggggtgggtgctctgtgtcctggttgcatccatcaacaccctggtggggataccgtgctagagttttgctggaggtttccactgggggggacggaatgaaggacacatgggatctgtttgtgttatttcttgtagctgcttggggatcaacaataatctctgaataaaaagtgtaataagtaaagcaataaaaacaacgaataaaggcatatgtatcaccaatttaacctgcttgggacgtggcccctccctgttctcactctctaggtcttcttctcggctggatgttgggtttgggggagggcaggggtatgggagggaggggctgctctcagagcatatggaactgcaggctcttctcattgaaggagacgcatttccatgtcaaggttaggaaacttctgaggacgcatcagaggaacctgaggcctctgaggctgggggagtccccttctctcaccacgttccccggggcaaggcccagcttcgacctcaaggtcccccgtgccaggtcaggccctggatgggcctctgggcatgtcctggctccatctgcctccatcccagcctggatgcgtgtgtggagatcccagcctggatgcgtgtgtggagtggacgacaggcctcccaactgctgagcaaactgcacgagccacacacctttctcagcatcgtgcttgctgcctgtctcagcacagacttgagggggggcctttgctgagaccctggatgaaaccctgcagccaaaggacaagcccggaacaggcctgcaggtgccacttccagaacgccttactgctccttgtccaaggagtggctgcaactccaccttttccctggaacaggccaccggggcatgtgggtgaagcctgagggtcactgcaccaggcaccctgccttggggtcagctggacctgtggcctcggaggactcgcttcctggctcctgctctcttctgtggcctgttgggctcactgctgcaggcccagcgtggactctcacccagagtcagcgcccggtgcctgggggcccctagggtggaggaactcagtcagtccccaggtggtctgagccgcccattggatgcccagccctgcacagtggccctgccccgccctgcccagccctgcctctggggtctccacctgcctcggaacagcccggtcattctcatccccagtgtttcaattgaaatgtcctaccaagggcttaaattaaaaaccaaacactcaaagcaccagtgccttttagatgactaaaataaaaacctaattgaattttcctagggaaaaatatctcgtgtaaatttagctaagggagtgaaagagtggctctttaaaaatagatatatatggtttttaattcagagttatttgcaaagcaaattaaagaaattaaaaaaaaacctgctctgccaatggggagactggatccagacaaagaggagcttgcgaggcttggcgagcacggggcggagccaggggccgaccccacagtcctgcccctgccagcctggctctggggcagctggccctggaccgggctcctcctgcagggccggtgcttccatccccggcgtgagtgcccatgtcctatgttcgtgtgctcttgtttttcaggctttgagctggatctatggggtctgggctcagctaccggctcctcaccatggaagccaagatgctgagaccccaaagccaacgaggcagagccgccacctctcagcccctccccaatctcgccctcactgcacccctgcccacctgaggacaaacctggcctcatgtcttttctttgctgacccttcttctatttggggaagggatttaataaaacaaaacaaaacaaaacaaaactgaagctctctgctgagaaccagactaaactgaaatctcattcctgcatgggaccctcccatccactgcccctgctcccaaaggagcagagcaggcctggcttcaaccaccaacaccctgcctttgcctccacagcaccatgcccatggcaggggccacctttaagacatgggacgaactcccccaccccaaatttggcccaaatgttgaggcttctgacaccacacacaccccatgggggagtgaagggcttgtcactcatatggtggggctttctggggacagcaaggcagctcccaaggtctggaaatagcttgggagagcaagagggccctggctttggggtttatgtggccgagtggggagtggggccgggtgggggggtccccaggctggcccaagctggggcatttggagttttccagggtgccaaggaaggagcccccaggacataaaacgtgagcccaactttatggcctgtgaccttccagcctggctgagcacctgcctggcctcaagggtgcttctgccaaccctgtgtgcgatgcccagcaggcggggctgcgatctccttggcccttgccatgggcagccctggcccatcttctgggactcagaatttcccactgggccctctatctgcctccagggccagtcccagcctggctgtcacaggccaggaggccctgccccatgcaaggaactcaccaaggacactgcccttccgtctgtggcactgctgcttttgcctgccggagggcaggtggggagcggctgtccgtgcctcctctccaggaagaaaggcactgcagcccgtcacaggtgcttccaggttggcggaggggcagggcttgggctgcagggccactgcaggtgagacctgacaggtgcaggcgggcgccgtgagggaagcgtgtgcaggggcccagcctgggcgcctcccctccagggacacccatttccacccttcctttggaggcttcctcttggctggaaattcagagttcactcccacaggcaaaggttgaatcgctgatgctgcgccaggcgaacgccatgcaccgcggccccgtcagggacacattttaattaagtgaggacaagagaggtgccctgccgttcctggggggaccctggactgccaccagcatctcatgacacacctgtcaaatcatcacggtcctggcaagaagttcgggagggctgggggcagggggctgggagaagaagggttgcccctggagtcagcccggcctttcctcagcttccagaaggaggtgtgtcttgggaggatgtgggcagagcagaggcagggaggcccgggtgcaggcagatggtgaatggcccttggggcagccatgagatgtgtggggcttcaggaccccaaaggcctatctgctctgcatctttgaggacacccaccctcagtcagcctgcagcctctccatggggacttgccctgcttccctcccgccatcctgcagctggggcccctgccctgcagcccccaccccagagagtgccccacacataggccacagagcttcagcccccggctagccggggaagctcagcctctgggtaacagtcttgtgtgcctgcatcctggagccagggatggccttttgggacccagcctatttatgccagggttactccaggaaactcaagccttgtcctcttctgagcctctcggactaggggctcatggagctgttgctcagtgagggcatttggggctttcccctgcagcatggacaggcctggttttgacggacaggagcatctccaggttcccccgagccacacactgctagggagcaccctctgctgcatgggattgacttctggggcttggccggaggagctgtgtatccttggcacgcgcctgttcgtgaggaggcagcgttttcttcctgtgagttctgctccctgggaagacagcggttcatggcaggcaggctgggtggactgcagccgttgctctggcctactgtggacccgacaggtactaacgcgctccgtgcacgctctgcttcacccgaaaatggggttgtgggcaggggcagagtgacgtgagtggacgtgtgtgtgtctgtgcccagcacgacgccagcgtgtgctctggagatgaatgctaacaggcacaaaacaattgataaggtaaaatcagtttcttaataaacactgccttgtccaaggtatggacactaacgtgagaggtgaaggctgaactgcagggatttcaggggtttgcacatgaatccctgtttttcaggctccccaagacattgagcatatggggagccctttgcagagcacctgagtgaagtgagtcccctgactttactggggagtcacagctgtcacccatcatggctcagccttcggtctcctccacggcacacctgtgagcagccgggcccagccctccttgtcctgagtggcctggcccgagctgtggccagtgctgctggggcagccccactagacctggggacagaagaggactgggaagggcccgtgtgcagctgcctacattgggggctcgaggaacaccccccatcccaggcctcctcctcactggggtccttacttggcacttggcaccctcttgggcatttggggtgggagttccaggttcctggcctctctcatgcccagacctggaagttacggaaccaagggagtatcggcgagcgggtttccacgctgcagcccaccccggcggccgcccatctgtccctctgcaccctgacttcattttcctgccgcaaggagaagcctggtgcctcctctgcggtatgtgactggctggagagtgaagaggctggagagattataaacagaccatgggtccaccagagtggcccgagagcttgcccagaaccggccccacatcatctctgtttccgcccaggcctgcccacacccagcctcagctggggtgatgagcttcctcccgtctcgaggggcctctgcccgccccttggaggacgtgccccagctgcggcggcacatgcgtgggcttctgtgtgagaggcatccctgttaagtcggaggggtggagaaactgaggcccagggaggcccggggcagaggagctgggctgcggcccctgccccctctcctgcccctcctctcggccctgtccaagactgcgcttcttcatcttcaaataaacccatgagcctccctgtgcagggacccgtcacccaggccggcctcagggcgcctccccactgtccctcctggcctcctggcccctgtggccaccagcatgggcacgacccctcaccccaccagcacacggggctccaagctcgcccgtcctggccctgctggctctggctgctgtgagttctccttggccaaaggaacgtcctaggccctgggctgtgccagcgccaagagtggggctgacaccaagccagctccccactagcagctccagggaagtcaagagatggaggatcagaaagccagccagcgccttcctcccccagagccctctgctgccccgtggggcctctcccagtaccatgggagctgaggccctttccctccccatggtgacaggagggccacaggctgctggggctgtggtggccacctggagagggcttttgctcctggggctccctccgtctgtgtcccaggctggccattaggagggtctggtcatctgtggcacatgccagccagcaaagggcactggggcaatagtgcccccctggtgtgggcacagaactgggcacccactgtggtctcagccagggcaggaaggggactggagtcacagggtggggagagggtaacaggcctgactctaacagagcctcctccctcgttcatcctccctcctccctcccgcgccgtctttccctccccagtgtctctggcctcgtctctaaggagcgggctgcactgagatgggccccgttctgtgtgttctgtgggcagaagagccggtgtgcctgagggtgcgggcctccttggtgccccagcctgtacatgggagccacccgcatggtccctgtagcgtcctttggtgacaggcaggccaagtcaagaggtcccagggtgtattcctggggctgaaagggaacaggggcgagggactccttgcccccagcctccggctctgcctctggcttctgtggggagctcagggtgcacagttggctcccagcagccctagcagtctcgatgcctcttgataagacttctatccatgcgggccgcagggcggagtgtgggagcctgcagaacccaggctggcctgggaagccctgagcctggtgtgaagccctggagaacctggctttcccactgctctcctgtggaatctgccaggcaccatttattccccgtgctcaggggcagctctgtccacacctgccggccacgcttctgcagattctcccagcagcccctgcgtgtgtccgggatgcaccagcccctcggcctggcctgagcagtgtggagaggctcctcctggcccagccccctagggtgagggcagcctcagccccttccccaggcagcccaggaggacagaaacctgaaggtgaaggatctctgcagagtggggcctgggcatcaggggcgaagagaaagtagcttagggacctggaagagagaccctgatccccagacacacaccctccacccctccccctcgctcccccacaagacagactctgggggtctttagaattcatcaggtccccacaagttgaagtgaaggatggaagaatgggttttaaattagtgaaacctttttacaggggatggctgtcaaggataatttttaattgcaaataaaaaactataagaaaaaaagtctgtcagaaggaggccagccctggaaagggcattctgacggcacctgctccagcagaagaagggcaaagtcacccaggcctgagcaccagcgccttctctgcacccacccacccacagccccttcccctcatcaccacccacggccccttcccctcatcaccacccacggccccttcccctcatcaccacccacagcccgtttcccttattgatggccccatcccctcacccacactgccctcctccgggctggccgagtctggcctcaggcccccaagggtacctggagctggccctgtcacgcccagggctgcgtcctaaggagcagagtgcccagaacatgggagtttcggtcttattggcccgagagctgctgtggccggggagccgcccacacccagctggagaggaggagaggagtcccaacggcgggactctcggcagaggctggggaagggggtgcctccagaactggcctgggctccgccagggaggtggccttattttcctcgcccgtctgagcagggtcaggagggtctcggggcaggcccggggggtggtgaacaggaacaccctccagtgccgggggtttctggtccccgggctcagtgcgccggggggcgggttatggctcagggagtattttttttcagagcctgccacagagacaataacacctcttaagacatggtaattaaaatcctctctgcacacagcaataaatccatgcagcacaactttcttgtaaaaatgaccttgcgagatgatgttttccagccgcatgttttatcaatatcacacttcccacagcctgacagcgcacggggtgcccccccccatcttcctgccgggctgcccggcccagatgctcactccttcctccagtccccctgcgcctctccatggcccctggacgcttggacaccgcccgtgctggacgctgcccacctttcctgccccctcctgagtctgggtatggggctccagtccccaccccaccactgacctgccccggaactttcctggctgtctgcagggccagaaggctccccagaaggagtctgggggtccccaccgctggtcttatcccatcttgggggacagttaggaagcaaaggtgtgcgctcatctccgccatcatcatgacgtaacagccaccatctaatgttccatgaaagggcaggagtgtgctgttggttttgaccaatgccatggtgacggtggcgcctctcctgtgggcaggctctgcgctagctcctagatcctaacagcctgcttggcaagaccacgagtatccccatttcacagatggggaaaccgaggcttggggtccaagtcggatgtgagccgggcccagagatcagggctggggcccaccaggcacgagctgtctgggagggcgagtggcctcggggatggaacacgttgcacagcactgggggcgggggcggctggaggcatccagcatgaggaaggaaaggtgggaccccttcctgcaggatggcatgggcgtccctgtgcccagagccctaggcctgtgctcctgcctgtctctgctcctgacttctggtagggacccaggaaggatctgaggagggtggagaaggggctgagaagaagccccgtgagcatccaggcatggccgcccctcctgcactgccaaagcctgtccccccatctcttcctccagtcttataataaaatgcagcttattagccaggtgcggtggctcatgcctataatcccaacacttcgggaggccgaggcgagcagatcacttgaggtcaggagttcgagaccagcctggccaacatgctgaaaccttgtctctgctaaaaacacaaaaattagccaggcgtggtgtcaggcgcctgtaatcccagctactcaggaggctgaggcaggagaatcgcttgaagtggggaggcagaggttgcagtgagccgagatcatgccgctgcactccagcctggtgacagtgcaagactccgtcttaaaaacaacaaacaaacaaacaccacagtttatttagctaaaattcatgtaccatacaattgacccatttaaagtgaacaattcaatgactatgtgctcacggatgcgtgcaccatcacatttgagatcgtttccatcacctcccaaaatcccctctccattagcagtcactcccatctccccacatactcccagcccctgcagaccctctgtctctgtggatttgcctgttctaggcatttatttaaatggcaccttcgtggcgtggcccaatgtgtctggtgctttcagtgagcacagcgtcctcaaggttctcacattgcagcacgtgccagcacctcattcctttttatagacaaaccacatcccatcatctggatggaccgcatttgtttatccatccaccccttgatggacacggctgtttccgctctgtggctgtgtgaatggccctgctgtgaatgctcgcatgcgtgtgctgtggggacgcatgtctgcctttcctccaggacagcaccaaggcggggagtcaccaggtcgcgcggttccactccagcctttgtcagctcccctcatgcagagctctcccttctgggctcatccatgccggcggtgcctagagcttcgaggctggcccctttggcacagcagagccttttgtgaagtctctgaagcagactctgaaagcctccgacgcccttgctggtggctcagcggctgaagggctgtctgagagcgacgtgttcatgcagcatcacctcccccatgttcccttagcgtgctcttccttgagaacatgcgcagggccttttaagtggtttaggaaagcacggtggtttaatgtattacaggaatataattgtatttttattgctcattacattctgagttaattacatagcaaccaggtttgtactttgtaatatccaacgaaataagcgtatgcactcttgattcagagtaggcgtcttctagcccacacaccttggggttagtcggctatggctcagtttgtcccacaaacagtatcagaactatcattggttactgggcacccaagagggtgcaccgtcctggggcccagcctttgctttagggtccaccttccacatcattccagaaggttccacctctttggggtcaggtgctgcctcacccctcctgcccatgggccggccctcaccttggctcagactccgccctctgagacgtgccgtggggtctttccaggatgaggaccgctagtgctgacatctcagtggagacatgcctgctgagaaatagactcgatctggcctcacgttggggaggcagatggagagtcggttggggcggggaggacaggttcaggctgagggatgggatccccccagccctgaagcactgaatgccagaggccctgacagtggcccctgcgtgggcaaggttccatttagttctggggactcctggagatgaaggtgctgcagccgctgacagacagctacctgctcctgggtccagagagcatccctgaggcttgtgtgccttctgtggtgcagggctgccttccggaagcctcttcttctgagagatgggatgacagagaacacaccagtaatttatcctaaggcaatcattggaaaaatacacaaaaatatatttccgaggctgttgcttctcttgcttattcgatgtgaatagtcactactgggatgagtgtcaatatgcattagtgggagtgtggatacgcatgaatgtgtttgaacatgcatgagtgggagtgaatatgcattacagtgagtgtgaatgtgaacatgcatgagggtgagtgtgaatatgtgcgactgtgtgagagtgaatatgcatgactgtgggcatgagtgtgcatgtgcattactgtgagtttgtgattatgcctgagtgtgagtgtggatatgcaggattgtgagcgtggatatgcaggagtgtgagtgtggatatgcaggagtgtgtgattatgcatgagtgtgtgattatgcatgaatgtgagtgttgatatgcaggagtgtgagtgtggatatacaggtgtgtgaatgtagttatgcacaagtgtgagtgtggataggcatgagtgtgagtgtggatgggatgagtgtgtgattatgcaggagtgtgagtgtggatatgcatgagcatgagtgtgattatgcatgagcgtgagcatggatatggaggagtgtgggtgtgattatgcatgagtgtgagtgtggataggcaggagtgtgagtgtggatggcatgagtgtgagtgtggatatgcaagtgtgagtgtggatatgcatgagtgggagtgtggataggcatgagtgtgagtgtggataggcatgagtgtgagtgtggatctgcatgagtgtgagtgtggataggcatgagtgtgagtgtggatatgcaggagtgtgagtgtggataggcatgagtgtgagtgtgattctgcatgagtgtgtgtggatatgcatgagtgtgagtgtggataggcatgagtgtgagtgtggatatgcaggagtgtgagtgtggataggcaggagcatgaatgtggataggcatgagtgtgtggatatgcatgagtgtgagtgtggataggcatgagtgtgagtgtgattctgcatgagtgtgagtgtggatatgcatgagtgggagtgtggataggcaggagtgtgagtgtggatggcatgagtgtgagtgtggatatgcaagtgtgagtgtggatatgcatgagtgggagtgtggataggcatgagtgtgagtgtggataggcatgagtgtgagtgtgattctgcatgagtgtgagtgtggatatgcatgagtgggagtgtggataggcatgagtgtgagtgtggataggcatgagtgtgagtgtgattctgcatgagtgtgagtgtggatctgcatgagtgtgagtgtggataggcatgagtgtgagtgtggataggcatgagtgtgagtgtggatatgcaggagtgtgagtgtggataggcatgagtgtgagtgtgattctgcatgagtgtgtgtggatatgcatgagtgtgagtgtggataggcgtgagtgtgagtgtggatatgcaggagtgtgagtgtggataggcagcagcatgaatgtggataggcatgagtgtgtgtgtggatatgcatgagtgtgagtgtggataggcatgagtgtgagtgtgattctgcatgagtgtgagtgtggatttgcaggagtgtgagtgtggataggcaggagcatgaatgtggataggcatgagtgtgagtgtgattctgcatgagtgtgagtgtggataggcatgagtgtgagtgtcattctgcatgagtgtgagtgtggataggcatgagcgtgagtgtgattatgcgtgcgtatgagtgtgattatgcatgggtgagtgtaaatatgcaggtttcagtgcgaatacacattgtcagtgtgagtgtgattattcatgagtgtgtgactatgcctgcgtatgagtgaatgcatgtgtcagtgtgaatatgcattacggttagtgtgagtgtgattattcatgggtgtgagtgtgtgcatgcacacccccaaaggaacatgcatggaggggaacaccaaatgttccactggggcctggtgtgtatggaggaatctcaagggtccttcctggaatctttgtcgttcctgggcctccgagttgctctaggtagagacgtgtttttcagtgacccaacacagcctccagcgccctgctcctctggaagaggaaggcgtccacacccgggcagcctctccagcctggcctcacccaatatgtacctgggctgctttgaaccctcagaatttcttcaaggggttctcccattggcacctgcttgtccatccttttttgtgggtggagcttcaggaacaagctttgctctgtttccctggggtccctctggggtccaggtctcagtggcccagtgagtctccaccacccctgctgacaccagggagcccctggcctgtactggctccctgccccctgccctgccttctggaacgtgttgcctcactcagcacctgtgtcctgtctcacaacagattttttaaaattgtgttttctaaatgttttaatagggagctttaaaaaagacacagaagcaatgtaatgagagagtgtggtatctggatgctcacatgcccatcccccagcttcaataatgagcaccaccaggcccccactgggttattttaaagcaaattattccatatttaaactttggtcttgggacccagaagagttcctgcatagatgtggccgattcatggcgcctgtcttcttatggctctgagtggctccaaacctctttgctggtctggctatgtatgtgttgaagaaatcagtgtctttgcctgtggaacttcctgccctctgcacggtcgtttgcgtccatgcggagagcctcatggtgcccttcaccctgcacttctgcccagcagtgccacgaatctgtgcttagccctgaggctgggctaagcagccgcacacacctgctgtgtcactgcacacacccttgggatggggctgccggctggggccactagcctggctaagcagccacacacacctgctgtgtcactgcacacgccactgggatggggctgccagctggggccactagcctggctaagcagccacacacacctgctgtgtcactgcacacgccactgggatggggctgccggctggggccactagcctggctccacctttataaggtttctcatgggcttctcaccgtggtgtgagcagccaccaggggtgacgctagtcaccattctaacccgctgcagctacctcctggccttcttccattagggacattttccttgccaatgatttgatgactttgacagacagttcacacagaaaaggcagccaacacctgatcctcacccatgtagctctgtccacagggatgagatggtgccgtggtccttccaaaggggccgtgagttttttcttcagtgttttgtccttatggtatcatttaatttggtttcagttcattgcagtcatacatgagatgtataaaggtataaattgtattcatttcctggggctgtgtaacaaagtgccacagaccaaatgacagctgtgtcttgtcccacagctctggaggctggaagcccgaggtccaggtgtcggcagggctggctccttcgtaggctgcgggggaggctctgctgtggcctgtctctgcggcttgcgatggtccttcctcaccatgtctctgctcacagttatccccctgtgcgtagttgggccgcaatcacttcctaagaggacatcagtcagatgggattagggcccaccctgaagatttcattttaactttattgtgtctttaaaaattttctccaaactatggtcacattctgaggtactggggatgaggacttcaacatatgactctgggagacacagtttggcccctaacgtagacgtggacttttgcgatgtgaatatcgtgccatcctcctctggagggaggcatcctggttgcctccagactctctcgctcaacctggtcatcctgagggctgtttattttcctgtatgacaagatgttcgagattcatcttgcacatttcctgctccaggtctcacagtggccatttctctaggcagccctgtttcctttagtggaaaatggcatttcatggtcacagtcgggagctaaggggattgcggctgctaggcaagtcattccttctaaacctttcctgtggccaaagctgagaaatgcatttattttttgggtttttttggcaagagaaaaatacatcatgaattcatactaatatttcccatttaaatgtaagattacagtgtttgtgcagcttctttgattttttaatttctatctctctcctcttatgctgaaaatcttggttcctaatgacatctgcgtgatgacttacctgctttctctcactgcacatgatctgtgcgactgtattggaacgtgggggagccaatttggccatgagatttttgctctgtccctgtcaagagggagagtctgttttcccatgttgtgcatccggactgatcttatttgctttgttctggaaggtgcagcagacatgatgtggtgtgaccttgaaggcaagccctcaagagatcttacagttcctgttttccactctccaggatcctgagaccgccaggctatgaagaaggctgtgatgaaaagctcttttatccagagtgggcccagcttttccagctgctccagctgggcctggtgcctgggccttcacctggctgcaggcaggtgggaagcccctgtgaggacagcaagggagccggtgtcgacccccatcattgtgagacgtataaagcattgttacttgatgccaccatgtttcagcatgtctgtggtgtagcaaatagaaaagtgattcagacattggtaccaccagtggactggtgccttgacaagcacctgagacatgtgacgttggctttgggcccaagggtgggtaatggctgggatggggaaaagggacctttggaggctggagaaacagtgacctttgtcacttaggaataagtggccaaactgtcacctatggtaacttggaaggtaaaagatataccttatgaacgtgtaggatccggtggaaggtcttgcctctggacagaatgtcaaaagtgcccatcagctccatctcacacatgtgataagatacagaaagaaaggtgagctgggccaggtgcagtggctcacgcctgtaatcccagcactttgggaggccgaggtgggcggatcacgaggtcaagagatcgagaccattctggccaatatggtgaagctcgtctctacgaaaaatacaaaaattagctggatgtggtggcacacgcctgtagttccagctacttgggaggctgaggcaagagaatcgcttgaacctggttggagattgtaatgagccgagattgctccactgccactgcactccagcctggtgacagagcaagactcagtctcaaaaaaagaaagaaagaaagaaagaaagaaagaaagaaagaaagaaagaaagaaagaaagacaaaggtgagctggagaagggatcattcaatctgcaatcggaacttaaagacaaaaggcccaggactagcttgtgtggaaaataaaactgtcactcatcccctttctctccaactagtaaaaatatgcaaagtgaaatgaagccagggccaaagatcaaattaaggatgtatctgtaagatcctttgttaaggcttttgaaagacttatggcagtacctaataggccctctcagccacacaaaagggattttaagaatccaggattgttccataacagccatacatggcccaagacagggaaagatctgtctcaaaaaataattatgcatgtggcttttgagatatggtgtaaacttcaattagattcataagaaatccacaaagttttaaagagagttgtattggtaaaaacactgtcagcttagaccacagaagacggtttaaaatgaaaagaagcttctgggaagaaaaaggttgagaaattactcagctacaaatgtgggtcacttcttaaggaaaagaaaataaaactcagagggtgtagccaagaacaaaggagaacaataaattagaaaaccactcccaaggaggagagctggacctaatcaaggaacattctttgcccttggagtagaggacactggctgtgtttcataattgccaggattggtgactgcatgtgcctcctgttcctcccctttttgaaggggagtgcgtataggagttttcctgtccctgactcatcagtgtacaggcacctgtcagagatagtgtgaatctggttccagatcatctcagtaaagcaaatagctaaaaaagagtcacacaattttttttatttttgcatttaaaagttatgtttatactatactgcagtctgttaagtgtgcaacagcattatgtctacaaagcagtgtagataccttaattaagaatttttttaattgctaaaaatgctaacaattttctgagccttcagtgaattataatctttttgctgatggagggtcttgcctcaatgttggcggttgctgtctgatcagggtgttggttgctgaagtctggagcggctgtggcaatttcttaaaataagacaataaagtttgccacattgatcgtttgactcttttcatgaaagatttctctgtagcatgtgatgccgtttgatagcatcttacccacagtagaactttcaaaattggaatccatcttctcaaaccctgtcactgtttcgtcgactaagtttctgatcctatttgaaatcctctgctgtcatttcaacaatgttcacagcatcctcaccaggaatagattccatctcaagaaatcactttctttattcatctataaaaagcaactcctcatcccttcaagttttctcatgagattgcagcaattcagtcacatcctcaggcttcacttctaattatagttctctttctatttctaccacatcttcatttccttcctccgctgaagccctgaacccctcaaagtcatccatgatggttggagccaacttcttctaagctcctgtcaatgttgatatatcttcaatcacaaatgttcttcatggcatctagaaggattaatcttttccagaagattttacttttcccagatccatttgaagaatcactatctatggcagctacagtcttacaaaatgtatttcttaaataatgagacttgaaagttgaaatgcctcctgatgcatgggctaccgagaggatgttgtattaccaggcatgagaacaatgttcatctctttgtacatctccatcagagctcttgggtacacagtcaatgagcagtcatattttgaaaagaatcttttatttctgagcagtagttctcaatagtgggcttaaaatattcaataaactatgctataaacagatatgttgttatcctgaatgtgttgttaaactttgggatttttgacagtggggtaggtggcacatggaaccttggtgtggttttaatttgcatttctcttattatgggggaagatgagcttctttttacatcttctagggccatttgcatttctgtttctgtgaactgtgtgttcctatctccagcacagcaggtgtttaaacccaaaggtgatgtgacaacaagaaacccccttcccaacccctaaccccaggcagactgctctcccaggctggggcctcttggaccttaaggaatgaggacagagcatcctgaagatggggagtcctcgtcccccaggtaagctcaggtgccctttccagtgtgccaagtgtgttgcctgtgtcctgccctggggttcaggagcctcctcttagaggagagaagcctgcaggggcctggcctgcccaaggctgcatgttcagcagcggtgcagcagtgcagtggtgcagcagtgcagtggtgcagcagtgcagtggcgcagccgtgcagtggcgcagccgtgcagtggcgcagcagtgctcctgctggcagagcctggtattggcggagcctcacgtcatgtgagccttggagccgtggttagtgttgtctgatgactgtgaaagctggaccctggaggtagcaagagttgggcctgtgagcccccaggagacacaaggcagccgtgcagcacagagagaacatcccggaggaggcctctccttgggaaccttgacacgcaggctcttctcctgtcacgccaccctccacttgcccatacctgcgtggtcggacggcagggacaccagccccccacgcctcagcctctgctgctgctgagtctctgtaacccctgatggccccttcaggaaaggccccttgttctccttgatcagatgtgagcgtgagacccgggctccagacatgctgtctgcatgaaccctgagaatgcttgggatggagctgcctgcctcctgggagcaaagtcacagcctgagctggaccgtcccagtcttcccagagggaccaagatttccttttcctcccttggctgtttggggagcccaggcttgagaaggcaaggcttgtccagcaggagcaggaaggcatggtcgtggggctagaacctgccacccaacccatgctctggtgaacgacagagtggtgaggggaggtggtagttaaggtctggccagaggagtccgtggaccagcctgctggccacgaggccttgctcagaccgaacccagagctgggtgcactgaccctcccagtccagggactgctccagctggcagcccctgaactaaggcagagccagtccccgggggccctgtggaggactccacatcctgggcagctcagccccgaggaagagggagagagtcagacccagttcttcctcccagcgtcatcctccctggggtcccagaagctcaggctcacaagggaccatgagcccagggcttgccagctgcctttcccagcaccaggaaacatccacagcaggaggaagtgtctacatgcccacgtgggggtcaggagaccgagctccctccagctgcaggctcgcccatgcgtccgggtgtccctgtcaccacctcagctctgcccagctggcctttcaaatgcagcagagactgtttccccggccagcccaggagaccccaccaaagcttcttctcagggttcctgggcacgaagggctgggacaggcttgtggtgggggtggctgcctcttatggggagggggttgcgttcaggccaggctgaagaggcaccaagaaagaagaggggggtgtaagctgagccagcaccacctccacaccctccacacccctacctccagcacgccctccacaccccctccatgctccccagggcgatgccttcaccaccctctccccaggctccagcttccccacagggctggtctctggaagcaaagacagattcggagccccgtgctgctccccagggaaggatttcacacttgtccctggaaaggcctgttgatgatggtgtgaccactggaaactgtccctaaatagctgtccgggaaatgctgctggtcgtgatgatccgtcagtcacatactttctatgtgttaggggaaataccttaaaatcttttttaaattgtcatttatttagacatttttaaaagaaaatctaagggaaaagtgctttgtttaaaatgcagggaggccatttgtttccagttataggcacattattataccactgacaaggagagaagtagcttagcattttccctccgcttctttaagaactattggggacttttggctttaaaacgggatcacttaggtcgaggcattctttgaagccaaaccgcttagaaaccagtattttgtgccaagggaagaaatctcacggaacagcaaagcacttaaatgttccactttaagaatctgaaggcacagatcgttcacatcggttccgattttacgttccatgaacgtcaaatggataaagcctccttgttgcagctgtaccaaaccagggctaacgactggttggatttcacgcttctttcaaaagctcctgtggttacaccatccttcacgtggcctttaatatccccacgtgccgcggctgcattggaacccagcgccacgctccccagtctctcgtgggttccgggcagtgagtggcagccggagggcccagggcaggtgctgcctgtcaggacctcagcctgtatgtgccgggggatgttcgtgcccaacagaggccacttgtctctgggccggggaggcaccgggtggccgtgcctgtcagggcctccttagacagtgccctctcgggccagccggcggctgcccaggtcgggaacagatatgtcgccggcgacaccattatctcccgggcgaacggcgacgtctccgcagccaggcagagcccaggctgccgtgtaattggaccattcagaagtaaattatctgcagctggaaacaagacactgccttttaactcgggcattataaggtcaagactcgagacatcgctgggaaaagcagttattgaaaagcgatgggaaaatgaaatttaaaattcaaagccaccatgggcggcgagcgtggcgggaggcgtgcgtcaccggcggccccaggagccgggtcaggaggtgtatttgcatctttattttgctgacgctggagagcactgcgtgaagtgactctaatatcaatctgatgaaaaaataaatcctggaacaaaagctgcaagacactcgtggagcccgggcactgtagaaggggcctcgcaacagaccccggcagggtggtgggacgtaggccctgggctctgggcaccaggccggcctctgccccacttcctggcattgggatggctgttccagggagggtgactcggtctcccccatttcatccctcctctcggcctggggcagtctcctcccagttccgcccacagccctccgcacacacccctgcacctgctatcctgtggcccctcctgccacaggagtttgccctcacccccacccctgtcaggtggctccctcggccctcggcaccctccctgccctcagcctgagccgagcctctgtgacctcatcccgctgtgtcgtgtgcaccattgtgggcccttctgggcagtcaacaagtgtgatgtgctcacctgggccccgctatgtggagtgcttacctagggcccgggtaccacacccagtctcaggctcttgcccacaactcatactccttttctccacatccttttctcttcttgtgcctggcatagagcctagcccaaaccaggacgcacaggagcaggagtggccctcagaaatggccgtgcccactccctgtccctgcagcccagtggagactggggagtggggaggcccagtggggaggcccagtggggaggcccagcctgtggggacaggcagccacaagcagacacagcctgaaggagaaagcatcccagcccctccctcttctctcaaccccgcaccaaactgccctccctccccagcccagcccagcccccaggtctcttctgctgccagctcacagtggtcacatgccttgggcctggtggaccatgtggaggaacggaggatgggtattcgcaggtggaggaagcgggtccctgcgaagtggagagctttgtctggggtcacacagcgacttagtctgggggtcctgagaccagagcccagcctagtgctgggtctttggcagcttccattcccagacgccagggtgggggagatgttccctcacacgtctgccagcatcctgtcgatggcctgagactgtctgcccactgtcttctgcgggaccctgggccctgggccctggaagaaagggatccgtttggagaggagcagagagcaccagccacatggagcccaaggcacactgtgtgcaatgccaagcaagccacgcaccgtctgtgggactcggtttcttgttctgataaacaggggacatgtgtgctcctcacagggcttctgtgaagattaaccagtgagcacagagcacccagccaagggggcaagtaatgggctggaagcttctgtatttgttttcagaggattttctgctgcctctcactcctatatctaattagaattaggttctgctggatagaatagaaagctccccaataatcatgacttcaacatgatagaagtgtatttgtctgtgtgtttgtctgtgtgtttctgaagctggaagggggcaggtccagggctgctgttgtgaacttggcatcaggagccgtggctgcttctgtcctgttgctccaccatgcatggcctttattcctgaggtttcctttccatcgccagatcttagtcacatggcagaccgcactgcaaacagggctgggcaatgtagcctttattcctggaagacacctgcccagtgaaaattgtgtgttctattactgaagaaggggaccgcagatattgggggcaactggtaatctatgcatgacctacagtcacatgcctgagaaaaaaaatatttttaagacctggaatgaataaggatattttcagctaaaagtgggaagaatttgttaacaataatccctactttaggaagagggaaaatgatctaggaggatgttctaaagcaaaagaaagaatagcaagcaaagaaaggtgagacatgtgggtacacttcagtaaacattgacaatatgaagccatggtggtaatgtctgactaaaaagaacaaggtagaaataaaatgcttgataataattacatatagataggaggtcagtgttgggagtgaaagtattctcagatcctgtatggttggagaggagagtaagaggattacagtattaactattgcattttgcttattttcttgctaatcattttaattttattaacattttatatggcatatataagagtataaaatgtatgtatatggtttaaagaagaaaaagaagattaataatcatgtaaactcctctgtagccaccacttggataaaatcctcccggagcctcaacagcccacggaatgctcctccctaatcatactctcttcttcaatccccagtgttcccgggtaatgcgaacttgaatttgtgttcatctttcccttgttttccttgatcgtttttgccatttatatctgtgatcctaaataacatattgtcttgtttgagctgcttttagaccttatgtaaatagaaccttcttcatatataacgtttgtgtcttggtctttcattcaatactatatgcatgaggactatccatttgaatgtttatggtgcagttcattagtctttattgctgttgggtactccgttgtgtgaatatgtcacaatttgttgatcagttctatcgctgatggacatttatgttgtctgcaggctttttacaatcacagtgctgctataaacatcctggtatacatctccaggtgcgtgtgcatgagcctttctctgggtgagcctgctggaatgctgtgattggggtgcaggcatgtttaagcaatggggccccactctgtctgagcagccagcagggctggagcagcttggaccctggactttctgtctggccttgcagcctggagcagcctcgcccatttactccattgtgtcatataagtactgctgttttctgccaggagttggaaaaggtttggggtcctctagagatggcacccggtgaggagttgctggctttttagttatgtgcaagtcacctctactaggtgtgagaaactgttttccaaagtaagtgtagctctgacagctgtggctgagacatcctattgcccactcatcctttccagtacctagaattgatctgcttcttaatttgtgcaaatttggttgtagtaaaatgatatcatattattttattttgacttaatagataaatacaatttaaatccagtccaatcctatctaatccaattgtctattattgagcatgtatatagctgaaacaacaaaactcacacagtactaaatggtatgttcactgatcttctcttccctgatcctgccagtgtcacctctagaattaaccatgattgacttaaaatttttttgttctggcatttacacatctgcatttttctaaatattgtgtatatattgctgcctttttattaattcatttagaatataatttttaaaatttcctgttacagtgatgagaatttagcccttgcattctgctagctcctgtgctctcctttcttctcttccagtatagttatactacaatttttgcttaagtaaagtttgtacctttacattgtctatataacattcatagctcagcctaacattatagtatactccaattatgtttccttttttactttctgtgtttcctaaagttattcattgccttgctttttgatttgcttactttttttttttctaacctattactaattcttcccacatcttcaaatgtcctttttgtgcacttttccacatcacatattcctgtaaaccctctgcctgaagatctttttctcctctcatctgggctggctgcacacttcgtcccgggacttgcctctgctgatgcttttctcccaggtgggggtccctgtttcctggatctcattcatgtcttcctttcttggtttgctcccttgtttggcatgaaccattttgtgggtaaatgatgtgaaaagatggttcatcagccctgacaaccttcaatattctggtgtcctgaaaaatctgctctgatctagactggttgccctgtatgcctggatcttccctcaccaccatactggatagtcctttcacttttctcctattttctagagaaaactagcaaccactaatcttttttcaatctctataattttgtcattttgagaatgttgtataaatgaagttgtaaagcatgtgaccttttgagattgtcccccctcccagcacaattcccttgagagccatctgagttactgcatgcatcaacagtgctccttcttattgctaatactccatagcatagatgtacagcaatttgttcaaccatgcacctattacaggaaattttggttgtttctaggttttggctattacaaataaagctgctatgaacaacagtgtacagattttgcatgtgaatataaatttttattttttagggtaaacgaccaagagtgtaattgctgggtcatagggtaagagtacgtttggtttcataagaaattgccagactgttttccaggtggttgtactaccttaaattctcaccagcaatgtatgagtgatctccagtttctccacatcctccccagcatttggtattatcactattcattttaggtgttcaactggtatgtagtggtatctcatcatggtctgaatttgcacttctctaatggctaaggatgttgctccttaagtgttgtgctctggcatcttgttagcctcatcctagtcctggctctgccactcccccttcatcgtcagtcctagagacacctgctgctgccagttcctgagattttaaatattcttgggagcaaatcagacttattcacagtttttcccttgctggctcaggagttgtctttctcaagtctgctaaggcagttagcacttgtctatctgctttccagcttccaaaattttgttgtgttttactgtttactgttagttgtttatgatttagtctgtcataaagtacacttcccctcttcctgttgtgttcttctcatccctaagagtttatgtcattaaaaaacctctcattatagttttagtaggagtgtggagagaaagtgagatgcatatgttcagtctatgatcacaatcagaattccctagaggattttcaaaaggcatttctgagtaggcacagtggctcaagcttgtaatcccagcactttgggaggccaaggcaggaggatcacttgagctcaagagttcaagaccagcctgggcagcatagtgagaccctgtctctacaaaactttttgaaaattagcagtgagtggcagtgcatgtctgtaatcccagcttcttgggaggctggggcaggacaattgcttgagcctgggggattgaggctgtggtgagctatgattgtgcccctgcactccagcctggatgacagatagaccccatctcaaccaaaacaaaaacaaacaaacaaacaaaggcatttctttgattactgaagaggttgaacttacttccaaatgtttatgaatctgtgtatttcctcttctgtgaaatgctagttcaaattttttgtccatttcttcccacggggatttttgccttctcttatcgatttgtaaaagctcttcatattttttgtattctgttggtcagttagatgtgttgcagatactttctcgtagcctgtgacttgtcttttcactttttgttgttgttattgctttttgtagagaaggggtcttgctatgttgcccaagcttgtcttgaatccccaggttcaagcagtcctcccacctcaggctcccaaagtgttgggattataggtgtgagtcactgtcctcagccttcgttttcactttttaaatggtttcttttgctgaattgaatttcttaattttaataaaattgccttttgttacagctttcccttcacgctttgctctttttgtgtcttgagaagcccttccctcttcaacagtctttttagttatgcctttcatgtttaaatctttgatcatttgggatttatttctgagtatgatgtgaggtagggattcattttctctacttaaaaaatgtatggagagcaagtttcccagcatcttatcaaaaaacatcctttctacactgatctgcactgtttattctgtcagttatacttcaagtttccattagtatatatttttctgtgttctcagtaatcttctgttggtctttttgtccatatctgcacccataccatacagtttaatgacttcagctctgtgctaagtcctgctgtgttgcataggtcccagcttgctttcttcttcaagagcatcttggctaatcttagtcctttgctcttacatgaaaaaacctcttgtgatttttgtttaagtgtgttaaatctttaggtcaatttggggaaaactgacatggtgatgaagtacatagtatgtttctttataaaatatatgatacatctctccttttacttacaccttctttaatgtctttgaataaagctttcattatttttcccataacgtgtttgcacatctgttgttggttttattcttaggtattcaatatttttaattgctagggtaaatgacattttaaaatttatattttaagaccatggttggtatagaaatcggtttgtatagattgtgattgtattgaaatgcagttggattggggtattgattttgtgcccagcaaacttgctaactatcttcattctaattagtattagtttttttcccttctacttaaacaatcatattatctgcagaccatgatcacattttctcttttctttcctcatgcatttatttctttgctttactgaaactggactggccctttggttaacttttgactttgtaaaaaagcctattaaaattatgagtaacaactgccttagtgcatgcaggctactatatcaaaatacctcagaccaggcaatttataaacagcagatatttattgcttacagttctagggcctgggaagtccaagatggaggtgtcagcaaattcagtgactggtgcgccggtttctcacagatgatgacttctccctgtgttctcataacgcagaagccggaaacaagctccctccagccccttctgcaagggcactaatcacctcccaaaggcctcatcacctcttgatactattgcatgggggttaggcttcaacatatgaatattggggggatgcaaggattcagaccacagcaactactgagacaatgtgaatagtacacacaacctccaacccggtacagaaggaaaaatcaggaataaaaaatgtctaattcacatgaaggtcagaaaggaagaggaaaataaaggtcagaggcaaagtatggaattccaaacgtggaatgccgaaatggagaactcaggtccggagccggtgaattgccctccgcgcttatggagatcgcctgcagcgccacctgcaggctggaggagcactccgggccccagttcaccgccctggacccagctggcaccacctgcggttcccaaggacgcatccagtaaggggcggggcggggcggggcggggaggggcgggactcaccacccatgtgacctgcactggcctggaggagctgcctgactgcagcggactctgccaagaatttcaagaggtgcagtggtccagtcataaagcaacatgaaaacgctgtaaaaagagtttaatcgcgcacacgaggcagacattgcatttaatttatcaccctgcaaaattaaagccattctggggtttgctatcgctcatgcagggtggagttatttattggacactgtcagagccgaggggatctgaaattcaggtcagggaaagtcaagtttacaaaggcccgtccgggtccctaggggcccagatggctcagggcaatgttcctgtgtcttgctgctgcagaggctgaggggagcaggcactgtgttcacatccttgatgagaaagccgagctccgtgtgggtgcgtgcaatcctgcctccccgagctccacgctctgaccctctaactcctcagaccactaagtaggctgtcccctcacctgcccctttgacgatgtgctgggtgccaggtgcctgaaatgcgtgctcctacctgcccagccctgtaaggaagccctgcatggtgacccccatgtcacagatctgagccctggctgagttgatcaccgggcctggcgctgtccacccagtctgtgctgaatctatttgaagaaacccatggggtcctgggcttggaccttttgcttggcccagggaggaggggcagggcaggcgtgaggcctcctagaggaaggatggcggccggtttgaaatacacctgggaaatggctccgggggacaccacagatttgccttcaaagcacttgttcaagcagttactcactgggactgattgcagaggaggtgggcagggggcgctggccgggcctctgggctctaattagtcaggtaataaggctgtttgtgccaatttgctgggccgacaggctggctgctcactggctgcctaacgaggtggggagttggggtgagtggcccaggcaaggcccattgactcaccaatgggctgcggctgcccctcctgctcctgtctgcagggcccaggagaggtgagtggaagctggggaggccggaggtccctggcgtgggaaggccacagcagtcattggcacccagaccagcaagaccaaccctccagctggaggccctctgtccctccgaggactcactgcccgaattgccagacaacctgccaggagtcccggcacccacacctcctgtccttgtgggtctgggttgtttgcactgagtgcagagctctgcggctgatgtagggagagaacagagggcttaaccccttcctgaatcctctcattctggcccccaccactgctgagtttaacaccatcctgacacccactttccagagaaatcagcagagcctggaagagcctcagggagttgaaggagagacgaggagaaggggctgccactgtgggttttctgtgtgacctcgggtgatggcctgccctctctgagcctgggttccctgtctgtggtatgagctggtgctgcaggtcagcctttgtgcctctcagagacagtgtgttgggtggctgaggggggcgctgggggtgtgaggggaaggaagaagcccagcaaatgcatgcggtctgcttccccgtgagatgttctgctttctcccatctctgccacaccccttctcctggggacccccagcccagcgccctggacccagggccatgctgacaagggatcctgtgagcagcctaggagcaggcgcacattccacacatacttctggagcatgtgctcagtgccagatgccacaacaggggctggagacacttggggagctccaggctcacatccctggggaggcaggcgccagccccatagtcctctgagtaactgtcctgcagggtggtgctcagccgtgcctgcccacacctccatcgactccaggtggcacatcagggcagggtcaccctcaccctccagttcccagaggcctcctctgtcaggctgcaccctctgtgagtccctggaggaccctgggctgaagtcaggcctttttcctctcccctgcacagatctggcaccttccagctcctgcccacagatctgtattgcacctgccaagctccagtctcccacccccaacctctgcagactcttccagcctcctccaactccaggttcctgcaggatccctccctgtcctactagactggagtgactctgaagtcacttctacaagcctgcgttgggctcccatgcagatgtcccatgtgcacagagccccgattctggctgcagaggcagctggcaccagatgtgcagacacaaggtgcctgggcaggtgcccagacagaagcctcagtctggggccatgaggtgagcacactcccgagggaggcatcagcccaggacctcaaacaacgatggtgagaacaccagcccgcactcttcctcattagttggagtcaacttggatgccaccttcgtgggaaggtctctcttccccaccatacctctgtgcctccatctctctcggcctttcaccctaccaaggaaaatcttccttgtccttcctttgtatcactgatcatcacccagcatgatctattcatttgtgagtaagctttctgctctttcccctgcgatgcaagctccatgcaaacagaaagatttgtctgcatttcttttcctgccaaatctttagcataaagaatagtgtctggcatgtaggaggtgctcaataaatatttgttgagtaaacaaacgaatgaattggttgtacatccccttcgaggcaatgtccacacagcacatttatcatcgctgcacttgcaggacaaatggcttctgtgtcctgctggcttccctccttttggataccagttgcccacgtttccattagatcttctgatttttcactagcgctgcccaagtgctatcgactgcctgatgggtgccttcccagactcttctgcacattgcacactcaggctgtcaacacatcactcctccagacaccatggagaggggcgccttagtggcaaaatttttccaatcgggggagcaattttctcaggataagttcccatgaattgcaattacctgatagaggagcccttgctattgctctcgccatgtgttgcaaattgcatcctagaagctatgtgctgctcacgtgccaccagctcacagtgccaccagcagtgcaagcacctgctgggggaagtccaagctgcacctgcctgaagccagcatgaggctgaatcccagccctgagcctccagggagaggcatgacccagacatgaaggcaacagaaagatatctgtgacctgcccacatggagggatggtgccatccagggtcctttccaaagagggcacccaagggcaaggtccagtgtgcatggagcttagggccagggagggtgaggagtgccggtggaaccccctggaatgagcaccagtgcagagaagcattgcctccctgctagaggaggccccaatggatcatcgtgaccaagggggcaagctctagatgaaagagtaggacaaaaagagaaaggagggagggccttggagagaagagaaggaaggtgagcaggccagcggtcactgagctgggtgtccatctgtggcttcatgagcctggtgcccctctcctctcttgaggtgcaatggcagaccctgtagggtcccctacccccactgcatgtgcccctgctggggctgcccatccagggtccagggctgcctccttccctccaggccctcttgacaaccccgctcccctaccctaatttgtgggaggattggatcctaagccagtttagccaactctgagactcactctgtgccagacggaggcaaagtgtggggctcacaggctccaaactgaaaaagcaagttcacaaaacggggggcacccggcaccgtgggaggcgtgcaagacattggatccgacttcactggagggcattgcgagaatgttggagatggggaatgagagagaccggcagtgaaggcggcacacccgccccaccctcaaggcaccgtgcaccgccctgtcctcggatctcccctccagggcaggaacgcacccacctgaccgagttgctgaggacaggctccagtgtgagtcatctgggccacgcttggctcctttttggtggggagtggaggaggcaaactctaaattttatttttgaagtgaaaaaagctgccatttaaaaaagttgtcagtcaagttccactgctgtgtgtccatcaaagctcgaattggactgatcctgccatagataatggtgataacctctggacaaataacaaaaataaatcaatcaacagaacttccagtttcagctgcaacatgtaaacagcttggaagtcactcctctccttacaataagaaaaaggcggaaaaagtgaaaatcagtgacttttctcaaacccatcagagaatggggttgcaaagcaaactgccaccctcaaatcccgggagacacatgaatatggaagagcaagtctgagatctgctcacctggagccgaagccgctggagccagaaacccgcaacttgactggcagccttgatgaactgctgggggctgaccgtggagtagcttgacagggagcaatttcctggggccacactctttttttttagatggagtctcgctcttgtcgcccagtttggagtacagtggcacgaccttgctcactgcaacctctgactcctgggttcggggccacactccttatggggggcccattttcgtgggcttcactcccagaaaccaacaagtctttcatggtgaagatctgaaaatgacccctgtgtctctggcagtgggtggcgaaggcaatcgtgtgaaatatacccagtgccttcttcataaccaaggcctgttctccaggaaaccttattgcaggtgggggagggatttcctcccactcctgcccccgccagtgtgtctgtctcaccttaggataaaaacaaaaaacatagtaaacgagggccagagagcttcaaaagaatagattgggaatattgcaaccaggaaaggacttgcagggataggaagctatacccatgcagaaacacgtgaaggtaacagcctagggtcacaggcccactacaacactgacatgtaattggaagattataaagaacctcctccccaacacctaccacagccccaacagggctcccatataatagcagtggattctgggacagacacagactctctaaggaggattactcagggaagcccaaagtcaaaagtggcggacacaaacaaggatactagaggaatctgatgcttctggcacccatagctacagcaaacattaaacatggaccaactcctagcaaggttaacataaaacttcacactaggccaggtgcggtggctcatgcctgtaatcccagcactttgggaggccaaggcaggaggatcacctgaagtcgggagtttgagaccagcctgaccaacatggagaacccccatctctactaaaaatacaaaattagccaggtgtggtggtacatgtctgtaatcccagctacttgggaggctgaggcaggagaatcacttgaacccaggaggcagaggttgcggtgagccaagatcccgccattgcactccagcctgggcaataagagtgaaactccgtctcaaaaaacaaaacaaaacaaaacaaaacttcacactaaaggcttatttctctcagttcttaccacccaatacaatatgtcaggttttcagcaagaaattacaaagcatgctaaaaagtaagaaaaaaacacaatctgaagagacaacgcaaccattagaaatggactcatgtaacacagacgattcaatcattagacaaggaaggtagatataactataattaatatgcaaagggctctaatggaaaaagacaacaagcagaaacagatgattaacctaagtagagagatggaaactcttagtaagaatcaaaaagatatactagaaattttaacaaacaaacaattatgacagaaatgataaatggctcatcagaggactgacacatccaaagtaagcaccggtgaatttgaagataggtcaattaacacgtcccaaactattctctgtgtctcttaatatctcttttgtattttctacctcttttctctctaagacgcattctgtgtaatttcttcagttctcttgtctaatttagtaagtctgtctttgactgcatctaatctgctactgtttatatccctcttccctctttagcatatttgttgagtaaacaaacgaatgaattggttgtacatcccaccaacccattggttgtacaactgccaccaactgagtcctaggggttctcttccctaaaggcaggttgtgggtagcacacaacctcaggctctgcttaccttgacttgaaaacctagtgacaagaatgtaagtcttggcagagagacagtctctttattcactttttaaaaaattattaatatataattaatataccatgaaatgcaccatcagttttcctttgctgtgcaagacatcaccgacaatctagcagcttacagcaaccattcatgttgtgcacggttctgtgggtggttctcctctggtctggtcaactgacctcagctgggctcactcatgcacctatggtcagctagcaggtcagctgcgagccagaaggtccagggtggcttcactcacacgcctggtagccagcagactgttggctgaggtgatagggcttctgggcaacgtgtctctcatcatccagcaggctggtcctgtctcctccatatgtgttcacaggggtctgagagcagaaagaagtcaggccccatcatgcctatgtcacatttgctattgtctcattggataagccaagtcatgtggccaatctcagattctgtatgggaagggactgcatagggatatgatgcagaaagatgtgtgactgcagtggtctacccagatgttaactgttctatggccccggtcctgctttctctgctaatggtccctactctgttatctattggtgtgaacaaatgactccaaaacttagtggcttaaaacagctattttattttgatgggccaagaatttggaaaaggcttggctgagtgattcatctctcattcagttggtgtcagcgggggtgactgaggctggagactctacttccgaaatgccttcttcactcccatgtttggagccccagtgcctctgtttctctctctcctccacacactgtctcatcccccagggcctctctgcatggcttgggcttcttacagcaggtacatctcaggttggctgaatttacatgactgctggtctcctggagcaagcattccagtgagtgaggcagaagctgccagacttcacaggacttagtctagaggtcctggcatgtcatgcctgctgcattctgtaggtcaagcaagtcactaagaccagggcagatccaaggtagcagcagattcgacttcatttctcaatgagaacaaagaatttctatccatctttaatctaccacagtctgccctgtggctacaactgttgatactcctttcaaatgcaacacacactgaatctcactgaaggccctcgcaacgtgcacccagccccactggagacccccgtttgtctcatctgtttggctttggctggaggtccaggaccctctgggctaatgaactccagtgcacatggggtcctgggtcctccaacacagttgttctgatctgaagaactgcaacccagatacgagccatggggcccttccacccacctagattctggtggtgagactctggggaccaccagaatgaacacccattcaacagagcagaaagcaggagtacatcacagtcattccatggcgatcctgaaatccaccctggcatgttgccagctcctgcgccctgatgtgatgcagaaggagtgtgactgcaatgacccacccagatgtcaactgttctgggggcccctgggtgaagaagattgtgccttctgggctcctggcatcatcctctgagtcactctttctcttccatatgagctgtccctgttcacaggtaggtcctcagctcggccttcctcctaccttaggaagatagagaacaccactggtacaattttgttaaaaggtttgagaggttcttccagaccaactaaaaatcagctggattggatcaaagctgccctggcattgcctgctgaggctggcctatcttcaccctgggcagccggctatggaacagcacccaaacatgcctggaagcctcattgactggctgggagcatcggtggggcaccccctgaagatgtttaaaggctcttttgtttagctgagagggcagtgagccacccccttccttctctctgaggtctggacaagagcgcttccagctgcgctggcttgcagccacacatttctgccccgagatcattgtttgtactgagaatcttcgttgggagagcttgagggtgacacagttttgtttttgaactgagcaagtcctgggtcttttatgttcactctaacttctgctaagaatttaactgttccttaagctgaccccctctctctttgtattttatcacaggcaaagctggctgcctggaagggtcccctgtcagatccaccggtgggtgagctgccctttctcttttgcaggtcaaactttccattactgtcaccatgtaacaggggccctttcctccagcctccagtaatgtcctcgccaccctcacccttagagccctcaccaatgattccccatgctgcctcccatcatcttgtccccaaaccaatgacccatggtgaacttttccttattaacatttttaaaataaaattgtatgtatttaagatatacaacatttgaacatacacatagtgaaatgactactatatatttcattgtatatatttaagatatacaacatttgaacatacacatagtgaaatgattactatagtcaagccaattaacagagtcatcactccacaaagttaccttttttaaatgagagcacctgaaatctattctcagcaaatttccagcatataatatagtactgactacagtcctcatgctgtacattagagctctagactaattcatcccacataactgcaattttataccctttgatcaacatccccccatacccactcctgcccctggtaaccaccgtttctctttctgattctatgtattcaccttttaaagattctacaaatacatgcagtatttttctttctgtgtctggatcatttcacttggtatgatgtcttctggattcatccatgttgttgcaaatggcagtatcttttccttttttatggctgaatagtactccattgtgtatatggacctcattttctttacccattcatccactgatggacacttaggttgactccatttcttggctgttgtgaatggtgttgcaataagcatgggggtgcagatatccctttgatatgctgatatcatttcctttggctacatacccagctgtgagattactgggtcatacagtagttctagttttagctttctgaggaagcttcatactgtttgccacgatggcagtacttattcccaccagcagcatgcaaggttgcaaggtttccttttctccacaacctcaacactgctattttttgtctttttgacaacagccattctaacaggtgtgaggcggtatcccattgtggttttaaatgtgtcaggttggtgcaaaagtaattacggttttccattactttccattgcaaaatctgcaattacttttgcaccaacataacacatttctctgatgattagcgatgctgagcatttttcatgtacctgttggccatttgtatgtcttcttttgggaaatgtctattcagaccctttgcccatttaaaaattggatgatttgttttcttgttattggatcatttgagttccttgtatattttggatgtgagtcccttagtgggtgaatggtgtgtgaaaatgtcctcccgttcctcaggcgccttctcctggtgctcacggctgcctttcctgcactggaactttgtcgtttggtgcaatcccgcctgtttattgttttgttgcctgaacttttggtgtcatctccgaaaatccaagttcaggagcttccgcctgtgtgttctacccatttaatggttgtaggccttacatctaagtctttaatccattttgagttgatttttgtggatggtgtgagatcagggccaatgacccatgtctaaagattttgttacagcagcacgcccaccttccaggtatcagattatattctggtgacttattgctgtgtaataaatgaccccaaaatgtggtggcttaaaacacccccccattttatttggctccttattttgtgggttcaggtttggaaagggctcagctgggaggtttttctcggatccacatggtgtctaccgtgcccacttcccagatggcatcttctcccacatgcctggtgcctgggtgccacgtggttcctcctcctctacatgggagtccacggcttctcacggcatggccagggagtaaacatgttaccctgaagatttccaagtgagttgggtaaaagtcacaggactcttgactcagccttgggagtcccagatgtcacttctgccaaattccattggtcaagcaagtcgccggttaaggccagtgcaggctcaacggggcgggtggatcagagtccatttctccagggaggagaaacaagaaatttgctaccatcttgaatctaccatggtctctggagcccggccccttgcctcccaagctagatcctagcttcttcggcctctctttgctgtctctgtcccaccaggagaacaataggggtgggtgccctccaggcctgtagggacccagccagtttctcctaacccgggcagctctggcccagagggattgtacatggcagtccaggggttgggggctggggtggtcaggctggaacgggagcggccaggggcaggggacaggaatgtgggggaacactggtcctagggaaggccaggaggcctgaggaggaggccagcggatcccagcaggtgagggagacagtggggcaggaggggagtgaggatgggggattgtgacggccccttctcccagcatgaacctcccaagccggctgtggatgtcttgcagctttgctccttggagctggggcccccactgtggtgactggccgctgcctcctgctgtggtccctcccccagattccagcattgcagataataagtgaaggggctcccagtgccagccctgcccacttctgaacaatagtgagtgtcctcaggcactcagagcccaatgaggaagaaagacacatgactggctggcaaagccctattgtgaggggcacggagggaaggggcgggaggaccccgggtcggctgctgggtggcctcgtggtacagagacctaaggggtgggaaggaggccctcagggaggagcagaggctctgtaccgacaggtgggctggcccctcatccacccatgtcctctcctggagcctcagtctgtccatctgtcaaatgggcagagggacagcaccatctcatggagctgtcgtcggggctgcaggctgtgaatctgaaggcttggcacatgggaggtcctcacgaggatgagattcttcgctgtgttgtcgagttttcccagcagagggaagcgtgcagaggcgcagcagagcctggtgtgctggaggaacagacgtgtggtcggggggctggaggcacgggctgtgaagtgaggtaggggttgagggtcaggttttgctgggagagccttgacttctgtctcacagcggaaaaccagagtccttcaagcagggagtgactggagtcccaatttggtttctcaattatcagggaggagggtgagctctaggggttgccagggagatgggggtctccgtggtgggtgcagggcttgctggaactgttctggaggtccctggagatagaggggccctgggttggccctggagcccccggtggtgctagagaacttggcatctgggtgtaggctctgccgggggctgtgtccctgcccagtggccctggctggccttgtctggagaaagctccaccatgtttggccctgggtggcggctccatcaaggccactgccagccgctggccctcagcccttccaggagcctgctcgggagctgccgggacattgctctgcatcgtaatgacgcgtgctggctctcgaggaaggatgtgacattcagcatccaggaaattcattgttattgccgcacactgaatgccaaatgaacccataacggtggtgggactgagctgaaatattatccaggtttcaagtgactctggattattgcaaacacacagggcagggggagtgggtggaggggttgtgcagacgcaggtctgggacagcggctggcaacaggaaaaggggacagagttggaggcaacaggttgcagctgctgggggcagggggctgggggcagggggctgggggctgggggcagggggctgggggctgggggctgggggcagggggctgggggctgggggctgggggctgggggttgtgggctgggggctgggggccgggggcagggggctgggggctgggggctgggggctgggggccgggggcagggggctgggggctgggggctgggggctgggggcaggggctgggggctgggggctggggcaggcagggccggagcctctctcagtagctctttgctgccccagggaggtcctggtcacagcacgtgggctgacgtggctgctcagaatgggggtgcgtccaccagcggtggctccccggcacagcaggccccaagttggccccgcccctgaggcccgcccgagggtgaaggcttctacagggggtctccgatggcagctgcctgaccagtgcagcacccgcaagctgcactccagcttggggctcccttccctgtcctcccgtccactgtcaccttgcacagccttcgactcgctctcctgactgggaccggcctctcccagccaagctgggcccctgggagagcccccacactaggtctgcaccccgtggtctcccatccctgactccgtcccacaaaccaagctcctgggtggggagagggggcctgtagctgcatgcagtgatgggggggccagtcccccacctccccaggctgttgagaaggcaacaaggaccaagggtggtgagtggctgtccccctttctcagacccagagccagtggctgccccgtggttactttgtccgacagcggtgggttggccggggttggtctctcctgcactggggcagaggctggggggacaggcagcctggatgcagcctctgagcctgtccctctcgggaatggcagcccagaaaaggctttttccttccgttctgtcttcttgtatttccactttttttacaaaagaaattgctcagaaatgatttagagctttttgctaaaagtgcattttgtcattacatggaaaaagcattgataattatcccagctgcactctgctcctgggaggatagatgggtcccagctgtaccccactcccacgaggatagatgggtctgacatccatatccagccctcattgtcctcactgcctggtgcctctgccaggatgccagaccaccctcgtccctggccaaagagagaagctccttctcactcctaccatccaccagaggcccactccctccaggtcccaggccctccgtttttttgggcccctccattctgggttgtgggaggcatttggggagccgggcctggtgtggcctcgggggttctgagtcagtcacggggcatcctcacaggaaggcatgcagggaggcgggctgcagctgtcttcaccgtgggccatgtcctgcttcccctgccatctgcaggacgctgggagagccagtcagatgagggaaggccccggacggctcccctgtccccacccgcccctgggctccatgtaggacagtccccacccacctctaggctccgtgtaggacagtccccacctgcctccagaccccaggagacagggaaaggcctccgtctttctcatttgtccgtgcttctcctttcccagctcttcaggagggaatcaccagctcactgctgggcgaaagttctggcagcagctgcctgggctgggctgggctggctgaagcctcagccactgctcctggtgggaagctcacatggaaagcattccagacccagagtcccagcagggccaaaaggtgggctgtgagcacaggctggggcccagcagctccagggtaaacagaaggtggccagctgccccttggtgctgggtgggctcctggatattccagggcacgaaacataagcctggcctgattctcccttggatgcgtcttctgcaggcctggctccctaaggacatagcagggaaggttctggccacggtgggaccccaggaagccagcaggcagccccgtgcagcttaggctgggcctggagagcaccgaggaggccatcccaggcacagctggcgctcacatgctgcgggggggttggatggtgcccctcaaggatatggccatagcgtaatgcctggagccagtggtgtggtctcacctggaactagggtctttgagtgaaggatctcgaggtgaggtcgtcctggatcgtctgggtgggccttaaatcccacggctggcgtgtgtccttacacaaggaaagccgagggagattggacacagagaaggaggccctgtgaagatggaagcagagactggaaggatgtggccacaagccaagggtgcccagggccactggaagctgggagaggcaggaagcagcctctcctggagcctccagagggagcagagggtgagtctcctccagggcggctggaggctctgtggggtttgcactcgtggtggacggccacccctgctggcagcctgatttcagacctctgacctccaggccctgaaaaaatgcacttctagtgtaagctcccggcctgcagacgtttgatgcagcggtcacaggggagcaaggcagatgctggtctgggcgcctcaatcaccatctctggtcccgtctgtcttgctcccgagaccccagggcctggtccttggtagcacagggaaaacaccagagaagggaatgcaggaatgaacgacacggcagacccaagcactggctggagggcggtcaccgtcaaagacagggcccaagagtgagagtgtggccacaggagccgagagctaggagggccaagtgtgaattgcaagggccggggctgtcctatagcagggctcagggccccagcggatgcagcctgacactcgtggtccagcttcctgagcacgttcttcgagccacatattttgaggacctactgcgtgctggccagtgctcggaggcttacgtggatcatgtctacctcggtagccctgtgggcagcatcagaaccctggctttgtgggcgagtgaaagtccaggcccacgtgtggccgggaagtggcaggcttgggcttggaccccggaccccagacccacgtctctgcccctggagaggcctcctgcagtgccgcagctctggagttggatggaaactagagcagggacagtgttgccgcagcagagcgctgcagtcccaggaggtgagagccctggtaagcgtgggcggtgcaggaacccgtcctggaagtgtccctacatacccgtgtgccagtcactaaacgccacacaggccgcaggactccttcggcccagggccactgtcctgcagtggtgagaagcctgtctccacttggtaggaccgtaattaaccagtctggaagcttccgtcaagctctgtatagaatcagccccaggcaaggcaccgcacagtggccatgggcctagcgcactccatgggcggagaatacactgacgatggctgagccgacaatggactgggcacagactcagcgtgccagggcctccctgaagtccagacagaacaactgggacgctggctttggggatctgatgatcatagatctttagccgcaaatgtgggaggatactggagtaactcacagctgtcagtgtggaaggagacaacccagagtgcagaggaaatcagcatctgtacagagagtggcgggcacacggggcttcgtgctccccacctgcttaccaggcactgggagccatgggtggctcttgagcacgagagtggcaggacaagcctctcgtctgggagccgaggcaggcgcttgcaggcacgggccaggtctttcaggagcatgaggaggtgggggcacagggcagtggggggccagggcctctctgtgggctttggcattcccatctgtgccatgggatgagcaccctgctctgggatgccaggccgggcaggggctcacttggcactgggtggactcttgagaggaatgagcctggtgttgggctctggccctggcccctgacatttgcttcttgccttggaattgggggcagtggcctggcccactggaatcgtggtgacagggtggtggctctcccttcaccagaagtgtgacctccatggaaagtccaggaagcagggatgaaggagtgcctcattctccatgctggactcaggcggacctgcggctccaagggctccatgctggactcaggatgacctgctgttctgagggctcagcggcttcctccagggccatcactgggatgagaggacctggtgtcaggtggggatgtgccagctcctgtgcccccagctcccctcctcctggggccgaggtagctgagtggatggggaacatgccctcccttgccgggccagccagctccctgccctcgtctaagcagcctctcagtgggcagtggccttgggccatccctgcttccagagggtcccccatggggccctcggcccctggcagagctggggagggcagctgcagtggggtcgcgtgcctggggggccgcgggaggtatcttgtccggggctgtgttttggattcatttatttccgctctgcctggaaacccactctgtcccctgtcctccgggtgtacagtgcctcctcagagattttgggggctctgcaggggcgaggacagctgtgtgtttgccggccacatggggcagcctgtgggatgaacggccaatgagtgaggtccggcaagcaggtctgggccccagctcagctggtggccatgacacaggctcctagaaggcagaaccatgtgtgtccatctgggccagaggttgggagtctgcagcatcaggttgggttcaaggcctgggaagcctgtcctgacagctccccctgcctccggcccccagccctgaccttaagccctcacaccaccatgcagaggcccagatggtgcaagccactctcctggctccccggctccagcacctgctgtggctcccagatagacagcagctaccatccctgcagccctcctgcaaaacacggccattcacactgcagggacccggaggggacagtggacccacaacctggcctggagctcccgaggtctttcatcatctggcccatcagcccctccagctcgtgcccatggttcccttgcacaccctacaaagttcagccaaactgccactctgggctgacccgagcacctgctgctacctgggcttccctgggctatcccaggggtgctcccaatctccagctccaagccaaggcctctctgggactgagcatttggtcctgtgtccaaattcctgttgtccatgttggatccagctcctgtccctactcctgcagaggggcccagccctgcagtccagcaagatgttggcgagtggggatgggggcagcagccctggcttttgctggaataggaggatctccccggccgttcccacacaccctgggctccacagagctgggaggacggagcctgggttggggaaactgcctggtctcccggtgtccccacagtcatctctactggtcctgccctggctgggtcagctcctggctgatgacccaagcctgaggtccacctgtgagctggtggttggggccatgcatggcccacgcactggctgcccccagggaagacagctgcccctcacccactgttgggcgagggttgagttctgttccccattcacaggtgggaatccagcccctgggatctcagactgggacctcatttgggaacaaggtccttacagaagcaaccaagttaaagtgagctcactggggtggtgtcctgtgtggctggtgtccctataagcagggggactttggacacagacgtacacagagggaagacaattaaagacacagagaagacagtgtctatcagcggaggccggaggccaggcacagactcccctcaggaccctgggaaggagccttgaccacagactccaggccggacctgtgagcagcaggtgagtgccgtctaagccctggtctgcagggcatcaacagccacaagaaagcagctggctgtccccgagggagcgatctgcccggcagacacactggagtccagggaggggctcaggctgggctcctgccccagccactaccttccctcccctgcctcccctcccctcacccttgccctcacccttgaggggctgagcaccaaaatgaaattcaaccttctcaagaaaacgtgtggcttttggaaccatgaaaaaaaggcccttcattgtacagatggggaaactgaggtctggggctgggagcttcctcagcccatttctggcccatggtgcccatctcccacatgagatctggcctccaagcggtgggggtgtctgtctgggccaatgaatgtcttggcctttgcttggcgtctccctgtggcctgactcattcctgggggagtgtttgattttagaaggaaagggggacccactgcagggtctggagagggactttccctcgtgctcccctccctgatgtcccggtgcacttcttagctcgcttgggaaccccttggccggagcaagctcatgggtcaggcgagttgacgtgaggctgctggaggaatgactgtggctgccttaagtggctgggatcccacgagagcaggcagcccgagcttccaccgagggcagacaaggtcaggggcagggaaccgccgggtctggggaccagagaacctggggaagtggcttgtggaggagcaaagcctgtgtctgcacaagagcatgtggtgggctcaccagggcctggcgggggtgagactgctgagctgctttggaagggagtggggaccagcagacctgggacagacatctttgtgcagaaactgctgtggaattggaagccggcctcactctcctagaaatcaaagcagtcagcaaaatgcctcctccttcagggagccctcctggttcagggtgtgtgtataggagaaagaaaccacctacttcacgctggcttgcgtagtgagctgtaaggaatgttctggcatctcctctggggttctggcattctggggaaactggctgaggagaccttggagcccactggccagggatgagaacaatgctttgggagagcctgggttcttgcactggaacctctgggctcggttctgtggaaattgttctgagaatctgcccttgatttggctgctctggagcatggtggcggagtctgggtgagtgccaggccctgctcccacccaccattgctgttctgtgtggtggggactgaggctgagaagccgaacaccagccagagcccacaggactcacgtggcaggggcagggcagcctggtgcccgagctctccttggcccatctggagaaggctgggctggccaggaggtggggggtcgggtcctggagccctcagccagggtagaaggaggccagggcctgcatcccctgctgtgtccctactggggagtgggtgggcaggagccctggccatccagggcgtgtggtggcccccggagcagtcgcaccctcattcctcacaggtgggccctcgtcctccagagaaactgcagctgctttatgaggccagcccggcggtgcaaagcactggggtgataaaggagggcagggccattacttatcgggttcaattgttccggggccctgggcagggaggtggggtcactgcagagcactctgacatctgtgcttggggctctgactgcggttggggcctgtggagggggtgtgggggtgcagggctcctgagaacccaggaagcagcgagaggaatgttccgggaccggcttaggctctgccgttctgggtgttggaggggagggcggctgcctctgcacagcagggcccggaccaggatctcacaggtcccctgggagctcttggaccatagtggacagaagcaccaggatttctggggtcctggctttggacctgggtgttcctcatgttgacgggggtctcccacacaccaggtccctttgtggcaggggggtcaccctgagctactgaaccagcctcactttccgtaggaggccagggggataatggtgcagggtccgtggctgtgggcttcatgctgctgggggccaagaggaataaccagcgatgacatcagagcaggtatgcaggagacgctgcctgggtcggcaccccgtgcctcagtttctccatctgcaaaaggagtgacaacactccagaccccacaggatgactgacttcaagggggaaaagggactccagcctggcctttactccgaatctccggacaacagcaggcactggcaccaaagacaccaccccctcctgcggaagtggatttccagcgcgggcaagtggaaagtgctcatgggggtgggggtgtctgccactgcagagctcgttctatgaggggcctcgttccttcttcccaccagcctctgctgtgggcatctgtatcagccccaccttgctggggaggaggtggagctctgcctggcccaggagaggggcttggcctccagcacacctgggtctggggccctgcctgggctgccagggcagcttgggggactacgtgaggtcacctgttcattttgcaggaattcatggccctacgctgtacaggatcttctctgggctctgggaacatagcaggtgtcaacagcaggtgggagcctgcaccctcctgagagaatggggggctctgtgccctccacactaggcacagctctgcggcgcccgccggctaaagccacatcttggttaattcccaccagctgtgggaagtaggaatacccatcccattatagttgggaaaatagactatccctgaacatccctggtgttcagtgcagtgtcccctcctctaggaagccttcctgggctcccagctggggtctcagcccctcccagcatgtcaactctgaagtctcgtggtgactgtctccacggagcacttttgagggagtaggctcttttctaacagacttctaaatatcacatccctttgtcccctgcactatctccccaggtagggactatcagtactgccactgacagctggaggacttgaggcacagagcagttattaccctaggttgctgaactaggaaagggcacagccaggatggactctccagcagcctggcctggcgtcaggatgctcgaccccaagaaagttctggaacttccctgtgctctccctctggctgctccgtgtggggctccgactcccaagagccccggggctgctgtgggcagataatcaggaagcagacattcaactacaaaagcaaacattgaccaaggcaggcagcagggcctatggcgtgggagcgctacctggacccctcacagactgccgggtggggctgggggccggggacaccaggagccgcccactgacctgtgtgtctgccctgtggctccgtctgtcctggggtgcctttctttcctccctgtcaggccacacacatgaggagccagctcccatgcagagggccccctcatcgccccacatggacacacctactttccattgtcacctgtcagcatgtccgggctgtgctccagtcctgactgtggccctgatccctctgggactgatccaacccctcccccttctgcaccaactacaggaagaagggcttccactaggccagcacccagggctcctcaggcccccactctgagccaccgtgtagcgtgggctctgagggagcagggtcagtgggagccggcagggacagagtggccctaggatgtgctctgccgagagaggggaattgagtcactgcgtggggtcttccatggtgccctggagggcacttggaggaagctaactagaacaaactgggcactgtccacgtcgctgggctcagcaggggtcacccttcccagggtggggactatgaggtcttcactcaactgtgatgccacaccagattatcttgctatccagcatgtcctcagtctgaactgtgctctgaccagacaatcacaccaagacccaactcccccacacaatgcgactgagatctgtgtttttggagatgattgcctgatttctcccaaaaagggttttaacttttcatagacagggggattctaggagcctcatgactttccctaattttccctccacctccaacacgtacctgcccacctcgtccaagccccgggcttgacaggtgtcccctctgagaacattactgcactgactttgtccccgagggtgaggtgaaccgctggggactgatgccagggactggggagtggccgtgccctgaaggaaggtcaaggcacaggagtcatgtaacgcaccttctccaaccacagcacaaccatgtgaggactgatgacaagaacggagtggaaaatacccggccatctgggaattacaaaaacaacccatcagccaaacaagaaaccataatggaaaccgatatttggaactgaatgatgaaaaagtacttcacagtaaaacttgtaggatccacctaaaattgcatggaaggataattctatggatttaaatggttatattagaaaagaaggatgtctgaaaagtaatgagccgaacatccagctcaataaactagaaaaaggggaacaaagaaagaaggaaataaaaaaataagagcagaaattaatgaaatggaaaacaatatacaaaacaaaggaataactaacgccagaagcttgatctttgaaaggacatcagttttagtgatctgtttcattgcagtgaccgcagttaataataatgcattttatgtttttaaattcttaaaagaatagattttaaatgttttcaccacaaaaaataatgtgttgatgaggtgatagatatgtcaattagcttgattgaatctttctacaatgtatacatagaataaaacattacattgtaccccataagtatacacaattattaattgttaattaaaaataaataaaatgtaaaaaacctgtaaagccctggtaagtcagatcaagaaaaatgtgagaaagcatgaatagccggtattaggaatgaaaaagagaacatctctacagatctgatagatctctaaaatttaagaagagaaaaaattataagtgaatattatactattattattattattattattattttgagacggagtttccctctttgttgcccagactggagtgcaatggtgtgatctcagctcaccacaacctccgtcccccgggttcaagtgattctcctgcctcagcctcccgagtagcagggattacaggcacgagccaccacgaccagctaattttgtatttttagtggagatacagtttgtccatgttggtcaggctggtcttgaactcccgacctcaggtgatctgcccgccttggcctcccaaagcactgggattacaggtgtgagccactgtgcccagccataagtgaatagtattaatcgattcatgtcaataagtttgaaacatttgatgaagttaacaatttctagaaagaggcatttatcaaaattgccacaacaagaaatggaagacctgaaaaattcttatctatgactattacagaagttgactttatagtgtttcttccctagagaaaactctaggcccaaagagccttcattcagaactttgatttaatatttaaataaaaaaatgccatttttatacaaaccctttcaaagaaaagagggagctcttcccaacttattttatcaggtgagcataatcttaatacagaaatccaaataggaaagtatgaggaaggaaaatctcactcacaaacacagacacaagcatcttacaacctcagcagactgaatatggtaatgtgtaaaaaggatcatgaccaaacatcatgaccaaactgtctgcatttcagtattatgattttagttaaacagaacatggatccaggcagccatgatgaaggtgggaggcagtgaaacagcctctgcactactgagggaggccagctaagatagcctttgcagaccaggaagagttcatgggaggtattcaaggattcagtgatgacacattgccccctaccctgtccgaggaaagcagataatgacggacaagaacagagaactcaagaagggagaagatggcaaggggagcccctgaagagcaatggccttaaagatactccccaaaatgcaaaaaaaaaaaggaaaaattatttttaaaaatgaaacattgcagaatgtcttccttttctttattcattcccttgttccctcgcccctgctcactcactcattccacaagtactcactgaccccatctctgggcacagctggctcaggggcccaggccccctcctgaaggaagaagttcacacagatctgcgactggggctcccagactcccacttcctcctctcactgtcacccctcttgtgggccttactcctttaggggcagggctgggagaagaaggggccgggtgacactggtgtgggaaggggaagcagctaggggcatctctaaggctgctctgagctggcccaggtgctgctggtcagcatgaaacaaagctggcctgcccaggcctgctgccctgcagacagcccccatttgggtcacaatggccgtggccatggtggaggggccctgcccttgccacctccactgcgtgctgatcattcccatgccctttgtgtccttgagctgctgttgttccccagagccccacctcccgagagagcccctgagaggtcgggacaagaattggccagggggtaatgggtgcccagccccgagacagcagggggtgcttgggctggtcttcagcccacctgggcccacttccacctccttcaatggtgggacagggaacccccagtcctgctggccagagcggatccctgtggggacctcagtcagccaccccagagtggatccccatggggacctcggtcagctgccccctcttatgtctttcagccaacgcttgccaggtccagctctgcctcaggctgggcgggcagcagggtgacaggtgtagcagctcgttgcaccacatcctggaccctcgagcttgtcccggggggcttctgcaccccacgccaggaagctcttcccataggaagcctcagggtgagtgggcgccctcggagataaacacggagcccaagcacacgagctccggcctaagtgaggataaatctccatgacaaatgtctcctcgaaagcccggaacaaaggccgcggcgtgtttatccaccctaaaggccgcgcagacagcccagaccccggaaacagccaatcgtgtcgaaattgatggcccactcaggatgcctcatttattaccagagatgtgatagagacgcaggcaggcgtgaccgggagaggctgcaggcggccaggtggtcatggcctcctgccacccagagggcttgggctccaccctcggccactcagccttccgcccaaggacaaatggggtcagggcagcagctgtacctggcgagaatgcactcccttcctggggggccacttttttccaggagtgcatggccctgggctggctgctgagacctgtgcccagcccctccgtggtggtactctcgtcagacaccagcctctgcggcacccaggtgagaggtggtggtgctggggggccccacccatgctcttgtcctgtgaagtggtcccagggtctcctgggctctccaggcccatccgccgcctgcccgcctgccagcaaatcagctgtgggcaaaaagggtacttttggttcccgtggtgatggcccatgaagatggagctctggccctgcagaccccctcccaccgcctgggcacctgcctggaggggccgggctttcacagcagggagggacaaggcggaggagcggctcctgttttttcttgcgtgaggcctggatctgatttgcacaatgatttcattgtgtggaaatgtgccagcacctggctctgacgccagaccaccacgagtggcagcttctccaggacatgctgacatgtgacgagggggtcctgcatgtggaggggcagtggtgggctgtgaggctcgaggttcaggcgaccagcagcgggtgtgggggctcctgtggtcccagagtgcgtgaccgtcaaccagagcagggacccccacagagcctcccagttagggcccctggcaatggctgtggggggctgcatggaggggcagtggcccagggtctgtggcggtgtgtgccgggcacagcagtctcgccccagctccatctgctcccctcctctggaggaatggaaatgggacccctcctgagcccaggcctcgcccagggctggcacctggagggtgaggccccctgccctcaagcctccccagtgacctgctgcccccagggcggagcctgcctgagggggaggcagcgctcagccctgaatgagctgtcaactgctgtgtcacaaattgccccaaacttagcatctgaaaacaacacacattgattatttccagtttctggtggtcagggatcttgacatggcttatctggggtctctgactggggtctgagggatcggcagaggagcaggttccccctgtagccaggaagatgctgcgtggaggtggggcagggtgcaggtccactgaaagggagcatgaatctgctctgcacggtggccccaggcaagtgggggcttgttgcagtggggacacaggatggcttttcccgtgtaccccagaagtccacactcccctggtgcaatcttctccagggaacgggtggatttatccgtggagatgcatggagccccgccgagccaggcccagccccaccagggtctcaggagagggctggatgtggggattgggggagaggggcttttctctgggacctgcaagttactggtcactgtcaatcacaaacggagctttcctccatctctccctcccctcaccccacccccagtctccctcagctccttccccagattcttggcagtgcagcgtctaagcagggcctccagacagagccccgccctcgaaggggcaggaggggcaccccgctgtgatcctaacccgatccccaccaccaaaatctgcagggtgaccctgggaaagccactgcccttcaaggagcctcagtttccccatctcccatgggtgatgggaccagactctttccttctctccttcaatcgtaaagccatcgacatcctggccaggaggtggcctccagtcacctttatcggttcatttgcccattcattaaatagttgtggcacctttcctgtagcgggtggcatggtagcccccaaacatctgtgttcatggacccaaagcctgaggaccaggcaatgaggtcttagttcaaacgagagcgtttgcagatttaataaggtaagtaaggatcttgggatgagattacccaggccctaaatccaaggacaggcatccccatgagagacacacagggggaggccacgtgaagacggaggcagagatggagggacgtggacacacaccacggatgcccggggccactgaagctgggagggcggggaaggatcctcccccagagcgtgcagagggaggggtccggcacacctggatttcggactccagcctccaggactgtgggggagtaagtgcctgttgtttcaagcctctgagctacggcagccacagcaaacacacaccttcaatgtgcaccatctactggcagccaggggacagccactagagggacggctcatctttagcagagaaatggacccgggagggaagggacctttggggctgagggttccaggagctgacagcctctctgccctgctccctccaggccccagctgggccagtgtccttcagctgctgtgggacagcacctgccgtcttcacgctctttccacagcgcggggtgtggggagggtggccgtgcatttcaacaaccatcctcttgggattttgtcaggagtggcctggcgggcccaggcgctgtcctgcgttggataccgcacgggtccttcagcaacacctgagctcgcgggagtctcaagtaaactctgcatgtcgcaatgagtttcagcaaagcctcaagttaaatggcttgtgataaaaatattaagcacattatgactgcaagacgtgatctcgtcaatgaaggaggctcttaattatttttgaagagaaatatcaacagtgtcagatttaaccgccaaactacttaatataacttccgcccaattttgcagatcatgatccgctcgattaacgggcaggaggtaatggatggagcccgccatgctgctccgggtgccgctgctgatgctggggaccgagccaggatggagggaggggcgtgcacaggagaaacctggaactttccctgggaatagaccctgcaggggaaagccctgtcccagcgccttctgaagtgggctgcaagctgcattcaaaggggcttctcaccccagactgagggtgggagcgagggctgcgaggctgcaccctggagatgcagccaggccaggcactcacttacgctgccaggcggttcacactcacagcgcgtcctgaaccgccttagaggggccgtagagggcggctctctcattcacaggtgctgagtttgctgagcccctccgtgcttcttgcttgctccccgcactccagggtggaggtcctgctatctcctctctgcagatgaggagttctctcatccgaacctcacggctcaaggaacagaaagctggaccaacggtggtcaaatacagtgggcgcttaactacctcatgggagtgaatggaaaggagttcccaaggaccccgggttctagccccagggccctgtggatggatctcacgtggaaagggggctttgcctctcaaggatctggcgatgcggagagcagcctgggttatcctggtgagtcttcaatgtaaccacgaggcagaggaaaatttgacagagaacagaagagagaaggggatgtgtcccggagatggagagtgcagtgatagggccacagccaaggaccactgagtgccaagggggctgggggaggccaggactgactgcccggggcctctggagggagcctggcccactgcaccttattgcatccccatgaaagctgttgcagacttctacctcgagacctgtgtgagaatacagttctgttgtcttaaaccactaaatttgtgatagtttaattttttttcagcagccacgagaatctaatacattcatgaaaggagcctggaggtgggtggcaccggcgttgagaaggaggtaatgacatcacccagggccctggctcctttccctcagtcatccttgaatgttggctacttgttctctggctcctgacctcacagtcacaagacggctgccactgctccaggcgtcccatcctcacacgacagcctctgaagcagagagtgagaaagggtgggtgtggcttctccttgtatgggtctatctttcatcaaggaggaaagcctttctcagaagcccatcagtgcacttcccaggctacatccaagcaaggtcccatagctatcctgggcccatccatggcaaagggaataggttgacctgatgggcttagaccagtcacaggtcatctactgggctaggcccacgctccccaggcacaagcaggttctgttggcaaggataggagggggatgggggctggggtcagtcgcggtcatggagttgtggggagtgcctggaccgagagagtgagaggcaggatggctgcagtgtgacctcctgggtcccccaccacccagctgcccccacacacacccataaacacccatatttggagaggcactgcctaggatgtcctcagccactaccctacagggctccacacctttctggtaccacataggcaggcactctgcccacacaggtccctgcccacgggccctctgcgcacctgctcctccctgagtgtttccttccatgactcccaacagtcttggggggaaatcaggccccgtcactgtgacattaacactgtaggactttgagccccatcaggcccacgggagagcttcctcctcctcctgtttcctggggctgcctgggcgtttcagcttcactttctcttctgcacaggcatggagtggcatcacggttcaaagctggcagcccctggtccccagactgcaccgggccagttccagcttctggggcctgagaggcacgggcctcgggttccctgtgagaattgttcctggtgatagacctgtgggctctctgggggctgagcgagagccgtcctaacggggagatggcccatccagggccaacacggcacctgtgcgttctcccatcctccttcccaagggagtcctggccaggcccctctcctgtgtccgaggagtcttgccagccctcatggtctgtgtcacgatctgcagtagctgtcccatcagggctgatctggaaggagcctttcctccacatggcttttcccaagtcagccctcaagtgctgtgagcctggaccgcgcccctgtcctccaggcagctgcctgcactccacacccatgcgcgtggcagctctgcgcccagcagccctcctggtgtgatttttatttatttacctgaatactggaacagctgctttattgagattcattggtcgcaaggcttaattaaaataatgccacgcgtctcactcagcgtgggtcaccaaagcaaatgtttgttttgctgctgtcagttagggccacgtgtgatgaagcggcggctcccggcagggaaggcacgtgggccctgaccccctgcacctccctgggttgcacggattgggggttgctgagaaggagggagggaggccccagggagggcatttctggtgtcttatcaggcgcctggtgggtggacgaggtgagggccacggcagtggggtgggaggctgtggtaccatccaggggctgttccacaccctgcaccctcagagactcgacttgaaatctgagtcccaactccccaggggtggggtggggtcttctgctgccctccgataggggaagccagacagatagcccccgggcaggacacgggagggccctggagagggtcccagggcagaggagcgaggtgtccacagtaggaccgctgaggtggtccaggaggaggttcctgttgctgccataacaagctcccgccactgcagcacctccagctccacagagctggcgccttccagccctgggggacgggtgtccaaaacgcatcccaccgggtgaaggtcaagggtcacagggcggctccttctgggggctccaggggaggatcggttccttgtcttctccagcttccggaggtgccccccgccccctcctcaccttcaaggccagcagagtgcccctccgtcctccccccgactctgcctctgtcctcacgtctccaccctcaccttcctgctccctcttctgaggcccttgtgacaacatttagcgcccacctgggtcgtccggggccatctcccacctcggggtccttctgttagttgcatctgcaaagtccaggttcacaggttccagggtttaggaggagggcgtcctgggggagactcagcctgcctcaccccaggcattggctggcagagaagaggggtgtcaggtggaggacagtccgagggagaggaggaccccggacccagatcggcgaggctgtgaggaggggtgcagccgcccaccctggagagtggaatgccgggggcgaaggtgggggggcagactcggcctcacgttgggggcagggaactcagctgacgtgagcctgagtgtttgctactgttgcaggggcggtggagctagacggggccaggtgagggacaacgccagacagtgaggccaccatcagggaaaagtgggtatggggaggccggaggggccctgctggctgggtgctgctgggtgcggggagtggagctgcacaggccaggatcgagccctggcccaggaggagaggcccctgggcaggtgatgagcaaagcccagggcaaagtgaaaagctggggccttgcttcaaacattatgaggaatttcagagctctaaccaagcttgagttcctctgagcatgggcctcgccacagccatgaagccggccctggggctgtgctggccaggctgagtttgagaggcttgtgcaaccccaggaggggtgaagaggcctttctcccccagcagctgtgtgacctcaggccaggggccacacctggtctgcacactgcctgggagcacccagtggggctgtctgcaccagccgcccccagacctagaggagctcaatggggtgagggtggaagcatgagggagaagtggggagcctccttatggtgcagggggagcggggtacaggaggagtctgggggagctcccttatgggatagggagatgggatgtggaggagcccaggggaccctttacaggatgggaagacagggtgcaggggaagatggggagcaggagaagccccttataggagggggagacggggtgcgggaggagccccttactggacgggaagatggggtgcgggaggagtcccttatgggatggggagacggggtgcgggaggagccccttacaggacggggagatgggtgcgggaggagccccttataggacggggagacagggtgcgggaggagccccttacaggacggggagatgggtgcgggaggagccccttataggacggggagacagggtgcgggaggagccccttacaggacggggagatgggtgcgggaggagccccttataggacggggagacagggtgcaggaggagccccttacgggatggggagatggggtgctggaagagttgctgagcggcagtggtgaaggaggttggaggccactatggtgactgtcccaagagttacgttggagtgtcctaggagtagaggggaagatgcggctgtcggctgcgtggggtgccctgagagggccagcgtgatgctggggtgccttggcgtacatgggaggtgtcatcctattggcagggctgggccagagccgtggacagtgcaggacaaaatgggggaatgggacctgggctctagtggacagcagacggggctggctcaggctaggcccaggggtcagagcaggcgggatcctggggacagcagatgcacagcccgtatagatgcccaggacttgcttcatttgtgttaattaccttcttttgattttcctgatcaataaattatcccgacgtaattggattatttgcatggctggcaagaggtcgctgtgatttagcgcctggcatcctggcagctgcgtggggtcccattctctctgagctgtcggcctggtcctgtcctgtgcctgcaggatggggctttggggcctcggcctgaaccctcctcaccatccactgtactggctgagttggggctgctcccttccactctgaccgcatccttctctgcggcggccatcctccgtgtgccttcagggagctgccctgcctcccgcctcacacctaccacatcctctgctggccactggcctccctggacgtgaagtgcaggccctccgggcagccctcacaggctggctgctgcacccatctggggctcctctggtcctttggaaccggcctcagtgcctcctccccagcgaggctactcccggccacctggactcgaaggacccccaaccctctggctctcgtgattttactcttgccatggtgagtgccatgggaactggtttgcctgtagcttggaggtcagggcccccgtaggggtgtaagttccaccaggcagggagtcacccagctctggcaccccgtggagcaccggcccaggaggctcccgctgcctctccagccgctgtgtttcgaggtgcttccttccttagcgttttttcttggcttcagttggcgagcttggcagagctttatccaccctcgtggaggtcagatttccctttgccctggtaagtaaaaggcatgccctcctctgcactgtgcctctccccaccgcccttctcacccctagcggcttccctctgacaggtatgaccctctgtcccctgtggtctctgtcccaaacagccccatttctcttacccgtgaggctaccgggaggtcaccacccccagacttgtctcttccctgcggtctcaggcccagtgacccggggcggtcccgagggcagccactgttctccccgaggcagcggatgagggctccgcactttcctctctgaccctgagctttctcatccttttcattaggatcgggacaggcctctcctgggctgctgtggggaccccagcagatgggtgtgacaccgagcccaaagaaaggggcttgggacactctcagcccctctggatatagaaaccaccccacacattgtctgagcttggcccttggggagtgactgaggtgcttttggcaattgtgcagggacataggagcccgcaggggctgtcaggatgggctgggaggctggcggccacctgcatgttgaccagcacccacaggggcccttgggccttgcctttgccagttggagattctctctcgccaccttcctcctctcttccagcctcgtcttagggctgtggaggcccctccctgcctggggcctttacagtatatgctgtttgatcacccctaccccaacctgcctccatctccaacctgccccgcaggcccctgtgtcccctcgtccctccaccaccgtgccctgcacacccccagcccaggctttgcccagaagacagtacacttgtttccagaacccggatcaagaaatagaatgtttctcacccccaaagcccccataccccaacctcagaggcatccgctgtttcaacttcctacactgcagacaagttttctcccgcttttgacttccgtcagatggaccatacagcgggggcttccccaggtctggcttccttcactccacgttgagctgtgagcgtcagtcatcctgttcatacagcaaatgtttattcacattcgtcgttcgctgcatccctttatgactacacgccggctttgtatccagccgcccatccgtggacactttggttatttctggtttctggaattggaagcagttataaacaccttttacgtgtgtcttttggcaaaaatgcatatgcacttccattgggtctctatctaaggggggaaaagcagggcaatcgtacatatgcaggttcagtgtaacaaatgctgccaagcagttccacagggcatgtgccccaaacacacacctcatgtcctccttgcacgggacattttctctcttcccttttggccattcattttagagggggtgtcccatcgtcattatagctcacatcttcctgctaactaaggaaacttagcattttattgttcatacatttagtgggcatttggatatcttactgtgcgagatgtcagttcaaatattttgcctatttttctatctatttgtcttgctccagtttttaaaggattgatgtgttgggctttttaaaatctagatatgagatttttgtcagagatatgtatcacaaatgacatctcttagttgtcttttccttctcttaacaatatctctgatgaacagaagttcttaattttaatgtggtccagttaattgatcgatttttttctttatggataatgctgtttgtgtcccatttaaaaatgtttagaattctaaatcctctcaacactgggatgattctgaactatgcttctgacttgtgatgtactttctgtcctttgtttcagcagcaactcgtcaggcagggcttttatttcctcatagaaatcattgatcagaatatcagacaatacaggactgatgtcagagtcctgggggatgctggagacccccctccagggtgacaccaggtcattagctaactccctttgtctataattgtatataacagacacattccacctaacagatcatctgggatggatttcccatttcatcctcaaggataacacagcagaccttgcaaatgcctgctgaaatcacaatcacacgtcccttgtctgccagtctaaggaccatgacaaggaaagacaatgatgttagtctcacatgatcacctcttggaaaacctgtgtagtcagagggggagggtgcgggggcttaccagtgcttgtgaagcacgctggattttccgctcttctctggggctccatgtgctctgagttctgatattttaagaaattggcaggggcacttcaaatccaagagcaggcgcccctgactccgtggagccagttgcctagcaactgcctctcatgacatcatcaccagcaatagtctgggtacccgagacccagagcagtgagctttcaggggaggaaagagggccatgcagaaagagaggaagggaggatcactgctgactggccggtgaaggccagcagggcttcctagaggtggtgggatttgctgtgtgcttagggctgggttgaaactcagcagagataaggaaagtgtttcaggcttttgaacatgaacaaacccttgctgtatgaacaggatgattgatgctcacagctcaacgtggagtgaaagaaaccagacctggggaagcccctactgtacaattccatctgactaaagtcaaaagtgggagaaaactggtctgcagtgtaggatgtgaaaacagtggatgcctccgaggttgcggtacaggcagctttagggtgaggaatgtgaaatttcactcttttgtgaaaacccttcatccctctggtctgtgcatttttgtgtgtgtgcctgacactttaatctgaagttctgttagggaccgaggagagctgttttgactgggacatgtgaactagcacagactttccgtcatgtcacaaacaactacagaactgaagaaaagatacagagtgatgtttttggatagcggacagcaggcagtgcaggactgaggtccctgagaagagggaggctgatgaggccagccctatgagtgtcccatttcccgctcaggggctctgcccagaatgcaccacaggaccaggggcccccagtggagtgcagtagatttgctgagttgagaagatacaaactcaggttcagggaagtggccaggatttgtggggaagagcaccaaggagcagggctgtgtgatggaatggctggggtatctgcacagggctccctcgagcctgttctaatgctaacctgtggttgcatggggtaaaactctgcaaggccaggcaacagacagaggaaaggaaaagctaagcatttccagaatggacagagctgggagacatttaagctctggccagccagagagagaaacaccctttaaaacatctgtattacattgctcaggctgccataacaaaataccagactgggtggcttacacaataaaaaaatgtgtttcctctctgttctggaggatgggaaatccaagatcaaagtgccagctgggttggattctggtgaaggctgtcttcctggctcgcaactggccaccttctcactgtgtcctcacacagcaggggcatgatggggagaaagatctctttcccttcttataaggccacagtcccatcagattagggccccacccttgggacttcatttaaacctataggccctgtctctatgaacagtcacattgggggttagggcttcaacatatgaatttgggggacacagtttagtttatagcaacacttgagacattcagctgagaattcagagggccacgacttagcaggaagataaaccagccccagagtagaggctacactggcccatccctaacacagatgatgaaaaaccagtcttgaagttctgatcctggcagcagcacatgcctccctgtagagcaacccttccaaagatagcagccgtcaacactgaacatgagatgtgaaaatggctgacggcactggggaagacctcggagaaagcaggcagattctggaaggatgtcagctcttagaagaagggattggaactgagtaaggtccccattttaacagcttctagccaagggcagccctgtgtctacaccatgcaggtcacagagatagcctccagtccagtaggaaatatgcagcctccctggcttgaagacagagaacaaagtttaaggcagtctcagccacagaaaggcaaaaagaatcacttgcagaaaggaaaaagccaaaaggaggcagaccccaagccctgtgcataagctacaacccaggaccagggcagagcccaaggagccctgccaaggctcaggactcagggcagatttgagctgccatccaaagggaggacttttcagttcgaatcaaaccagttaattacctgttaaaacagtgaaaacgggtactcttcaatccagaggcattataacacctgtttacaaagtccaatatccaatccaaagtaactcaacatatgaggaaagaggcaaataggaaccattctcaaactgaaaccatccatggagactaatcccaaaatgaccaagatgtcgagctaaacagacaagcattttgaagctgctatttctacaatgcccaatgacataaaagaaagtatgctaacaattactgaatagattgcgcattgctgtagaaaaatagaagctataagaaaaagccaggtgaaaattctagaactgaaaatgtaaatctgaaataggaacttcactgggctcagcagtagcatgaaaatgacaaagaaaagaagttagtgaacttgaagacaaatcaacagaaatgatccaatttgaagaagagagagaaagaagaaaaaaatgttaagagtgttttagggacttatggaataatcatggaagcctggcatatgtgatcttgaagtgttagaggaggagacaggataaaatagggacttttttttttaaattttagaaatcatggctaaaaattacctgaatttgttgaaagacaccagtttacagatttttaaagtgtggaaaacccaagtcaatataaatacagcggaaaccatgccaaaggccattagagtgaaacagatgtaaaacatggacaaagaaagaatgctgggaacagccatgaaaaatgacacagtacacagtggggacaaggttccaggggatgctgacttcttgtgagaaggagaggcggtcagaagacagtgggaaatagttttataacaccaacctgtgctgtggggttggaggggagccctataatagtaaaaaccattcttaaagagtgaaggtgaaaggaagaaatgttcagataaaaataaacagctcaggagtttttgacaagcctgaccaacatggcaaaaccccatctctacgaaaattagctgggcatggtggcacatgcctgtagtcccagcttctcaggaggctgaggtgggaggattgattgagcccaagaggcagaggatgcaggagctgagatcccaccactgcactccagcctgggcaacagatcaagactgcctcaaaaaaaaaagtaaaccaaaagaattcttcaccaatgaatacgcaccacaagcagtgttgaggcaggttctcccaatggatgggaaatagggacgtgctgccagatggaaacctggcgctttggttcccaggacggagagaccatggtggttgagtgaaaagtacccagcaggtttaacaaggggaagaatctgcactaattctcccctggcttacctccggcatcacagggccggtgccccagggctctttccaatgcccagttcggagcccgtgtgcttctcataggtcttcaaggtggagggaaaagcaagaggccgggccccaggcaaaccttggaacacgcatgtccatggcaggttggtagagaacctggagacaggctggtcacaccagaggccggctgtggggtgtggggcaagggactctggggtttgggcttccagcgtggagctgggtccgggcatcagtgccagcattaccacccagctgtgccaccttaagccaatgtcctcccctctgggcttctgtgtaaattatagggaaccgatgatgggctgcgcgggccctgaggcagctccagcgctgagagcccggatatggcctgtttgcagctctagggttctctggctcttggagcccatgcagacgaaggagctgagcagagcaggtgccgggcagccatggttctgagtctgagcctctgtctcctccgtggtactgagaattgctctctgccacctccccgtgtccccagctatggtcctgctcttaggatgggtttgcagatcctgggggcccaggttgtggccgaggactgccctgtgtctggggtcagggctctggcatccgtggccagcaagaggggcttccctgctccctgagcctctgcttcttttggtagccacgacccactgtgaccggaggctcttttagaacgtgtgtataaccaccttccctcccctacatgctcacactgggtctggaaactccatctttctgcttcccctgacttctgcagtctgggtctgactgtctcgagggccctgcttgctagaagaggtggaatgggatggctcgccatagcctgaggtggccgaggagccaaggttggtgggggcatgaggggtgtaggaatccccctcccaccagtggtgcccagcccaggcacagaccccgtcagtgttggatgggggtgtacagttctaggtctctgaatcggacttggctctgcagcctccctcctggctcagcgcccccagagcagagccttcccccagcagagagggtgtgagggaggacagtgacagtgcaaaggggagctggtggcccaggagtggggggggcacatgggggagctcccctctcctccccagcccccacctgcaccgggcctcgcagccgtttggtccctgaaaaggcctccctgccccagcatgtgaatatggatgtgtgcctaaggactggaggtgcggccctaattagagcgtgatgactgcctcccgccgctgccgggagcctggggcgggcgtcaaaggggagcagcccgctaatccccccttccaagggcagcatctgctcccctccccttgtctctctgtcggcagccgtgagagccctggctatttaattaggacagaaagttcccccaaccttgggaaatgatttaatttcaatatttcctttgctgagcgtgagatccttccccactgcctgccccgtcctcaaaggcctttcatctgcagcccaccctccccctgcagaccctcgcactcccctctcattccggatgtcggagcgtttccaagggatcgcagggaggagtgaggctgggctgggggtgctccctggctgcgtgcccggcttcagcttcggctgggaccagctgctcgaaccacccctccagcctggccttcctgcaagcaccaccctcaatgccgcccggagtgctaggcagggccctctccaggcatccacccaggcaggagccaggcctgcaaaaagcccccatgaagccttggccccagagattgcgcctctgtagctcttccctggacgtcgccaccttcactaacgggcctttgttatcgtctttaatctggcctgactcattctgcccccagcatgtgggtgtctgcatgtgtgtgtgaatgtgcacatgtgtgaaggggagcatgcctacgcctgtgtgtgcatctgagtatgctgtgtacacgcaaatgtgcatagttttgtgagtgcatgtgcccacagtctgtgtcaatgtgcacaaatgtgcgtgtgtgcacgtttgtgtgtgtgcatgtgtgtgcatgtgtgagctgagagtcccctgaagtctaagcctgctttctcccaattctttttagacaagtgggcgctcatgtcctcagctgacacatccagggccagctccaggctaggcacatggcaggtgtggggtacactggcaaagcaaacatgtacatgctcaaatgaatggagtcagcccagcccaggcctggcaggtaggcagagggggtgggtggtggtgctggggatgctaagattgctggacttggggacagaaggcccagttgtagtcactctgtcccctgctctttccagactcagtgtccccatttgtgcaatcacctcaatcccagagatcagtgccctgtgcacagctgggaaagccaggttagcaaggatttctcgtgaccctggggagccggcccagcccccaggatggtcctcggcctgatttcctccagcaacgcctcctcacagccccctccctgagctggtcttcaccctcactctccagccactctcctccttcgtcctgtcctctcccatttaggacaaagatcagcgtcatcccagctctcagctgggagggcctcaagcccaggcacaggaggcggctaatgagaggtatcagctgggcggctctgccaggaaactcgccgccctgagcaatttcttaaaaggaaaattctaaccttaaagagtcctttgaacacgttgtgaatgaacaacggactcggtggagttggttcctcagaattactgggagatggaggttacagaaaagagaagattgatttccatttggtctcctgaatatatttcctgagttcttaaggagctgtttatcacgcctcacactgagggcgaggtgggaatccttggctaacaaattatgatcactgttattctccctcccctacccatcccccacacgagaatttatgcattttccagacaaaacgtgctttcgcagagaggcactgggtcgtcctcaccgcagtcaagtatcgacagtattgatcagacgctccccggctaacaggcaccaatgagtctgtgccgcccacggtgatgttctggcggctcgtggggaccccacccaccgtcagcctagcttatggtccccgtgcctcctgaccccacctaaagatgagccccagcaggggccctttagtgcatattcattccctgttggtccactcgccagccaggcgctgtgccagcacgggcttagaacaccagtcactcagaggacgctcaatgcatgcgtgcatgaacgagtgagggtgtgaatgaatgaatgagtataggtgtagtttgaaatagagctggaaacagaaagccagggccacgtgaggggaactgctccagcttgttggagatggcccttttgatccccaggacaggaatctgacattgatcaccccagagacccctctctgggcctcctgtcaggctcccggaggtcccgtgggccaggcgggcctcctctctctgtccccccagtgatggcactggaagggctctgaggacggctgaacaaggacgcatgactctgctgtccagaggcaccgctggctcctggtgaggagcttggaaagcaaatttgcatggaactttgagaattgctttctttctgttttatgaaatccttctctaaatgtctgcatattgctctcctgagggatagagggagaaaaatagcaattaaagtcttgtcatccgacttgttcaggccgttaagttgttcaatcttgcataagaaatctgctagtgtgcttaagtgggagggagcacctggagccggctgtaaatgtaaatcaatatgtaatgatatgcgcccaggctgcacggcctgtcacttgcgggcgcaaccaccaggggcccaggtgtgtcctccgtgtgcgcctggtggagccgggcctgggcccttctgcccgcagtggtctaagcagacggagagaatggtcccatgtgggcacaccctgtggcgcggcctctgagccatctccctcttcaccagtcttgctgggaagtccagatgaatcacatttggaagaagctacttgctgggccattggcctggacaaacacaacggcattcctgggcagcatggccagggcgtgggggctgcgccaaagtgccaggccgccccctcgcagcccagcagggtcgggtggtggtgagtccaggccccgggctccgatgggagatcggatggggcgggcttgccactgacagacagatgtagagccgggcaggtgggcaggggcaagcctgggtctttgaggtgcggcagatgtgaacatcccattttccagaggaggaaggggaagcagaagcgccctgtgcccctgaggtccctctctgctgcctcccggacagctgtccgtggcaggctgggagccaggcctggtcctcactttatgtccccattttatggcgtctcaggagaaggatataaagctggggagattcatcccctttgcaagaggttcatttattttgacacttgtggtttagtttcaattatttatcataacactagagagggccctgataaaagcacccaagtgtgtttaacagcagccacggtgagggtgaccagtggagcaggcacttggggaaggcccctggggaccagggcaggaaggtgtgggtgggagggagcccctggtcgagggagcccgcatgggctggacggcactggggttttcctcttggctggaaacacaggaggtgaaggagatacgctccagcgtgcttggaaatgacaacttgttccagtgctgtctgcagagccagatggcagccaggaacctggcgatgggattttaggagcgaagcttccttctcttcagtggatacagtttttccacctgcttgagcttgagcgccaagtgggaaggcccagcccctcggctttggtgagattccctcagcctgtggcatctgcactatctgggcacccacctgccctcacgtctgtccatctgcccacttacctgtccatccgtccacatgtctgcctccactggtgacggtgcctgcagcagacgccacatggggatggccgacatggaggcgcatcaggcctggcactgcctgggagctcctggcctggggagaggtgcagctcccaacacaggaacagctagtaagcccctgctgggcccaagtactgttctatgacctgtccacgcaagggccatccagctccagggcaggcccattgacctgcatcctgtatgcagacaggttcaggccgagcctgaggacggactcaagccaagccgctgggtggtgtcctgcctgacggggcctcctcctagacactcgccctcagacatgggggctgaggtgcccgccttctcccaggggccatgcctcccgcccttcccaaggctacacccttactgcctggttgtggagaggttcatttctgagccatacacagcccctccctgggtcacacccatcagctctgggcggaggaaaagtgggcatagggggaacacagcctgcctgttcctccctgagcggctgggtgtgtgtggctccatcttccagaagaggcagactgagtgagatgggcgtgcagaaccagccagctctggcatttcctacggcggctgggaaatcggaggctccagagaggagagggcctgcccggggcacacagcaaggtccctggctcaggaagcacacacaatggcttcctctggccccggcaggggctggggtgcttggagggccccttatgcttcatggccccgcagcgtctgccccaaaacaagccaagatggatgaaaaatcgctggcgaaggtcactacaggacagccgcggaccggttgattgctcggggcggccctcgccccgtcggcgactccatcggcaacttcgccgcgctctgatttatgatgggaagaaaatggtcccctgaaccgccaccggctctggtttgggattctgtgtgactctctgtgtggccggcccaccgtttattcacaccactgaagtgtgaattctatgaataaattttattatcttggggctttgggatgacaaaaacatgaaagcctccggaattggtgagatgcccgcctctcctcattacgtcggctggggctgggggcgggggccctcctgggagcctcatttagattttaattaaactgacttttcccaaacaatttgcaataaattagtgccaaccaggcttgcaacatccaggcgcgaggccgtgccaggctgtcacgggggacgctggctctcagttggggtcacccgcatgggaggccatgcacactctggacaggccggcgctggctcactatgctggccccaaggtttgcgtggccaggggtagcccaggcacacaccagactcccagctgacacctgctccaggagaggggagcggccatgtgctgggaggggctggcgtcttttcactgaatgcccacagcaacctggtgacgaagatgtcagcatagcgctcagtggcaccctcagggcagaggatgctgagcgcccaaaccgcagctttgaggatgcagtgtggtggagggtggccggcacggtgtgggggtgtcctcagcaccctccgccctggaccttcctgttccaggtggactgagcatcagtggggtgcagggtccaggacagacggaaagggaggctgggccccgggtgccagccgagagatcctgacatcccaagttccctgaacctcaccttgtgttagacatgtgggaaaaaccgaggctcagagaaagggaggtgatttgaaccccgggcttcttccactgcaggcccctgttgccatccccagcctgcccagggagcactccctcagccagcacatggccagcctccagtggccatccgtgggaaggagcagagctgctctgctgatgcccagagagatgtggggggaaaacctgctgctcctcggctgggagaaacccccagagtggcttgcctcccagtgacaacactcaaggtccccaggaagagggcgtgttcttaaaaccggaaaacagcccagtgcagccctggtgtgtgtctgaaggctttaggatactgaagcttggcccacaggccctggccttcctggagagaaggggcagggaggaagggaaggggccctggagggaggctgtgtgacctgagggctgggtttggccaggctggtgcaggctccgacagcagcctctctccaagggcctgaccctgacctccaggatgcgaggcccaccaggaagcccccacctgccttggccctgcctgctgcccacgtcggcagctcccacctggcttcaccacggcctcggggaagggggtccctgcatttgtgtgccccaaatccccgaacggcaggtatggaggtgacagccacagatgaccttgaggtggccccagggacctctctccccatcaaaggctgtgcagacaggcatcctcctgctttccagcatcgacgtctacgtcacaggtggaaggcacatcactctttctaatattcacaccgacagtggtccctttgttcttgattttcctgtcccgtggatttgtaaaaatgaatctgcgtcttttattgtggtcaaatatacataacgtacagcgtatcacggtaaccactctcgggcgtagtcagcggcgttcagcacagtcgcattcgtgcagccgtcaccaccatccacctgcagagcatcttcatcttcccagtcaaagtgccgttcccattcaacactgacgccctgttcctcctccaccccagccgggagaggcgtttatgttttataagaggctttggggctgcggagacgaacccccaggtttgccaggcccagctgtggttaattcaggtcacatattccaagttcccgatgaggaggatctctgtcccagtgaggcaccggggacagggtgcaggggacacaggcccttgccaggggctcggggaagaggtcggcacaggtagccaccgtcaagggccaccgcagagctcaggcaacgatgacgatccttccgttttgctcaatgctccacagtcgacaaagagcgttctggtccacacacgactgtgtgctcgtgcgagagccttggggatgacattacacagtgtctgtccatcaggcccacaggtatccagcaaggtggcgtctgcacatgctgagtgaggggaaggtgctggttgaggagggagcgaggctgtccccggccctggccagctcccaaagcgtccctcaaggccagcgatgtcccaggtcttggctccctcgtggctggattggtctggggactggtgcatcctcactctgaaaggctgctggggcctggactgggcacctgaggatgagaaagtcagatgcatctccctgggtgcctgctgccgccctcctgggagtttgtggtcataaaataggatcctgggaagaagcgactccagagggagggctccgggagagctggtgggctgctgtcatggccttgtggggctctgcagctcttggggcagttatgagcacagcgatatacggggccactggggctccatgtagctctcggagactctgagagaaggagctggccctttggagctggagagtagaaccagcctggctccccagtgtgccggctccagggaggccctgaggcgggcccagcaggccagtcgctgctgccatgggtgggcgtgcagtcggttctggcaagtcctgcctgcccgggaggcctggtgcacacactggggatataggacagcctcactgcttcaactgtggggttggtggcgggggtcacctttcctgctttacagatgagggagccgaattgcactggggagagccctggcccctagtctgtgtgtccaacattctagagcctgggttctcgaggctggtggctacaaggtggctattctagattccctgtgtctggatggtgtggccgcagcacccagcctgaaggctgatggatcccactcaagaacccggcctcctcatgctatgtgcacacagaggggcaaggttggggagggagaggggcgagtcccaggctgcaggtggagcgaccccaagctcccaccccaaacagcacagtccaggacgcccacccggaaggaagctgccaagagcttcagcacgtggctttgaaataacacagtgtgatttaacggcccgggtggtgtggaacagcggcacggtggctcctcagcagtggaggctccggtcctggctggtgcatctgctccggcagctggccgcccctccatccgcggccgtaacatttcaagacagttttgcttgcaaggagtcacagtccattggttttatggaaacactctctgagtttacttcccgcgcaggggaaagacagctgttttatatgcacttggaggaacacctaaagggttttagtgttaattaagttgggaggacggttcttaacaagcacctttttgtaaatgtcaagctgctctgctgtttcactgttgttatggaaggtggaaattaggcagcgccccctactccctcctgcggcaggaaagggggcaccacctgtgtgtgctggggcaggtgtgctgacaccggcttgctcagtagagccacttcctggaatgatccggaaagtataagggcagcccaagagggcagaaaagccgcagcatccagagagtaatggggaggctctgagtgttgggggctggtctcagggactggctccatctggggagagctcacaatgtgagggctgcagacacagctcccacccagagccctggcaggaccccctcatgggcaggtccgggcagcacatgggaatccctgtctcagatggtggatgccagcttgaagctcccaatttcatctttagatttgggcctggacgaaaagtccgacgtgcggggcggtcagcgcttcggctgcggtgggttcccgccccttgctgcctccccaggatgggttcttggccttctggagctccaggccctacccggtttccccctctcatcaaaacatgcgaccaggccatgtttgcggggaggccagtgccccacagcccctgactgtccccggtggggcctgaggtcgatcaggagcagggagagatgaggcgtgaacacctggctgtgagctggtccttccacgtggaacaccctggatggatgggggctgcagatgggccccggggcacacgatggggaaggggaggctcccaggagtatcttcagggcccacagggaacccccagggaaggggcttggacgggtggggctgtggttcccgagggcctggaaagctgtgtggacctgagggtgtgctgggtccaagcccagctgattccagcgggtgggaaaccgtgtgtgaggctctggacggcctgtggacagggcagaggcccgggatgtctgggaggccgggtggggacacagcctttccctgtcggctcaggagttggcaccgctgaggaaagggggatgttcaacaaatgagcttcagagaaaccccccaacaccactactcctggaggaggcatcctgaagactgaaatgttcccgggtctccagaaaggaatcctggggccagcactgtgtgggggcagctgacctcccagggccactgctgtcgctgcacccactggcagtgggacaggagcctgggccaggacccagagacctgagtcatgtcaaccccaccccctacccccaatttcttgaccaccggggccttcaccagacctgcctggctccggcctctgtcatgtggagactggaagtttcagggctcagcctgggtgagcacgtgggagccctgcggtgagtgggggtggaaccccggactccagggacggcgctccaggaggggtctcaggcacaccccaacctcccagcggccgtgacgggcttggaggcctgtgtcaggccacagcaggccaggcccggtttccggaccctgctgagagccacagacccaatgacttctgcagcttgccccgtgaatggagctccatgccaaagcttggtctccagggtgctgcttctccagcaccagcggctcccaggcttgcaggggcggcgtggcctgggccagctttcccagccattgttctccctgtgtgaaaaccccagggctccccagccggcaccaccacacccctttgcctttcccctcctgcggcccctctgctgggtcacagccttggagatgggcctgcagaggcacccacacaccctggccagagctgacatcctaagcaggctgacaaccagcctgcaggctgaaggaccctggagagacctggccaggctggaccctgcaatcagaaacagaaggcccttctagtgggggaaactgaggcccagaggagggtagaagactgcccacagctgcccgagggggctgagttctgagtctgggctctgggtggcctgagcaagaaatctgctcctgggcacccgcggctgtgacggctcctgtggctgggtcctggaactcctcctgcctcaatcatcgattgggcagaaggtctggagcatgctgggcctggctgctgcctgggcacgagtggggatagcttcagtgtcacctcagtcaccccaggagccctgcgggatggctgccccacttcacagatggagtcttgagagagctgatcaagaacggggtgtgggcctctgtggtttccgcctcccggatgccccatgcctctgtgtctcagaggtgcctgggcctctgggctgctgccaagtccaggactaagtgttcttccagagccccagatgcatccttctggtgtgtgtgtgtgtgtttgtgtgtgtgtgtgtgtgtgtgtgtggtctctgggggcagtggtaggagcctgggttgcaggggctgtctttgctagatctcaaactcaaaggggaccctctctctggttgcctggggagtctgctgccccgccacccccccgcaacagtcctgcttgctgctcctgtgccttcctgcccccgagccccgtccccagcccctttccctgcccagccctctctgctgccttccaggcctgctctcttgacttcagaggatgagactcgggtctgccttcaggctcccaggggaagggtcccaggagctgcactctcctccctgcctgacagtgcaggaggaggtcgatgccgtaggaggagggcaatgccccggcagcaggtgctctctggctccagctccccattcgtgcaccgcctcagccctgcaaagtaggttggtgcagtcttacggggggatgtctgcagccaggcatcaccatccgcagccaggcagaacgtgaggctggtgctgtgacctgggccagcacttccctcacactctccttgtccttccatgcctggcctcagtgaggaagggtcctcctggagatggggctgggcagacgtccctggagggtcccaggaaggctctgaaatctggcacattctgcaacctatgttccaaccactgactccaggaactggtgcatgggctgaagcaatgaagaaaagtcaccgtcccatgaggcaaagctgatttaaaagctcacttattcttagtgggaaaaatggggttagcaaccataacatttgaaaaccaactggaaataggctggtaaataactttatggaattgttggttcgggaattatgttaggaacttggagtctgtgattatcaagcaaaaaatgtctcagcatttcaggccagggtcagggagagggtaggggtgggaatggggtctatagaggttataggaaaagaaatctgagtggttgtttaggagactgaggagactgaaaagaccctgaaaccccacggaggtgatcagggacactggcctgccctgagatgcctcttccagtgtgccttcctccccgctgccctgcccaggccagctccctggaaacccactaagaggaagggtgtcttgtgaccagccacatcacgagatgtcccacatcgcagatttcaggtgcaaggattgaggtgtcacagcaaacagaggaggggctggggtaggtgtggttctacagcagctcttaaaacagaataaacaaaaactacaagcggtctgccacggtggctcacacctgtaatcccagcactttgggaagctgaggtaaaagaatcacttgagcctgggagtgtgaggctgctccctctggtgagctgtgatcacaccactgtactccagcctgcgtgacaaagcgagaccttgtctctaaagaaaacaaaacaaaaaccaagtgtaatcaaccttgcccttgaaaatgcgttagtccacccaccaggtcatctggaatctatcttgggataggtggtgacctggtaggaccaagggtcttccgaggcactgaagaacttgggttttgctgtagatctgagtggggagttttgggaggaaggggcgggaagtaccttgatctcactgccagggcccctttggctgctgaggggacagcagctgaaacaggacgggcagtgcacgtccagcgaggacaccctggccgcaggtctgcccagcgacaggaggagggctgcatctggggtccgtggtggaggtggacacagcggccagcttctgggagcgttttagagtgaagtccacaggacgtgtgtgagggagtgagccggcatccagggcaaggtcctgagattcagacggtggtgctgtttggcagtgaccctgggtgtgggcgtcccgggtgccggggagagctcatcttcagaaatgaggaggccgggggtggcacagactgtccacacaggggttctgtggcctggcgtgctgccagtccagagatcccaaaaaaacctgtgtcccggctgctgtccttggccctgctctgacccctgctctccccgctgcttttcagaattgctgctccgtgaatttctgaattgcagtactcgctgtgcacctgtctcttccttcgggagccattgtcaggtgggattgcgtaaatgtcctccatggcgtgaggccctgactcacctgaacaacattccccagtgagcacggagcagcagcccgcccggctcagcagtgccttgccctggccctttctctcctcgctggttcatctgcattaaagaaacagaaagcttccttcgctggcccgctcattgcctgtcttctctccctgcctcagctgcggtcaggctccaggtgagctgcacctggccgtctcaattacactgcttctctggcatcggataggaactctatggccaacttacccacaaggtggtctgcaatatctttgaataaattaatgattgaatgaatgtcttagtccatccaggccactacaacaaaacaacacagatggggcagcttaacagtggacattcattcctcacatttctggaggctgggagtccaaggtgaaggtggcagcagggttggctccagagagggctgcttcctggtccccggacagcctccttcttgctgtgtcctctcatagcagagagaggatgttctgtcacgggccctcatgacctcctctaagcctcatcagctcccaggggcctcacttgcaaataccatcgcattggggtcagagcttccacataggaaacatttggtctgtagcaacgagtgaatgaatcattacagatttctctataagaccaccaggtcttaatgtattcaaagatattgcagaccacctcttgggtaagttggccatagagttcttatccaatgccagagaggccgcgtaaatgagacggccaggtgcagctcacctggagtctgaccgcagctgaggccgggagagaagaccgacgacgtctgagtcgtcaatgttgtgaaagatctccagagtgatgaaattaagggtatttatttctttagttgttgcttttgttgtagcaaacaaaatgaaacaaacacacatgcacacaaaacgaccaagcaaaaagtgtccgctacttgttaaagtgaacctctagtaaagttgtctctctttttgtcaccgaggatgagaaacagagatgggaattctatcctcatggaaaacaggaggcacccacaactctgagcccctgagagtgtgaaggccttgccgagtgacctcgctgctccagggcgaggcggaggccaggctgcggggctgcacagccagccagggaagctccccgccccaggactgccctcccacacactgcagacagttgtttcgggaagaactcactttatatgcacaaataaacaatgacagaaaggaatgaaaatagtgtccactgaaaacattacaagaaaaaggaagaaaataatagaaaaggtaaaaagcaaagacacaaaaaatcctcgcattggggaagatgatggaaaccttcttaacaatcagaaacttaacgatctaaatgaaaatgtctttcacgtaaaacaaaagccaagacagacttcaataagaaacaaaaagatgataggagatttcaaaaataggcaggcagagctcaagaaaagaagcagaattttaaaaatcacaaaatgaaggccacactagaatcaaagaaaaagagaatagattctcctaaaaccattgccagggatgtggagtcaagcttggaaaaagtgaaaaaaattcaccagaaaagaataaagagttgcgatggtttagaggaaaggatagaaaaggaaaacacaaaatgccgacacaacacacacataattggtggccttgcaggagaaaatcaaatataaaagaaaaataattcaaataattcaagaaaatgtggtgaaactaaaaaagatgaaatctatggattaagagggtatatcatgtttctacaaaaattggtgcacttgatcagcactgagacttgggggtcaaacacgaagaatttgtttggcaccgaggcaaaaatatgaaggccctgacatgagaagagaagtccaagctggcttcagattttctacggcaacacctcatcttagagaagagggaaataatgcctgcaaaatctccaggaaaagaaagtatgaaccaagaattttatatcagagtaaaattttagaacagaataaagctgttactcatgctgaatcataaaaaagcgcttctgaaaatattcacaaatggaggaactcttgtctactgaagttccttttaaataaataaatagagaatgaattttagtccaccaaaaggcaaatgaacaggctgtgaaggactaggtcaaaacaactgagagacttaggccgtggagcgttaagtagtgtggagtgtgtcagtggagacaggcggcagagctttggtggcctgtgacaaataaatccggacagctcctcctctccctgtgggtgcagccactcacccaggaagtccacttccctccacctgactctaggctggcctcatggcttctttggccaatccaatgaggcagaaggggtgtcttgtgagttctggaacctgggtcttagggcgtggtagcttcaattttcactgtcatggcaaatcctgatgccggggcgccttctgatatggtttgaataaaatctcacctgaaatgtgatccccaatgttggaggtggggcctggtgggagatgtttgggttatgggggtggatccctcatgaatggcttggggctgtccccatggtagtgagtgagttctcactcttaattcacacaagagctggtgttaaaaagagcatggcacctcctcctatctctcttgcttcctctcccatcatgtgacattcttgttccccttccaccttccatcatgagtggaagcaacctgaggccctcaccggaagccgagcagatgccagtgacataattctgtacagcttgcagaactgtgagccaaataaacctgttgtctttataaattatccaagctcagatattcccttatagcaacacaaaacagagtaagacatcttccctgcgctgctcccgccaccccttctccccggagagcagcttctcggaaaatcacctgcacctgaatctttggctcagcatctgctctgaaaaacttgatctaacacggcatctaagatccaaaggaagttagctcagcctgacgccagctttctctctaaaagcacccaatccaagcacatggcctgtggcaggatgtggaagcaatgcccctgggtctcaggacactcagggtaggcaggtggagagctcttagtatggcaggagtgatgggggtgggggtggggatgctggaggtggtgctgagaacacaggtggcacaaagacccagtccactcctcctgtgacctttgccctccagctcctgccaatcaacttctcagtcagtgtctaggcccagccctctattgcctccgtgctgccatggcctccctgtccatctcccaggcaacagaggagtcggtctgaggcctccagcctcacagccagtgtagttgcatgttaggtaccacttccatcctcggctgtcaaagaacaatgctccttatctgaagaatgtggtctggagataattagttctaacgggacacagccctgtggctgctgtggatggggctttgttgtggctcaacaatgccaccatcagcccagatgtcgtgcacaggcttgggcaaaaggcaggtgactgcagactcacaggggctcaagaagcacaccacatgggagagctgtggagattcactaaaggatggaactaaacagatcgacagagacagactaaaaaacagcctcttcagcctttgtctgcagtgtgcctaatgcctccagccaccagcaaatcaataacaataataacaaaaccatcaccagtgacgacagggggccctcatcaggcactccacccatgaggcactcacagtaactcgataaagatgatgcaaattacatatatccctattcataggtgaaggaaaggaggtgggcagtttacctgacttgctcccagtcctggaattctgagcagtgaagccgagattcaaacccaggatgcctggctgcaaagcccacacatgtgcacagctggcaccatacccacccggtgctgcccacacatgtgcacctggccccatactcaccctgtgctgcccacgcaagtccccactgatatggtttggatttgtgtccccacccaaatctcatgtcaaattataatccccagtgttggaggaggggcttggtgggaggtgactgaatcatgggagcagatttcccttttgctgttctcacgatagtgagttctcatgagatctggttattttaaagtatgttgcacctcctgcttcccagtcttcctccttctctggccatgtaaaatgtgcctccttcctctttgccttctgccatgattgtaagtttcctgaggcaccccagccatgcttcctgtacagcctgcagaactgggaatcaattaaactcctgttctttataaattacccagactcaggtagttcttttttaaaaatttttttccttttaatttttctttgtcatccttgtacagggaccatgctaatgttctctgtaccattccaattttagtatatgtgctgccaaagtgagcactcaggtagttctttatagcagtgccaaaattggcaccaggaagtaccaggaagagaagagaagagacctgaaaatgtggaagcagctttggaactgggtaacgagaagagggtggaagagtttggagatctcagaagaagacaggaagaggagggaaagtttggaacgtcccagagatttgttgaatggttgtgaccaaaatgctgatagtgatatggacggttaagtccaggctgaggaggtctcatatggaaattaggaacttattgggaactggagtaaaggtcattcttgctatgctttagcaaagagactggtggtgttgtaaccctgctctagggatcagtggaactttgaacatgacagtgatgatttagggtatctggcagaagaaatttctaagcagcaaagcattcaagatgtggcctggctacttctaacaacatatggtcatatgcatgagcgaggagattatctaaaactggaacttatatttattaataaaagggaagcagagcataaaagtttagaaaaattgtagcctgaccatgtagtagaaaagaaaatccccatcaggtgcagtagcttatgcctgtaattccagcactttgggaggctgcagcgggtggatcacttgaggccaggagtttgaaaccagcctggccaacatggtggaaccccatctgtactaaaaatacaaaaattagctgggcgtgatggtgcacatctgtaatcccagctacttgggtggctaaggcacgagaatcacttaaacccaggaggcagagattgcagtgagccaagatcacaccactgcattccagcctgggtgacagcatgagactcctcaaaagatttaaaaacagaaaaacccattttctggggaggacttcaagccagctgcagaaatttgcatgagttgctgaatgtcaacagccaagacaatggggaaaatgtctaaaaggcacttcagagactttggcggcagccctccgatctcaggcgtggaggcctaggagggaagaatggtttcatgggctgggcctagggctccactgccctgtacaactttgggacactgctccctgtatcctagccactccagctttagccatggccaaagggccccagatatgtcttagatgatggctccagaaggtgcaagccattcagtgttggtggcttccatgtggtgttgagcctgtgggtacacagagggcaagggctgaggtttgggagcctctggttagatttcagaagatgtatggaaatgcctggatgtccaagcagaagtctgcaacaggcctggaactctcacggagaacctctactagggcagtgtggaggggaaatgtggggttggaggccccacacagagtccccactggggcactgcctagtggagctgtgagaagagggccactgtcctccagaccccagaatggtagatgtactgacagcttgcaccacgcacctggaaaagccacaggcactcagcggcaccccataaaagcagccaagggggctgtaccctgcagagccacagggctggagatgcccaaggccttgagagcccacaccttgcgtcagtgtggtctggatgtgggacatggagtcaaaagacattattttggagctttaagatttaatgactgccctgctgcgttttggacttgcatggggcctgtgacccctttgttttggtggatttctcccttttggagtgggtgtatttacccaatgccattaccctcattgtatcttggaagtaactaacttgcttttgattttccaggctcataggtggtagggccttgccttgtctcagatgagactttggattgtggagttttgagttaatactgaaatgagttaagacctgtgggactgttaagaagggatgattgtgttttcccatgtgagaaagacgtgagatttgggaggggctggggtagaataatatggtttggattgtgtccctgcccaaaactcatgtcaaattgtaatccccagtgttgcaggagggcctggtgggaggtgattggatcgtgggggcggatttccccttgccgttctcatgctagtgagtgagttctcaggagagctggttgtttaaaagtgtgcagcatctccccccacccttcctccttctctggccatggaagacatgcctccttcccctttgcctttcatcaggattgtaagtttcctgagacctacccagccatgcttcctggacagcctgcggaactgtgagtcgattaaacttttctttataaattacccagtcttggggagttctttatagcaatgtgagaacaggctaatacacccaccttgtagcatgcctatctagtgctgcccacacacatgcccactttactgtatgcctgactggtgctgcccagacatgtgcccaccctgctgcattcccgccctggtaccactcagacatgtgcccaccttgctgcatgcccacctggtaccaggcccatgccgaccctgctgcatgcccacctggtacaactcagacatgtgcccaccctgctgcatgcctgcctggtgcttcccagacacgggccacgttgcagcatgtctgcccagtgttgctcacacacatgcccatcctgctgcatgctcacccagtgctgcaggcacagagacaaaaagctcagtcctgcattcagaagtttctggtccactgggggccagtgtggttgcagagctgtgaatagcgcatgggacccacggggaggtggcagctcagaacttccgtggagccagggatgtgggtggggatggcttccctagaggatcgcatccaatcgtgtccatgaatctgagcaaagtgagggggccccaggaagggcaggacaggtgggggcatccaagcaatgccagagcagagaggggacacagggcagttctgaggcacctgcgaatgagaaaggaagaaggaagaaccacattcagcctgggcgagcacagaggtgagaggatttgctaacagtgagcaaaggacatggagtcaaaaggcctttggttttgtttttccttcagatgcaaaagactcaagcatgtttatgaattgagggtaaaagccagaggagtaagtaagaggatgctgggggagcaggggcttggcacaggttctgctccatggcagcaggagggcaagacttggatcgcattagagctcaactgtgtgttatttacaagggacacttaatacattttgatgtacggcttaaaaataaaggactgatgtaggcatttgcagcggcaaatgttgacaaaaagtgccaaggagtgacaatattagtatccgcggaaaataaagcacaaatcattaagaaggacaaacagaccaatttatattaataagagttattataccccataaagttgtgatgtctaatacacagccgatacacacgttagatgtttatgtgtccaacatcgaataccgaaatatatcaagaaaacctgttagatatattaggtaaatagacaagacccagctgtaacgagaaattcaacacggtactgttgattcctgtcaaatcaagtgtacaaaataaataggactatcaagaatgtgaatcatataatttgtaatggagattctataagtattgtatatatgtcacactttacccctccctgtcatgaaatactgcttttcccccatgaacccatagaatataagaaacatatgaaaagtctgtttatctcattcgttagggaaatgcaaatttttaagaaataagctattgttcaactatcagataagcaatattaaaagtattccagttatcaaatttggtgaagatatgtagaaaacatactcctctctctgacggtagtgctcatcacaggccttcccccagccatgtgaccatgacttgctctaatcagtgatggctgagcaggagtggcaagtgtcacctcgttacagagaagccagcatgtggtccactgtgcttgcgtttctccctgtcacagtgaccaacagtggcccagagagagcgccctgcgtcttccggggttctggagtgaggactgtgtggggcagaagcacagccaaccacatggacatgaagcacgggtgaaaaaaatgtccttgctgttgtgatcactggggcttgggggccatttgtcaccacagcatcacccagcccttcatgatggatacagaagaccattgggtgttcctattaaaagtctagatgcttataaagtgcgacccagcaaatctacttcctagcaaacacctttaagaacacccgatgcgattctcctctgagcagctaactcccattgcccactgagaacacacagaagagctagtcaacacacagaagcaatctgtttaaaggtgtcggagaactgtggaagcaatgagactagagggactaaagttcagagagcagggacctctgagaggtaaggtgacgatcacagccacactttcctggggcctttgccaacctcccatggctggaagctgaggatccaggcatggcccagccagaggaacagtgctagggacaggaaagcaagaagagcttatagcatcacttgtgctggagagagaggggtggagacttaaagagcccaggcacacagtcacttgacatttgccaagttctgaagctgcaccgtgtgaaaagctaaaatctaagcagaaaccctctaacagcagagcggagtgtcccgaacaccacgtgtgccaaagagaccaagaccctgggcaggaggctccagggagcccgccaggctcgcatttgaactcactgaagcgttccatggtagagaagaggtgagcccaagaatgtccccagctgtggttctcagccactcactggatctggagggtcatcttcccattctgtctgcctgccagaagaatgggtgaatatttcctgatgcaggacatcatgtgttccttgtatagtttgtgtttatacatcatgtcccacaaccaataaaaaaaattgctaggcatgccaaaagacatgtggctaaaaaccaagaaggaaacacacacaccaagaacagaatcagtggtgagatagtggagtaacaaataaggacctaaaaataaccaggatgaaaacatgcaaaaaaataaaggaaaagatggggaaaataaatgacaacagaaaataattttaccaaagaaattgaatccataaaaataactaaatggaaattcaaaagccaaaaattataatatctgaaattaagaactccatggctggatctagctgcactttagatatagcagaactctgggttaaagaacgaaatgaacagtgaattaaaaaaatctaaactaaagcacacagaggccacaaatgaacagaagaaaagacacgtgacaccccgtaaaaatgtccattctatatgcagttgtaccccctaaaggagagaaggcacatttgaagaaaaggggattaagaacattccaaaatgaatgaaagtcatcagtccacagatttagagagttctgcagcaccaagcaagataagtgcaaaggaaaccacagtttgacacatggtggaaaaactgtggaaaaggaaaaagagaaaactttaagagtggctggagaaaaatgatgtgctgccatcacaaaagcaaaaaataacatggagagctgagtcctcaccaaaacagacagccagagacagtgggatgacagttctaacgtgcccaaataaaaagagaaatgcaactcaggagtctatactggggaacgtatgcctcagaaatgaagacatttcagcagaaatactgggaattcatcaccacaggcttgaatgaaagacattctaaaatgagcacttccgatggaaggaaaataacctcagacagaaacatggaaatagaaagaatgagaaggcggggggatgtaaatcctggtgtaaatataatagacattcactatgtgcgacagtagcagtgatgagtacatttaaatgcagggggagggtgacgcacaggctggcagtagctggagctccggcacctcagttctggcagagcaggaaatgggcaaagtctccattcacattgaacccttatatgctagtcaaggatgaatgctgaaatctctaggataactgtgaaaaaaatagtgaaggaatgtatacctagcaagatgagaggggaaaaaggaataatggaaagatttcagtcatcttaaagaaggcaagacgtggaacacgaagcagatgagtcaaacagaaaacaagtagcaaggtgacagcgaaccaaacacaaagaaattgtgttaaagacaatgggtgaaataccttgaggaaaaggctaataatgtcagatggcatgcaaaaaataaaacctagttgtaaggcacttaaaagacacagtccttgatatggtttggctgtgtccctacccaaatctcaccttaaattgtaataatccccatgtgtcaagggcagggccctgtagagatacttgaatcatgagggagtttcccccatactgttctcgtgttggtgaataagtctcacaaaatctgatggttttataaatgggagctcccctgcacaaactctcttgcctgctgctatgtaagacgtcactttgctcctcattcgctttccaccatgattgtgaggcctcctcagccatgtggagctgtgagtccattaaacctctttcctttataaattacccatcctcgggtatgtctttattagcagcatgagaacagactaatacactccttatatacttacataagggtgtcaatgagaagagtcaaactctgtaaaatatttgaagagatttattctgagccaaatatgagtgaccatggcccatgacacagccctcaggaggtcctaagaacatgtgcccaaggtggctggggcacagcttggttttatacattttagggaggcatgagacatcaatcaaatacatttaagaaatacattggtttggtccagaaaggtgggagaactgaaagtggggggaagggtggagggcgcaggctataggtaaatttaaacattttctagctgacagttgcttgcatttgtcaaaagacctgggatcaaatggaaatgttctggttaagataaagcattgtggagaccaaggttcttttaaagtcttacagaggctgcccttggaggcaatagatgaaaaatctttcctgttcgcctttaaagggtgctagactcccagttaatctcttcaggattgggagggcctggaagaaaaagatctagctatgttaatagagattctttactgatgcaaattttacccccaccaaggatgactttgcagggccatttcaaaatacggcaaacaaacatggtttagggtaaaatattttgattttctactttgtcatgtaatgttatgccagagtcagattggaaagtaagtcactcacgatatgtacggttaaataaattccatctgatgagaatttatggtttgtagggcatgactccccagactccttagatagataggaatttgggcaagttaaaaaaatcagagcttagtcctcaagggcacaaagcaggttgaaaggacaataaatgggaaaggtagaatatgtaaacaccaaccagaagaaagcaagtagagtgatagaaatgtcagacaaaacaggtgtgaaggtgaggtgccttgctcaagaccgacatgggcatgtactgaaagaatcaacactccaggaagctattacagccccaagtaagcatcaatgcatacattatgtgaaacaaaaattgaccaaacttgaagaagaaagaaatccatgttcatacagagagactttaacctgcctctcaatgcctcaatggctgatttaataagcagacagaaatatcagtaaggatatggaagttctgaacgacgcagttgacaaacctgacctaattgacaagtgattcagaccgctgcactggcaacagcagaacccacggtctcttcattagcacacaggacattcaccaagattgtcgcgtgctggatcgtggagcaagtcccaacacatttcacgggattgaaatcattcagagtttgttctctgtccaccatggaattaagctggatataaaaacataaatacaactagaaaatctccaagtgcttgggaattaagccatatgcctctaaatcataggccacagaagaaatcacaaaggaaattagaaaacactgtggactgttggataatggagatacagcatattgaaattgacaggtgcagttaaagcagtgcttagagggaaatttatagcctaatacgcacatagttaaaaagaagaaggctgaaaataaatgatctaagcttctatctgtagaagctgagaagagctaagcctagtaagaggggaaggaagaaaataataaacatatgacaaaaaacccagtgaaatggaaaacagatgtacattttgggaaattcacaagccaaatttggttatttaaaaagattaataaaatggatgtatccctaataaaagtgatcaaggggaataaaagagagaaaacacagccaggcgcaatggctcatgcctgtaatcccagcactttgggaggctgaggcgggtggatcacgaggtcaggagtttgagaccagcctggccaacatagtgaaaccccatccctactaaaaataaaaaaaaaaaattatccgggcgtggtggcatgcgcctatagtcccagctactctggaggctgaggcgggagaatcacttgaacccaggaggcggaggttgcagtgagccaagactgtgccattgcactccagcctgggtgacagagtgacagagtgagactacgtctcaaaaaaaaaaaaaaaaaaagagaaaacacaataaataatatcaggactaaaaagacattaacaaaataatgagaggatattataaaaatttgaagtaaatacagttgacaatttagattaaaagggtaaaccctctttctcccaaaaacacaatttatcaaaagtgacagacaatatttaatgtgaatagtttgatatttcttaaataaattgtatccactagtaaaatgtttctcatcagtaaaactcaaatctcaaattttatcagtgtatttttccaaacattttgggaagaaataacactgatcctacacaaaccattttatggaataaaaaaatgaaagaatgtgtcctaattcattttatgaggccagtataaccttgatatgaaggcctcacacagacacgagaagaaaggagaataataggccaatgtccttcgtgaacattcacagggaaatataggcaaattaaatcaagtgatacataaaaataatagtatatcggaaccatggaggagggtttaatataagaatgcaaaattaatcaatgtaattcaaattatataaaacagagacattataagtccatcccaataaatccaggatttgataaaatctaatttcatgaaaaaattgtttgcaatttggaatagatgtcattgatcttccttaaactgataagagaatacgctaaaatcttacagtaaatatcatgacagcaggaatggggcaagaatgtccactatcgatatttatttctcttccacataatagtgtagtttgtagcaactgcattcaagcaagaaaaataaattaaaatataggaaataaaaaaatcaaattgacgtattttgcagatgccatggctagtacatcgaaaagccaaactaatgatacactttttaaattaagaagtaaatttaacagtcactagttgaatttttatgtattgtaacaaaagttggaaaattaaaaattaaagcccactatttacaatagcattaaaaaatctaacatctatgacatctatgagtaaatgtaaccagagatgcataagacctctacactgaaaattacaaaatagatttttttttttttgagacaggatctcgctttgtcacccaggctggagtacagtggcccaatcacagcttactacagcttcgacctcccagactcaagagattctcccacctcagcctcctgagtagctgagacaataggtgtgtgccaccacaccctgctaaatttttttttatttattgtagagaaagggtctcttcgtatttcccaggttggtcttgaactcctgggctcaagtggtcctcctgccttggccaaggtgctgggactacaggcatgaaccacagcgcccagccttgaaaattacaaaatagttttgaaagaaattaacaaagacataaataaatgggaaattatattatgttcatagatcagaagagtaaatgtgaattctgaaaataatttacaatcaatgtaagttctgatcaaaatcaaagtttttttcataaattgataaggctgcatcaatcatgaagaacaaaactgaaggatttgctctaccagatgtcataacctgcattgtcagtagataaaatggccagtgtttggcacaagagtggattgatttaccactgtaataaattagagtccagaaaaagacctaaaggtatacagtcacctgaatcgtgggaaaagtaaaagttcactgagtagaaaaaaggtagtcttttcaacatagggtgctagatcaatagaattttcatacttttaaaatatattttgactctaaccttataccatatgaaaaatgaatttcagatggatggcagatctaaatgtgaatggccaaacaaaaacctttagaggaaaacacaggggtacattgttgtgaccttagagtaggcaaatatttcttgaataggaaacccaaaaacaaaatgataaatgtttgaggtgatggatacgctaattaccctgatttcatcattacacattgtatacatgtattattaaaatatcacgtacaattattacatgtcaactaaaaataaaaggggaaaagagaaaacacaaaaacgctaactaccaaaaagaatgataaagtgaaccatatgaaactttattttttatttttatttttattatactttaagttctagggtacatgtgcacaatgtgcaggtttgttacatatgtatacatgtgccatgttggtgtgctgcacccattaactcatcatttacattaggtatatctcctgatgctatccctcccccctccccctaccccatgacaggccccagtgtgtgatgttccccaccctgtgtccaagggttctcattgttcaattcccacctatgagtgagaacatgtggtgtttggttttctgtccttgcgatagtttgctgagaatgatggtttccagcttcatccatgtccttacaaaggacatgaactcatcctttcttatggctgcatagtattccatggcgtatatgtgccacattttcttaatccagtctatcattgatgggcatttgggttggttccaagtctttgctattgtgaatagtgccacaataaacatatgtgtgcatgtgtctttatagcagcatgatttataatcctttgggtatatacccagtaacgggatggctgggtcaaatagtatttctagttctagatccttgaggaatcaccacactgtcttccacaatggttgaactagtttacagtcccaccaacagtgtaaaagtgttcctatttctccacatcctctccagcacctgttgtttcctgactttttaatgatcgccattctaactggtgtgagatggtatctcattgtagttttgatttgcatttctctgatggccagtgatgacaagctttttttcatgtgtctgttggctgcataaatgtcttcttttgagaagtgtctgttcatatcctttgcccactttttgatggggttgtttgattttttcttgtaaatttaagttctgatattagccctttgtcagatgggtagattgcaaaaattttctcccgttctgtacgttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgccgaggttttcttctagagtttttatggttttaggtctaacatttaagtctttaatccatctcaaattaatttttgtataaggtgtaaggaagggatccagtttcagctttctacatacggctagccagttttttcagcaccatttattaaatagggaatcctttccccatttctttttttgtcaggtttgtcaaagatcagatggttgtagatgtgtggtattatttctgttctgttccattggtctatatctgtgttttggtaccagtaccatgctgttttggttactgtagccttgtagtatagtttgaagtcaggtagcgtgatgcctccagctttgttcttttggcttaggattgtcttggcaatgcgggctcttttttggttctatatgaactttaaagtagttttttccagttgtgtgaagaaagtcattggcagcttgatggggatggcattgaatctataaattaccttgggcagtatggccattttcacgatattgattcttcctatctatgagcatggaatgttcttccatttgtttgtgtcctcttttatttcattgagcagtggtttgtagttctccttgaaaaggtccttcatatcccttgtaagttgaattcctatgtattttattctctttgaagcaattgtgaatgggagttctctcatgatttggctctctgtttgtctgttattggtgtataggaatgcttgtgaattttgcacattgattttgtgtcatgagactttgctgaagttgcttatcagcttaaggagattttgggctgagatgatggggttttctaaatatacaatcatgtcatctgcaaacagggacaatttgacttcctcttttcctaattgaataccctttatttctttctcctgcctgattgccctggccagaacttccaacattatgttgaataggagtggtgagagagggcatccctgtcttgtgccagttttcaaagggaatgcttcccgtttttgcccattcagtatgatattggctgtgggtttgtcataaatagctcttattattttgagatacgtcccatcaatacctaatttatcgagagtttttagcatgaagggctgttgaattttctcgaaggccttttctgcatctattgagataatcatgtggtttttgtctttggttctgtttatatgctggattatgtttattgatttgcgtatgttgaacaagccttgcatcccagggatgaagcccacttgatcatggtggataagctttctgatgtgctgctggattcggtttgccagtattttattgaggatttttgcatcgatgttcatcagggatattggtctaaaattctctttttttgttgtgtctctgccaggctttggtatcaggatgatgctggcctcataaaatgagttagaggggattccctttttttctattgattggaatagtttcagaaggaatggtaccagctcctccttgtacctctgatagaattcggctgtgaatccgtctggtcttggacattttttgggttgtaggctattaattattgcttcaatttcagagcctgttattggtctatttagggattcagcttcttcctggtttagtcttgggaggatgtatgtgtcgaggaatttatccatttcttctagattttctactttatttgcgtagaggtgtttatagtattttctgatggtagtttgtatttctgtgggatcagtggtgataacccctttatcattttttattgcatctatttgattcttctctcttttcttctttattagtcttgctagcagtctatcaattttgttgatcttttcaaaaaaaccagctcctggattcattgattttttgaagggttttttgtgtctctatctccttcagttctgctctgatcttagttatttcttgccttctgctggcttttgaatgtgtttgctcttgcttctctagttcttttaattgtgatgttagggtgtcagttttagatctttcctgctttctcttgtgggcatttagtgctatagatttccctctacacactgctttaaatgtgtcccagagattctggtatgtcgtgttttcgttctcattggtttcaaagaccatctttatttctgcattcatttcgttatgtacccagtagtcattcaggagcaggttgttcagtttccatgtagttgagccgttttgagtgagtttcttaatcctgagttctagtttgattgcactgtggtctgagagacagtttgttataatttctgttcttttacatttgctgaggagtgctttacttccaactctgtgttcaattttggaataagtgcgatgcagtgctgagaagaatgtatattctgttgatttggggtggagagttctgtagatgtctattaggtccacttggtgcagagctaaattcagttcctggatatccttgttaactttctgtctcgttgatctgtctattgttgacagtggggtgttaaagtctcccattatcattgtgtgggagtctaagtctctttgtaggtctctaaggacttgctttatgaatctgggtgctcctgtattgggtgcatatatatttaggatggttagcgcttcttgttgaattgatccctttaccattatgtaatggccttctttgtcccttttgatctttgttggtctaaagtctgttttatcagagactaggattgcaacccctgcttttttttgttttccatttgcttggtagatcttcctccatccctttattttgagcctatgtgtgtctctgcacatgagatgggtctcctgaatacagcacactggtgggttttgaatctttatccaatttgccagtctgtgtcttttaattggagcatttggcccatttacatttaaggttaatattgttatgtgtgaatttcaccctgtcattgtcatgttagctggttattttgctcattagttgatgcagtttctccctagcatcaatggtctttaaaatttggcatgtttttgcagtggctggtactggttgtttctttccatgtttagtgcttccttcaggagctcttataaggcaggcctggtggtgatattaaactttaaaaattcctgctcatcaagagacataattaagacagggaagaagcaaaccacagaatgggagatgctatttgcaacatgtatctgacaaactacttatgcccagaatgtgttaaaacccctatagatcattaaaagaaggacagataaaccaataggaatatcagtcaaagatttaaatagacatttcagaaaagaggatattcaaatggccaataaatatatgaaaaatgctcaatgccactggttggtagggaaatgtaagggaaaaccagtattaggttagcattatacccaccagaatgactgaaatggaaagatgaaaaaccacattttgacaaggctgtgatgcaactggaactctcacacactgctggtcggcatgtaaagtggtacaaaactttggggaaatatttgacaaagtctgttaacacttgatgcagcacttacacttctaggtatagacccaacagaaatgggtaaatattttttaccaaaagtataaacaagaatgaccatagaagcactatttataacaacccaaaactggacattaaaatgccacccctccgccaaacagtagaatgggcaaataattgatggaatgctcacatggtggatgctgggtgtcaatgagagtggtgagccacaactacacacgacagcacgtatggaccttacaagcaaactattgagtgaaaggaccagataggaaagaaggtatgttgaatgattccattctttaaagcttgaaccaggcaaacatagtttaatatgtgctgttagacgtcaggattacagttgctcttgggaggagacacggtgagcagaagaagatacaggagaggtctctggaggaggctagcagtattctgtgactttatgtgaatactgctttcacaaatgtatttactttgtggtgcttctgtgagttgtaacagtatgatttgtgcacattttcatttgtatggtatatttcaaaaaagtttacctgaaaaacatagtgcatgtgcatgtggaagcatgtatgaggatgttcattgcaatgctgtttacagtagagaaaaattgggaacagcctaaatgtccatcaacagggaaatgattaaatcaattactatctattaatattgtgaaacactaggtagaacttttaaagaataaagtagatttaaataaactggcaaaaggcaaatatggaagctatgttgacagcaacaaaaccaggctgcagaacaatacatataattgtttagacatatatgagtcaagttatagatttttgtaggttatatatttatatgcaaacacatagaaaagtgccctaaagaaagcacaactgtgctatggtttaaacgttgacatcccccaaaattcatatgttggaatctaatacccaatgtgacagtattaaagggtgagacctttagaaagtgattaagtcaagggagctctacctttatgaatgggattaatgcccttataaaagagggttgagtgagctccatggccccttccaccaagtgaggacacagagaaaatgccatctgttaggaagagcaaggcctcaccagacaatgacaatctgccagcaccttgatcttggacttctcagactctagaaccatgagcaatacatttctgttgtttataaattacccagtctaaggtattttgttatagtagcccaatggactataacaaactgtaatagtgattttctggggaaagcagactaaaattaggggtggaggtcaaagttattttaggtttatttttgtttgtgttttattacaatgacaatataatcatgattacttgagtaattaaaaataatatttcaaatggtaagtgaaagatttccaacaggacatttcctagcaagaaaatgcatacatatacacatacaacttcaatatattcaaaaagttaaaattgtacaagcaaaactactttaccttgaaccactagaactagaaattattaataagtctaaataaaaaacccttaccaactggtaatttaaaggtacttctgtaaacattcgtagaaaatgaaaaaatatttttcaaactctagaatagcagagaaataatgaaattgttaagaacaaatgggtttcaacaaagctgtcctcaaagatgaagtcacatctttaaatgctttcattagcacaaaaaaaaatcaaaactttcaagtcaataagttttttaagcagttccaaggaagaacaaaatagcagatgatagcagaaattattgaattagaaaagggaaaaatgaggattagtaagtacattaagagctaagagataagtaaattaaaaagttaagtcttttaaaaatctaacacgacagactcaactctggctaatctattaatagttactacaaaggggaaagcataagaaatagcaattaaggaacatttaaaatcccataataaagacagtaaatgtgcatgcaattttaaaaatgaacaaggcattatttgcatggttatatgatgataaatctgaatggaaataaatacatgatcaaagttaacattaaaagaactgagcaacatgaataaagaattattcttggaaaaatgtttaaatagaaaggaattacatccaaaagaggtaccagactcaggcgttcttgttggtgagatgctgtgaaattttaaggcataattaattccaaaagtatgtatcagttttagaaatgtgtaaatttggaaaagtaattttataaaagtagagtaaccctgaaaccaaaatctgacaaatataatccaccatctgttcttcagtctacaagaaatagccattacattaaaagaagtttccactatctcataagatttaccaaagaattaaacaaagtcaatagaatctttaaagcagaacttctcagagcctttgatatgcaaatgtgcattgtggttcttaagaagggcaggaatacagcctgcagtgtttcccaattttattcgtccaagcaaaaaaccatttctacctggaagcatctcttgggagtggtgatctggggtacatcctttgggaaagcctgctatggaatataaaactgcatgcaaaatcaaaagtgaaatataagcaagtaaaattcagctgtgtgtttaatcaacaatctatgacggtttaacatgggaaaggaagaatggtttaatataacacattgtattattttatttataatacaaaataccaataggcctcaaaatagaacctgaataaatgttgaaatattattcagaaaatttaaaaatacatttctgataaaacatttagtaaatagtaaagtctcttacatgcataaaagcattgtctacataactacctgttccgtgtatcaaaatcataagcaacagatttgaaaagcaaataaatggtgaaaatttatgcaatgaatatcatgaacaaagagagatctctttaaaatcatcaacaaaagcattattatcccacataaaattggcaaaggtcaactcataaatgaaggaatacaaatcaccaaaaattattaaaaagtgttcatattataatcaaagaaatacaagattaagatattcttatttttatctttcaggttaaataacatatacattgcaaaacatcagaagagtatatatcagaccaacatttttacaaatcacaaatataaacttagacaaaatattttaaaaatctatgtgaagacaccagagaatagccaaaagcaaacagaaacagaaaaagataagagtccagatactaaacaacagaggtccccagtccccaggccatggaccagtaccagtccgtggcctgttaggaaccaggccacacagcaggaggtgcgtggtggatgagcaagcattacagaaagaaaagcattacagttgaaagaaaagaactgcgttgattgagttcatgtttctacgaccttttggtgcagaaaaatccccaatttttatgacgtatagcaactaaaacttaaacagaaagttgcaaacttactggctgaaggggtgagagaacagtgtttggaacttccaggccagctagaaatagaagaaaaatcccagaaaggagagagccagagagagagaatcccccagatctgcacacaaatgctgctcaaatttttggctgacagctgcactgcacgggcacaaaggaagctccaggaagcccagcacaaagctactgctgaaaggctggaataatccagcagatagttcagcagaggtccaccaaaggagaaacatggtttgaagtctatgtctagcaaaacttcaaatttatgtttatattatgttatgaagtttatgtctagcaaagttgtggctttcaagaacaaatagcaacacacttcagaagataacagtccagatactatacaacaggggtccccaatccccaggccatggaccagtaccagtccgtggcctgttaggaaccaggccacacagcaggaggtgagtggtggatgagcaagcattacagcctgagctccgcctcctgttaggtgagcagtggcattagagtctcatagaagcacacaccctattatgaactgtgtatgcgaagcacctaggttgcatgctccttatgagaatctaatacctgatgatctgtcactgtctcccatcacccccagatggaaccatctagttgcagaaaaacaaactcagggctcccactaattctacattatggtgagttgcataattatttcactgtatattacaatgcaataataatagaaacaaagtgcatgataaatttaatgtgcttgaatcatcccgccagcctgccacggagcacctgtggggctggagcctccgacgcagcctggcagggaggggtgttggtgaagagtcagactctgccggcccccctggtccggcacccgcgggcatctgcctggccagagggcagctccgtagccaatgcttctctaagcaacctgtggtccctgaatccggacctggtgcccttgggtgaagggaggtgacgtgcctgttctcaagatgctggatgctgggctaccccaggctccctgggggtggaggtggggagggccactgaaaatactgaagagcatccccggggccccagatggaaagagagtagcggttgggcctctgtgcataggatggaagggggccctggggcctgtcccccactccatttctctttcctcatctgtgaaatggaggaaagcatgtatttctccagctcagagatgcccgggaggaccaagggcctgggggaggcagggcttggccagggtggctcgtggctgtgagcaggtcccagagactggcctgtctccctgggtccactgcagcatgatgggttcctgctgatgtgaataggctgactgctgccctcccagaggtccccttaaatgccgtaccacaccaccccggggaagccaggcccaggtgcccaggagctgcccagagccaggcccacatggatcccagcttgctttctgcccctccttgtcctgagctacctaagcccaggttaggctgagcagccccctccccacactcccaccagactctagggcattgtggggggtcccttcatagagcaggcttgtggctccggcctctgcagctgtcctggttttgagacattttactccacttaataaagattatttgttgaaagcagaaatgaatgtgtctcatttgtgtgctgcaggaattcataagcatcacctccctgatccccctcgctcctgtgggacctggtgtttccccactggattccagcctgccctcctggcaccacccaggccgccccagccaccgcagccaccctactccctctccctctccctctccatctccctgacgcagcgactgagtcggcttttgactctatgtgatgtctctcagctccgtggcctctaaatgaaaagattaattagttcggggagcccagcacaggactgccaggggcactctgctgttctgcagacagggggaccgtgtcattgccgttttgaattgaaacaggcctcttggagagaaccatgcttaggaaagtgtcgagaaacctccagcgctttggggcaataagggtgtagtgctgtcaagatgctcatcagagcctagtaagatcacctaactgctaatagctggtgggagcgggaagccagcgcctctgatggagcagaaaggcccacgtgtgaggaggaggcaggaagggcttcgcttccaggagggccagggcgggaggactggagactgtgtcctctgagtccctgctcaaggaccgtgtgaggaactccataaaattttatggagtgaatgaactcgccgtgtttggctcgagcaagtgacaggcttgccagctctgaaggtctgttaaaaggcagatgggaagatccgcctctattctgagacaaacttgccttgtgtggtgcgaggtgaggtgtggggaccggcagcgggcctgccgcgcttcccgggcagcggagccggactgcgcacccagcgccccgctctgtggtgtggggtgtgtggtatctgagcccgggacgcggctcagtgactgtgatgggggctgttcagctgttgtgggactgagttacacgcatctcactggcaaagccacatcatctcaccccacaaaatacggaatttggggtgtcatgggtcaagaggctctgcgctggacagtgtggggtatggtgggtgtgtgtccgtctggacgtgtgtccctctgcctgaagggatgcagggccgtgaatggacccagcagcccccgcatcagccctgccctcccacaagcagccgaggaggctggtcctaagccggcgtctgcacagctccctgagggggaacaagggggagggtctcagaatggggctgaatttttctccacattcagtccccggctggacctgcagaaacctaggacggctttgaccctggtttacagctttcgggaaccccagggaatgctctggcctctaggctggaaccctgcccctctgaccccagccctccggccattcctacagcgaaggcccagggatgttaaccagtgcagaggccgggagcagtcccgggaggcgcccctgtttagatctcatggctggtctctgtctccacgttctcagaggcctgggaggggcaggctgagggctctgccagaccctcctgcccagagcccctccccagggtctggcccagcgaggggatggcatcactccctggggtgggtgccggggattacggcaggtttggggaggaggctggtggggcctgagcacgggctggtgtgggggccaggtgaagggtgcccaggtgtgtcaggatgcggctgggagctcactcggctggggggacgcctccccagcgcccgggtggtgaaagtgggtttccccctccagcaagttctttcctcagcccataaagcgggaatcctcccatgtggaaatatggagacaggcccctcccgctgcctgttctccccacggcaggtgaagggcctccttggagggcctctgctttccagtctgttaacacgaagcctgccagaaagtccccaggaccccaacccccactccttagagaagctgctctggcctgtctttgtccctccccgacactgccaactccaggcccccgttaccccactacttatgggcttggtcacctgtcacctcccccaggaggctccttgggccccaggctgccctccagctgggcccagcggctctcctgccagtcccgctggctggggactgcacctgctccccaggcgtggcctggtgccatcacccggacacccaaggacaggtttggactgcccatcctaggctcccatccaggagagggtttggcgggggcagcctggacctgcccattccttgctgtcctagctgcccaggactgtcccagttctagccccagaagccctcagccccagaaaactaggggtgacttaggcttggcggggcgggtcaggatgtatccccactagggagacagtccggccccccaagccatgtgcagagaagcccagggcagtgggatggaaggaggggttcggggaagaatcctgctggggggggtgtccaaaggacaacccgaaggagaggttcaaggaagtcctggctgagcagagatgctggcgggcagcgggggcagtaggggaaccggtggatcgagggctcttcctctaggacctagtgcttccaggagcatctcaggagctgaggggcatctgaggccacagacgggaggctgcatgggtggcgggggaggcgtctgcagcagcaggcgtgggagcccctgaaagctcttggcaggggagggacgggcagctggcatccacgaagccccctgggctgtagcctggagcccagcctggaagggcagctgggtgagaggaggctgggcacacagatgcacagtatgggcaaatggccaggtggggctgtgccgccccggaccgcagggtcccacttggcttctgtctgtcacagtcaccgcccccacttggagagcgtttgctgatggagctcagctccagaaagtgctgtttaaagattgaagagctccaggcaggcgattacagagcacgtgggttgactctctctgacccacagctggtggagggaggggaggagctgggggcgccacagctggatgtgctcctcccccacgagaagcgcccagggcacgtggagcagagggaggtgctggctctcattttcctcctcactggagcgaggcgctggaaggccactccgagggtgggggcggcacgctgcctgttccccactggctctgcccttggggcaccttagcttgggtccagcccacctgccccaataccccttgccggaccctgccctgctgcctgcccctgcctgaaccccaccccccacccaacagtgcttcccgcccagtctttcccagttgcaggctgaagccccccactccctgggcatcccctaggagccctccctagcaccgcctcccacacccatttcccagataagattctaccgttgagaacataccatgggggggccacccaaggcccctgagccacacgtccaaagcacagacaccttcggaacaaaagcctcttggtgcaggggatggcggcggccgaagttcaccctgcccagggcaggacaccctgcagcaccgggagggtcttggtctgtgtttccaggactgtgagcggggcctctttggcctagtggggaagagggcacgtatggggcccacgacctctcctgtgcccaggggctgtggtcagggcactcgtcctgcagccacagacaagtaagtgaccaggacctgcggggaagataggagatgaagcccccccggacatccccggccctccccaggaaccaatttacagttgctgagctctactctgggccaggatgaatcagggacacgacctgggaaggggcggagaagaggacctcacgcaggtgccaggactggccctgcccccactgccccaaccttcatgattctgccccagagtcacctgccctgggcctcagtgttctcacctggcggcaaggatgttcctgagcatttatttctgagtgggtttgtgtgtgaggtctctgcatgggggctctgtgtgttggcacatgtgtttcggctcagagtttgggtagggggcttctgtatgcacatgtgggtctgtacacgtgtgcgtgtgtgtgagtgcatgtatgtgtatgcacaggcatgcatggcctgtgtgtacgtcagaacgtgtgagtgcacatgtatgcatctgtgtgtgttgcatgtgcgaacaagtacacacgtttgtgtgtgtgcacctgcacgtgtgtcacttgcgtgcccttgcctgggtgggagaaaggacaaaggcgaatgctcttgtctcctgctgctgggtaacagctcaccacaaggcaaggccttggacagcaccacattcgtcaactcagtttccctgggctgggggcaggctttgcttagctggactcgctgccccgtgtctcacatccgggtgctggctcctgcattattccaagagcatccaagctggtggcagaactgggtgcctctgggttgggactgaggccctgtttcctggctgttggggcccctctagagccctgggcctctcaggatgcctcacgcacacccctcactctccaactctctctgcctctttttctgctctcggcttgtaatgggctcacctgactgggccaggctaaacccatgacctccacgtcataagggggcctgacctgggaccatgactccatctggagagtcccctcacagcagaaagtggattcctgtttaattaaaaagctaggccaacataacgaacccccgtccctactaaaaatataaaacttagccaggcatggtggtgcacgcctataatcccagctacttgcgaggctgaggcaggagaatagcttggacctgggaggcagaggttgcagtgagctgagatcatgccactgcactccagcctgggagacagagtgagactccgtcttaaaaagaaaaaaaaaaaaaagggccaggaggcaggaatcttgggcggtaactgctaagctctgcctgggtgcacccatctgagccccatctctgtcaggtgtctgctgcacccgccggtgactgtaccaggcatagcagcagcacctacccctctcctccccgcccaccctcctcctccccgcccacccctctcctccctccctgctgcctctggcctctggcatccccagcccatgcagtcaccgaatccccttgttcctggacatggtccaagggagatttattactcagcccatccttagtgtcgagggagcagccccagacacagcctctgctcctgggaagccatggagggggataggggagcctgtggcttggagacggagctctggctgggacgagctccttgcacagcatggtggaccctcgctgaagtgaggaggaacccacctcaccgattgctgtgacctcccaagatgagtcgggccacgagcctggcctggggctccaatcactacagcacgctccttccccgagtcggcctcctgggcctcactttccccagctgcacaacagagagtgaggccctgagcgttgggaggttggaagccaatctacagccttcctccagtgcaccctcccatcttgggcagaggccagcagcacacacgggctctggaagatgggactgccccgtccatgcagtgcccacctcccatacaaccaacctgggctgcactgcgggctgctgcaccactgcccaagtagctgactagggaggcaccacccccggccacgcagccgaggccatcgtctccctggaggtcgcctggtggttttctcaggttgtgcccccaaatgaccacgaacccagggcaccttcctcactccccctgcaccccagggcctggccttccctcacaccaggccccaatttcctcctcctacgggaagccttccctgatgccaccaacctgttctgttcttcccagacatgttcttgggccgagccagccagagggtggggaccagcactcaggccatgtgtgtagctggggacttgggtatagaaagatagggtctctggccgggcacagtggctcacgcttgtaatcccagcactttgggaggctgaggcaggcggatgatgaggtcaggagatcgagaccatcctggctaacatggtgaaaccccgtctctactaaaaatacaaaaagaaattagccgggcgtggtggcgggcgcctgtagtcccagctactcgggaggctgaggcaggagaatggcgtgaacccgagaggcggagcttgcagtgagtcgagactgtgccactgcagtccagcctgggcgacagagcaagactccatctcaacaaaaaaaaaagagaaagaaagatagggtctctgactgccatgggaggaccccagctcccacattctccagctatgtgacttcctccagtctcagttttctcatctgtaaagtgaggtgcctgattgatgccaggtcatatgtggggaattagagaagccagcctgtgagaggcgcccctgaggcctggcggcttcgttcctgcagccccttctcacctccctgagtctctgcacccccaccctggcctgggggctccttgagggcgggggcaggggtgggccaatgggagaacaagtaagggctgagctcacctcccagctgggactcccagaaccttcccttaagagcagtgaccctgcaccacccaccccattagctgtgtcctaagtgatcctttagaaaccccgcaggaggcggctggacagagcacctgggtatcaaatgtcctgcagccatcacacaggtcacacatggggtctcaccacccaaccagccaggccccgagacccgcccctgcagctgcccctcccacccacttgccgacctctcctctctataaaatgggaagggctccagggtcagcgggtggatgtcagggtgagacaagtattgtgacgcagactccgtgttcagcacggccgtcgggtgtgcctaggggttcccaagcactgccttgcacagcaagcccatgttgcttatggaaatttcaaacccccacgaaagcaataaggacgcacaatgcacctgcacactcagcaccagccgaacaacgaccctctgcagaccttcctgtcatctgcacccacacccccaaagcatttgttaacatgctgctgtctggaacagttttggatttttgcagacagcacagagttgccacgtccccacaggtggtttccctgttgccaccaacctgcatcagtgtaagcgtctgacaactaaggagcaatattgacatgattcatgacaacatcactttattcagatttcctggttttccctgatgtcttttcctctcccaagaccccatccaggatcccaggtgacatctgttttgtttttgtgtttttgtttttcccccgttcctacggtgttgaccacatggcgtttggtcgttgtgcctccttggacacctcctggctgggacagtttcccactttccttgttttgatgaccttgacagtggtgaggtgccctgggcgggcactttgaaggatgcccccgcggggatgcggctggtgttcttctcacaagcagcctggggttgtggccgtggggaggaagggccatctgctcacaccctctccagggtgcacgccgtcaacaccaccccgctgctggcgctgactccaccctcctcatgtttcaggaaacttgactgacagtaaatcttcatggaaagcacattggggtgatggcgcccggacagccaagacatcaccgccctgagactcctcccgagcccctggagctgctacagcccccgtgggtgctccctggccgcatccttgccccgctccagcctctgtaacttagcacgcgtgctcgtccagcggcctttgctctgtgtgtgactgtccgtgttgctgctcaggttgccctgcgtttaggcagcaccctatccgttcatccgtcccactgcgggcgcagcaccctagccagtcattcgtcccactgcgggcgcagcaccatatccattcatccgtcccactgaggaggcagcaccctatccattcatccgtcccgctgcgggagcagcaccctagccagtcattcgtcccactgcgggcgcagcaccctatccattcatctgtcccactgcgggcgcagcaccatatccattcatccgtcccactggggaggcagcaccctatccattcatctgtcccactgcggaggcagcaccctatccgttcatccgtcccactgcgggcgcagcaccatatccattcatccatcccactgcgggcgcagcaccatatccattcatctgtcccactgcggaggcagcaccctatccgttcatccgtcccactgcgggcgcagcaccctatccattcatctgtcccactgcgggcacagcaccatatccattcatccgtcccactggggaggcagcaccctatccattcatctgtcccactgcggaggcagcaccctatccgttcatccgtcccactgcgggcgcagcaccatatccattcatccatcccactgcgggcgcagcaccatatccattcatctgtcccactgcggaggcaacaccatatccgttcatccatcccgctgcgagagcagcaccctagccagtcattcgtcccactgcgggcgcagcaccctatccattcatctgtcccactgcgggcgcagcgccatatccattcatccctcccactgcggaggcagcaccctatccattcatctgtcccactgcggaggcagcaccctatccattcatccgtcccgctgcgggagcagcaccctagccagtcattcgtcccactgcgggcgcagcaccctatccattcatccatcccactgcgggcgcagcaccatatccattcatccatcccactgcgggcgcagcaccatatccattcatctgtcccactgcggaggcagcaccctatgcattcatccgtcccgctgcgggagcagcaccctagccagtcattcgtcccactgcgggcgcagcaccatatccattcatccgtcccactgcggaggcagcaccatatccattcatccatcccactgcgggcgtagcatcatatccattcatccgtctcactgcggaggcagcactctatccattcatccatcccactgcggaggcagcaccctatccattcatccgtcccactgcaggcgcagcaccatatccattcatccgtcccactgaggaggcagcaccctttccattcatccgtcccactgcgggcgcagcaccatatccattcatccgtcccactgcgggcgcagcaccatatccattcatccgtcccactgcgggcgcagcaccatatccattcatccgtcccactgcgggcgcagcaccctatccattcatccgtcccactgcgggcgcagcaccatatccattcatccgtcccactgcgggcgcagcaccatatctgttcattcatctcactgcggaggcagcaccatatccattcactaattccactgcggtggcagcaccctatccattcatcgtcccactgcgggctcatctgggtcttcgtggagccacggtcctgcttcagtagatccaattttccaaagctgctctgtggattttcagcccctcccaccgtgtgtgggggccactgccttctctgtcctaaagcggccctgccatcgccgctctggagagcaggatccagaagctcagtgggctgagcgcatccgtaggtgccccacctccaccccaggatgggcccagtacccacctcaggctgcgtctgctgcaagtggaccagccagctccaggtggagagaagtcccaaggaccccacagcagaggtgcctagggtgagggacatggggggtgccccgtgccagcttctgcctgggccaagggaaggggcagtggcagagctctgacagcctcaggagtttgagatgggtcctcctgcagctccagaagcaggagggcttgggcaggggtggggctgcctgccgggctgaagctcctgaggtggcggtggaagagcacacttcaccctcacaagtgtcttgcagaaatttccagagacagtgtcctggaacggtcacccagctctgcctgccccatggtggtgggatctgcctgcccaaccttggctcatagcgacattggaggggccgggacagccagacctcacctcctcgaggagcttcctcctccaaggaggggctcaggtgagcatccggtccccagaagggccctggccttccagtttgcacactaaactctccctgctgtctgtgggaggagccggctcctgtgggaggagcacaggctcctctccctgctgtctgtgggaggagccggcacagctctggagctgcccccacagggcacagccttgacctgggctcagggagggccaggggtcccttctggccaccccatgtctccagagggccttgtagcccatcctggggtaggggctcagtctgggcatggtccttgcacgctccagtgatgtggagggtggtccctggggcaggccccagcttgaggttgggccagagtggggtgaggcctgaggaagggtctgggccacaccaagcccgaaaggagcgaagagaaatgggtccccatgccaccgagagcaaccacttgcctggccctctgcatctggccaggctggctgggcctccccatacctacggtccccattttacctgcactctgtggcagggctggtggagaccagggcctgcctgggacccacagcagccagcccaccagggctctggccagggtcaccaccctgggttccaccagggtctgggaccagggaccagagagacccagagctggggacacaaccaaggagcctcggagtctatgaagcaccaagggtcagccctggggacatccttggagatgcccaaccggctcctggcccagcagtggggaggccgatcctgaaggggccggagcccgtggaacacacggacgcaaacaacgctgcacagacccctttcccagcctaggatgtggccgccgggagggtatctctgaggctggtgctcaagcaccacccacacctcctcatccccctcacctcacctcccctaatctgcaagctgcggcccgaggcgcacctggctgtcccagccctcccagcagcacctggcggctccctgagcttgtccacagcagcagtcgtcttcagggtggctctgcactggcaggccccgggtgcccttcccacgggggtggcagggagccggctactccagacgggccccgcactgtggacaggcgctgatgcttcggtttccgtggttgccccggccccgttgtttgagggccccgagcctggcccacctgcccacacccgtgaggaggccttcaggaaggtggggcacagcagcggtgcccagtttggagcaaagcctggacttggagcttgcagaaggagctcttagcccacacagaaggaatcacaactgggaccagaagcacctcctccatcttgtggagttgctgaggacagatggtcagaaactgagtttgctgtggtggcaaagtgtccctgccaccccggcccctctagagagggcagcgcccgccccctccaatcacggcatccacagggctcctggagcccctccagccagtcgggccagccatgggggcaccctgtgcctgctccgctccgaggtgacctccacccacagctgctctgaggagcacggccggggttccccgagacttccctggtccactttagagccacggggctaacgggttttgttttcagtggtatctcttcctcggtgatgtcctgtgggccaggtctcagcccaacccctccttcacaagctggtagccaccctggagcccgccagtccccagctcccggatgctcacggtgggctaggcacggtcaccacaccctgggctgcctgtcacagaagtggccccagcctttgaggatcacggagagaccagggtgacagtctctgtcaagagcacctgtggcacctgaggtggcccctgctacctccctggagggtgagcttcaggcaaggcctgagggtgtctagagggaccctgtgcagggccaccccgcctgagctcaggccccgtccttcctgccctccagagggggaaccagccacagagcctcggcctagggctcacgtgggcccgcgcctgcagtgagtggctgccctctgcagacagagcgggctcaggcgccccggagctggaggggtcttctctgtaaaagtgacctcaggaggtccgggtcctgcattctttctgtccccagcccagaacctgatttctgaaacaaagtttcctgggcctcggggagtgaggttggggctactgggagttcacagggctcatcccttcccctggagtctaccagcctgagctttcctgccccacactgtccccgaggggcctgggatgctgacagaagtctcacggctgctaatgtaaggtcagggctttagtgccctgtgcccctgcttgtcgccacccgccaccggcctccccacacctttggagcaggtggggaccagcatggatggccctctggactggtgtggggggcccctgctttggaggggctgctggccagtggcaggggttggattggagccaggcggatctcaccaacccccatccttcaacacaacagaaaggggcgggtgggaggttggagccccggccgtgttagctgctgtggtgcctccagccaaccctattccatccccaggaccacctgctcaggggtgccctgatcccagcaaccaaggactccagaaggtaggtataagttccatgggctttgcagggaggggctgagcagtcccacacaggcactcatttggaaccaaacagagggctggggactgaacagaggcattctgaccccacagcaatggggagccatggcgggtccttgagcagaagggtaggctctggaatgtgtttgaagttgatgctgacagcaggtgtggggtggactgagggaagatggagaccaggggttgccagggcaatgcccaggagcaacgtaaggaggcccccagggtgcaagggagggccaggggcagggcaggaggtgggagtcttggccaggaacatgctgtagggctaggaactacccggaaaagggtgagtctcaggggcttggaccccctcccggagcagaggactccagggtccccagctgtgtgcccttcactgtgaggcagtgtgagtgctggcccactcacgacatgcccagacctgcagaatgggaaaggccttcctggtaacggggcctccaagagcaggcaggtggcctgtgagcggcatttccaaacatcagacttcgcagggctgacttgatggctaccagcaagcaagtcccaccatggttcctgtggggcagtcggggtgctcagggaggtgggctccaggcaggggacctggcccagcctcactgtgacccccggaggcccagcaaggggtgactagtgggcacagtgccttggagtgggaggaggagaaaccctaaaatgaggcccacgccccacagccgagtggctccctggagccagccctggccccgtcgtgccccaagaaggcctggctggccagggcctagggctcctgtggggttgccagcaccacagggtcagtacaggctgtcatcaggcagtccagccaccctgagggcaggtgctggggaaggaccctgtcccactccctccatcacctgtgctggggccactggcagtcataggagagcagagcaggcccaaggtaggcgccagacatggcgcccttgcagccagcgtgtccacgcccatcctcaagccgagcctggtcaccagcagtgagaagggagggtaggcccacggccctggctcccctaaagtcctgtttccacggaacgatggcccagcatctactcctccccaggacccccgctaactgggaagggtcagcccctgccctttgcactctacccccaagacatgcggcctccttgacctctctatgctcaagcaagtcttgccagaactaggaaaatctgccccaagctatgatcccagctggtgcagatggtcccaggctgtggtgggccctgttctattcctcccaacaaccctgcagtccatcccacaaatcgggacaatgcgctgggacagctgacattccagaggtgtccagggacgcacagtgaatccgtgtccactggggagcgcccactaggagggaggaagcccaggagagtgggcgctcgcaggaagccctctggcctggcccggtagtcctggcgggcttccagggggaggtggagctgagcctcctgcagatgggcggagctgagggaggcaggcctggggcagtcggggtgaaggctccaggactgccagggcaggaaaccacacaggatgttatggagaagcaggacggcagcaagggtgtacagctgggcctggtcactctgccaagcccctagcccggcggctgcctccccgcagtggcctgttttctccgcggccatgccaggagacgtgccgggggctgaccgtaagcttcccccaggaactgctgacacaagctcctcccactgcatgcctgtgtctggctggccaagctctgtcccaggacttccctcccaccagggccctgttcccattcccaccacaggaccaaggggccctacttagcctccagcctcccgggcaccccctggtccttactgcagctgcgctggtgtcattctccgtcctgtggggtgagctccagcatggccgtgcgtgctctgctgggcagtgccaggcccgtctccactggcctcagacacggcaaggctggacccctacccagggtcagagcttaggtgtgggaaggagggcgatggagcagataatgagtcaatcagacctggagacgctgggggctggtgaagcaccaggcaaggagtttggggctgcccctggtacaggagccgtatggtcctcaccccacaccccagggagtcacccagccagggccaggggagaggcaggtgactgccgtgtgcggactctgcactggctactacactgcctgtggggctggaatgggggctcccagaaaggggctggactccagcccctggaggacagggtgttaggcagccagcagtgggtgaacccaagggccaggccagcacagcacgggggcagggtgagggtcccaggttgtggctcagcctgacgggccttgctgtgtaagctgctctcagagagggaggtggctggtctctttcttcccttgtggagatgcagccagacaggggccagaggcccaatgaattaattatggagggaaggcagccctgctctgagcagcggggctctggatgaggcggtggctccagctgctgcagggccctgaaagcacactgcccacctctgccggccccacccagctgcaggaggcccagccccacctgccctggaagccttccaggactgtcaggcagggggatctcctgtaagcgcccactctcctgggcctctcccctctgacagggcactcctggggcaggtatcgcagagggggagttcctgggccctggccagctgctcagtgggcagctgtgggcccttcactggcttcaggttcctctgagctggtgccctcccgcctgcctgtgggtggtgacactgggctgggacacatgagtcctccccacactggccccagggcacaatcaatacccagtgagcctttcattacctggctgttaattattcagcgctcactgggaaggccacatgccacatccgtgccctcaccccgccccaccccatgggaacacaacagaaagtgcctgggagtgggcagggaggagacgctaagcacacagtgaggagaccacccctggaagcccccagaccacagcagagagaaagagagagacagaaagaagtcttccctggtgggtgagagcccaggctgttcttccaagggcaggagggagggaggcagggaaggaggaaggaaggggggcctgaccacccaggccagccccgggggccagctccactggcatcacagcacttaatttgcacacagcgcaggaggtgaggcctgcctgtctgctccctccaggcccaaggtcacagtgaagggacgcaggggatccagggcagttggatgccccgcaggtgggggatgaagacttggccaagccccctcaagcgccaagctcttttactaggcagtgtctaaaagccccttgtgagtgtcccaccagccacatccattctgtatcctctaagaaagcaaagcaaaggaaagaaagaggggaggggagggcaggggcaggtcctgagggctgcaggcccccgggtcccaggtgagtttgtgggtcagctctcagaggtgtgaacacagccttggtggggcacccagatgcagactctggcctcagaccagcccccaccttgtttgcgtcccccaagtcaagtagccgtccccctggcatgggccatcccatggcaaaggggttgcagggaggaggtgtccctgtggcctgtgtcgggggtacacgccagcacagaggctgagcagcccaagccaccagctccagatgctacaggtggagtttggatgtcgaagcccgaatccccagtacacagaacgtgatcttatttagaaatagggtcactgcagatgtgattagaaaaatgaggccaccctgcagcagggcaggcccctcatcggacatgacagttgtccttataaaaagaaggaatttggatacaaacacgtgcacagggcaaacaccgagggggtgagagcaagggtcggggtgatgtttccacaagccgtggaccccagagacggccagcaacctccagaaacgaggcaagagctgtggaacaagttctccctcacagccccggaaggacccagccctgtcaatgcctggatcctggactttctgccttcaaaacattgcgggaaaaaatctctgttgtttaagccacccacgatctggtacaggcaaatctcagagatattgtgggttccattccagaccactgcaataaagtgagttttacaatacggtgagtcacatgaattttttggtttcccggtacatataaaagtgacattttcactgtactgtagtctattcagtgtgcaatagcatcgtctaaaaaacaatgtacttaccttaattaaaatacacttcattgccaaacaatgctaacgaccatctgtgccttcagtgaatcatcttttgctggtgagggtcttgcctccatgttgatggctgctgtctgatggaggtggtgggtgctgaaggctggggtggctgtggcaatttcttaggacaacagtgaagctggcctcatcaatagacttttcctttcctgaaagattttgctgtagcgtgcgattctgttgacagcattttatccacagtagttcttctttcagcagtggagtcaattttcccaatccttgccactgctccatcaactaagttttgatggaatattctaaatcctttgttgtcatttcaacagtgttcactttcttttctcatccgtaaaaagcaactcttcatccattcgagtttcttcatgagactgcagcaattcagtcacatcctcaggctccacttctaattctagttctcttgctatttccaccacatgtgcagttcctgcttccctgaagtcttgaaccctcaaagtcatccatgcgagttggaatccatttcttctaaattcctgtcaatgttgatatctcaacctcctcccattcttcacggcttctagaatggagaatcctttctgaagattttccattgactttgcctagatccatcagagaaatcactgtctatggcagttacagccttacaacatgtatttcttaaatagtaagacttgaaagttgaaatgactccctgatgcgtgggcggcctgatggatgtcgtgtgagcagccatgaaaacaacgttcgtctcctgcgagtctccagcagagctcttgggtgaccaggtcatgtcaatgagcagtcatattttgaaaggaaccttttttttttctgagcagtaggtatcaacggtgagcttaaaatattcagccaatcgtgctgtaaacagatgtgctgtcatccaggctttgttgttccattttcagaacacagacagtcgactttgcgtaattcttaagggccctaggatttcaggaatggtaaatcagcactggcttcaacttaaagtcaccagctgccttcactcctaacaagagaggcagcctgtcctttgaagctttgaggccaggcatcgacttctcctctctagctatgaaagtcctagatggcatcttcttccaatggaaggctgtgtcttccacgttgaaaatctgttgtttagtgtagccaccttcgtcgatgatccaagctggatcttctggataactcgctgcagcttctccgtcagcacttgccgcttcaccctgcactttcatgttctggggacacacattaagcctcacgaaccgacctctgccagcttccagcttttcttctgcagcttcctcatccctgtcagccttcacagaactgagaatcagggcctcgctgggggtgaggctttggcttaaggggagtgtgatggctgcttggatctatccagaccactcgagctgtctccacatcagcatttttaaaatttttaaaatttccttatagaacttttccttggcattcacaacttggccaaccggcaccagatgcccagctcccagctttcggcctgcatggggtctccacctgccttcctcacagaggtgaatcacttctagcttttgatttaaagtgagagatgtggcatggttcatggtttccccagttacactagtaacatcgaagatcactgaccacagatcaccataacatacagtaatgatgcaaaagcgtgcgatgttgtgagaattaccaaagtgtgacacagagatgtgacatgagcaacgtgctgttagaacaacagctctgattgacttgttcaacacagggctgccacaaaccctcaatttgttaaaaaaaaagtacagtatctgcaacgtgcaataaagtgaagaggaataaaacaaggtgtgcctacacctgggtacggcagcctaggacactaatgccacagacgtgggaactgaatggtggggtttcgagtagtgttttctgggatttgtaccaccaacccatccctttctgattatacaaggcttcagtgacagatggggaaactgaggcattgagattggaagagattcacccacaacacccacaaatccatggtggggctgagccagagtccctagctcccctacccctgcccattccctattccgggccctgtccttccttccagctgcaacacaaaggtggtgtccaccttattgatggaggggctgagtcccagagtcacctggtgcctgcacagagggagacggagctggacccctgccgggggtggaggccctggacaacgggcacaagtgaggctccagacagcatgggagacagcccagtggatggtgggtcagggaggcttcctgggggagggtgctccaaggggctggaggatggacatggtttagcaaacctcgctggggcagagacaggaaggacacgggtgagttgggagctgagcaggcaggcactgggcatggggcagcagctggagacggagggctcagggctcactggcaccaggatgcctcagctggagaggaacagccagcaggatggtaggccaggaggacagcaggacagcagtggccacaccacgtggcccaccgtctgctggatgcctgggtggtacacaggcttccactccgcggtgaatgcccaaggcccttttattcatgttcgtaattacagaatgcagggcgcattatccacaatttgcttcacatgaaaaagcaggaccatttgctgaagcccttccccgtgaagctcagcacgctgctatcaatgaacccggaatcctctcccggctggcaaatggaatcttttctgctcctgacaaagaggaatgtcctcaaggtgaatcttttcattcctgctcctttcagccagcaattttggtggctgacagattcttctgtgagaaatggcgatttgataaaatgcaaagtggatgctatcgagctcacgggcttttcagaggagttgggagccatggccctgggctcctttccgccctccatccgcctcctcttgctcctccaagcccagcctgtgcatcctggaaagccaggagcaggactccagccccagccgccacagcaggcagcagctgaccacttcgaagctacccgccccgaccccacgaggccacacagcctccctcaccggctgggcctggctgagaccccggacttggagcaggagcagacctcagccagtgcccaggaactgctaggtgaggcctgcactgggcagcaacaccccctcacgaggcacaggagcaggacctgggcctgggcagggctggggggcagacacctctgtccacagcacatacggcttctcccggccaccccggggtccgtcggagaacctgggatcacgcagggcccagaacacggccagccaagcctcctccgagccctcctgggagtgcccccacccttacaccgggcacgaggcgaccagagtttcaggccagggctatggaatgctgtggagtcaggcgagtcttgggagcagggatgaacacaagccttccaaccatgtggctttgggcaagtgatctctcagaacttctgttttctcctccataaaacttgcatgggtttatctgccgctcccagccaaccacatggccagctctgtgctccagaagcatctgaaaacagcagtgggatgagggaatgaaagagcaaatgagtgaatgacggggagcagccatggtgagggatgagagcctggcctgcccttcccccactgaccccaggacaggatggaactagccgtggaaggtggatttgggaagacccagctgtaggggcctggcaagggctcttccggcagtatccgcacgggtgagggagtgtggatggttgtcattcaggaattactcagactgcagggtgagggatcacaggcagctctgggacccttccacagaggtggtgcctaatcactgggctgaggctgtgatttgcctgcctgcaggggagccctgcctgctccgacttaagactctgcctcagcactaacttttaacgagggggtgccccagagggccccacccaccccagagtcagaggcccggccgcagctctgtctcagcacattacagggaacccaggagttctgatcctgattccaggccagccgccccagcactgtcccccacgagagtcctcaggggacagctcagcccagccactccggccctccccactctggaccctgagggtcacctccctgcaaatgaggctttcccaggcagcaggccccttgctttccggggcccagtggcagctgcagagcagggcaggctcaggctggtctggaagcccctgcccctcacctgctggaaggctgctctcctccagagcagatctggtccttccagaagcctcctcctccccacccagcagggctctgcaggcctccccctgcctcaggcttccctcactccgcgccacactccactgtgccacccccttcaagcctggccctgctcgaggctgcagccgaatgcacctcctggaggggcgctgctgatgcccctattcccctcttgttcctcgagccctctgcttccctctgcagcagcgtctgctgctggatgtgtggtgtgtggtgcatggtgtacgtgctgtgtgtacttcccatccagctcgggcaccgctgtggggatccaggccaaggatgacctgtccagtctcccacatgtggctccagcaagtccgtgtttgaggaagaaaggcctgagaattccagtctccaaagcagggaaccctgggctcggggctggggctcaagatcactcacttctggggcatgaggctgatcccagagcttcatggagctaagcagcctccacagtgggtcaaagtggcagtgggggcagggagaggagccagggacgtgtctcatcccccccaagggcctagagaagagcccaggggcctggagtagatgaagccttaccaggtttgcccaggccctgggggaggaggggctgtggctgaccagccaggacacctgcctgatgtctgggcctctggtggctgatgagtacatcagtgcatttcacactgaactcctagcaaggtgcgtccacacagggagagtcctcaggcagctggaaccatgcacctgtgggagttgagaaagcattcacccactcacttactcacccactcactcattcacccactcactcacccactcactcacccactcgcccactcactcattcacccactcactcatttacccacccactcacccattcacttattcacccattcacctattcacccattcacacattcactccttcactcattcacccattcacccattcactgattcactccttcactcatttacctgttcacccattcactcattcacccactcactcactcactatctcacccattcaccatctcacccattcacccattcaccctttctcctgctcacccattcacccattcaccacttacccattcaacagttcaccggttcacccattcacccactcattcattcagccactcacccattcacccactcccccatgcacccatttatcccctcacccattcactccatcaattctttgcacattcacccactcgcttacttacccactcacgcattccgacattcccacagcaggcatgtactgagtgctcatggcatggtgtgggcacctgggctgttcaagtgcacaaggaggaagcttcccatttccaaggcagctgggtgcgggagaaagggggaagaatgaacccaggatcagagagatggggcatccttcaagacagtgggatgggcattggcccagaggaatcaaccccaaaggtgtatcaaggccctgcagaccggagctcctgtctgttccctgtgcagaggaaagccgggcaaccacctgcctccctccacgtcagagggaaatgtcttcattaaatattgattggtttgcacaagccttgggttgtctggagggaaggatagagagacttttgcatgtaaattacattttttttcagcccttctttaatcctttcctgcctaggcaccttgacacctgttttgattccccacaacaccagcaggaggtccctgtgggctcagggcagcccccgggacttgggactggaagcatccagcatctcttctctgccatggccttgaaggtcttccaggtccgctctgcctctctccacactgggcactgcctgctccctcttctgctggattggagatgcaaggatgccagcacccccatcccctggcccaggccagggcagttgatctctgcagacacagactctaaccactcctcagccaggccttggcaccaagtcttctaggaaagagctcacctctgggaccaccaagagcttccatcttgacttttaaatgttataatcctgccttgctgagcaagctaagacccacagaggcaccttccaattgggttccagcacttgggatctgtgtcctgggggacggtgggctggggggaggggagaacagctggcaccacgagcctaggtttccacatttgtaaatggcaggattattgtagcttcccttaaaattgtgaccaggatgaaataaagccatgtgtggctagcacagtgctgggcagatgactggtcaagaagcagcattttcccgactgtgtgtggagagagggaaggataataaatgagtgagtgagtgacagatgagtgggtgaggagtggatgagcacgtgaataaatgaacgaatgaacgaacggcccagtggtcctgcatggccttggctttcctgcagaggctaatgagactccttcattcaggagccctggcctccaggagcagctctggctctctttggctgtccctgggatgctggctccgggtcgctgcaggtccagcctcctgtccggctcctgagctccctccgtgctcctggttctgcaagtcactctgctccctcttgaaggtctgaacctatcacaggcctgtatgtccctggatgccctgctgtgcttggggccccttcccttcctacccctctggcctttttgacaccctcactgataccaggggggctcccaaagctgcttccagggatgatgcctccttctcactcagtgacgtggaccctcagtaacccgggaagtaggcagtacctgccccgccaccactgtgcagtgcatgggggctcagggcagtcacagctgggaggcttgctagcacctcccagccatctgtccattgtccatccactcctgcctccactgcctaaactcagcctggactccccctgtgattggatttgactgacttctggagtcctttgcaggactttggtttgtttgtttgtttgatctgcagtatctagctgagattgccttggaatgctacaggttctggtctattcaacaggcacagtgagattggagtaaaacgagttcacacccactctgtcaagatgttaattctgcagctcccacgggcaggtagtgagggaggcccgggccctcttgttcctgcaagggactaacaatagccagacacgctgaccatcatccctcacctctgttctgtgtctgttctgagagccttggcctgttctcacttccttccaccttgtttccaccacacctgcccctgtctacagcagaggcccttgcaatcctgccagggctcccaaagcaaggccaggacatggatctgagtagaatgctgtatgtgcacacatgtacgtacacatgcgcagactcacgtgcctacatgcacacgcatgcatgtgctcacaccaactctggctgactgggtcaccagatggtcctctccgggtcagtccagttcccttccttttgtggtaaaactttggaggaaatcttaaataaggttttggggagcaagagctttgcaacttcttatgtgtgagctcggctgagccctcccaccctgggcttcatttttcccagatgaaaaacggaggacttggacccaatgacctcttctatatcttccaagtcaaacttgccaggagcctgggactgctgggttatcttgggcttcagcatcaggttctgtgggtaacaggtgagtgataagtgtcacttctaaaagcagttcagatgacacagtgggaggaatagaactgtgcaggatgacctctgggagcaggacttagaaggctgtaagtgacaaaagaggccattccctctgtgctccctcaaacctaccacccgcccacctatccatccattctttcattcactcattcaggtgccaggcaccaggcatgaaggaggtgaggaacacacagacttgccttcgggagccaaccccagaatatggcagctccgcttttggctattaagctttctgttaatagtcctaagaaactctaaataaacaacacaagcctccatttcccaatttcttagctttagacagaaaaaaatatcactcctcactatggaagttgaaaaagatgaatacccccagcatccactgaccgctcagctcctgaggcccatgagcggtccttctgctctacacggacaaggtttacggtgtccagttctgtttcgtagttacaatgaagtctttcatgctttgtctctttgctgagttttaaaatggaaaacaaataaatagcattccactaaaatgcaaatattatacagggcagacttctgcttctgcttctggccatgctagagtagcagagactggatttaccctcccatttgaaacaactaagacaccaagtaaaatgtataaaataatgatgttgatatgttgaaaatcaggcagtgcaggagagtgactcctgagagaggaagtgaaagagatgatgcctgtgatggtcagcttattgcctggagagtatttagggctcagcccagagccagtggttacctgagttgaggaagcagagttgagtgttcagagcgtaaggcatctagaatcctggagcagaggatctgggtggagaaaatgcatagaaaggagagagctgcacagagaaagagctccagattctgcaccaatttccctgacagccttcctggtcagtacatgtatatgtagaaggcatcaagaccagggaaagatccaccagaaaggaacagggaggaaaatctctgcagttgacacagggctaggagtagctcacgtttccaccagccagaatggcaaaatctcatagtacacaaaacacggttagagtacttggcagggcatgtctcagatggggcataattagctctcctctaaaggctgctgtggtcccaactatcaaaactgacgtacaagcctcaaaaaagaatagtcaaaatagtaaaactaacagtgccccataacaaagtccaagcatgtttacaggagtaaaaaaaatacccagcaaccaacaacataaaaatcacaatgtctggcatcctgtcaaggtcaccagacatgcatacaaagaaacaggaaaataccagtcaaatgagaagaaaaaatccatccatagaaacagactgagaaacaacacgtgatcaaattagtagagaaagaaattaaaacaactattttaagtatgttccatgtgttaaagaagatagaggaaggcatgagcaggttaaggagaaacatggaggatgtaaaaaaagattgatacaaaacttcagctgatgagaatggcaattcttgtgatgggaaaagcactgagtgggattaacaggatatttgacactggcagaaaagatctgtgaacttaaaaacatagcaatagaaactttccacaataaaacacagacagaaaaagtgacctgcaggagaaccacaaatggattaatgtatgtataattggagtcctgaaggagaagtaggggatgtaaaatatttggaaaagtaatggctgaaattttttcaagatgctaaataaaccccaggtagaggtaaaccatgaagaaacgccaacaaggcacaccacaatcaagttattcaaaaccagtaatcaagggaaaaccttaaaagcaaagaaaaaaagacatatacacagaacaactgtaagaatgataccaatttcttatcagaaacaatgaaatccagaagatagtggagaaacacctttaaaatacaaaggggaaaagcaaattgtcactctagaattctatacccagaaaaaaaaaacttaaaaaccacagcaagatgaagactttttgagacataagagaggtaagagaattcattgctgtcagacctgacttataagaaatgttaaataaagtcctttatgcagaagaaaaataatagcaaatggaaatctagatttgttcaaatgaatgaagagcactaggagcggtaaacttgtgggtttaatcatgaatgcacataaaatatagtcaagttctttaacacataaataattgactaaaggaaatgtgataacaacattgtggggcttatcacatgtatagaaagaaaatgtataattcaagaacacagaccctgggacaagggaactagattattactgttataggaattttatgctacacatgaagtggtgtaatattacttataggtagaacataagctaaagatgtatcctataaaacctaaagcacccacacacaaaaatgatgtatagccaatgagcccacaaagaagataaaactaaatcataataaatactcagttaatccaaaagaagttggaaaaagaggaaagaaaaaaaagcagatgagggaaaaaaagcaagtagaaaacaacaaagtggaagatttaaacccatcacatcgataatcacattaaaactaaatactatacttgaaaggcaaagattgtcttattgggacaaaaaggcaaaagcaactatatgctaactaccagaaacccactttaactgtaaaactataaacagattaagtgtaaaaggctaggaaaaaatgcaccatgctaatactgatcaaaagaaagctggaatgactatattaatcacaatataagtaaatttcctggcaaataatatcagtgataggtaatttcataacagagggtcaatgtatcaagagggcataataatcctaaattgtatccacataataacatatattcaaaatacatggagcaaaaactgatcaccctgcaagtagaaataaataaattgagaattagaggtgtcaactccctattctcagtaattattagaaaaatgtagatagaaaatgggcaaaaaaaaaggaggcttgaacaacaccatcaatcaccttgacctaacagacatttatagagtcctccacccaataacagcagaatacacaatcttttcaaggacacacagaacatttaccaagattgaccatattctaggccataaaacaagtctcaacaaatggactagattcatatcaaattctcagccaaaatggaattaaattagaaatcaacaacagaaagatatctagaaattcaaaatatttggcaactgaacagcacacacctctaaataacccatgacttgatgtgttagtcctttctcacgctgctatgaagaaatacccgtgactgggtaatttataaagagaagaggtttaattgactcacagttttgtacggttggggaggcctcaggaaacttacagtcacggtggaagacacctcttcacagggcggcaggagagagaatgagtgtcagcaggagaaatgccagatccttgtaaaaccatcagattgcggaaacttccgagctctactctgcgtctgcagccgccgccgtcctgcagaggagcacgcaacccaggcgaggccggaggacgtgtccatagaatgcccaggggtgacgagctgtcctgagcccctctgctgcagccacctgcctgtcccatacaccctgcccaccacggagtccagagggaaatcggccagcagccccaagcccgacaccaaggtgacccaggccaccaccgaggccaaggtacccccggcagccgatgggaaatcccccttgaccgagccctggaagaaggaagccccggcagagaagcagcagccactggcagcccccaccatggcgcctgccaagaagaccccggccaaggcaaaccccgtccttctcaacaaccacggcaacctgaagccagcccccacagcccccatggtgcccagcagtcctgatgcaaccccggagcccaagggtcctggggacggggcagaggaggacgaggctgccagcgggggcctaggggtcgaggtccctgttcctgcgagaacttgaaccccctgctggtggctggagatgtggctgtggcagccatagccctgattctcggtggggccttcctggcccagaaaaaataataccttcgggccaggcgggggtcacagagccacttcctgtgcagatctcaggaagccagcgcatgcagaattcacccttatctacgtgtacacacgcacattcattacacatctacatatgcccccaacacacgcacacagtggagaagatgctcgagcccacccttgctgatccaggacttccccaacctccagggcagaaggaacctaggctccggggcccacagcgccggactgggggagagggtctagctgggggactgcaagaaaggaatggaccctgtgtgtggccctccaacggctgggtgatcctgggcccccagggctggtctctgagtgtaggtgggggtgctgggatgggttctgcctgggcccagccctcttggggagattaaagggcggacattaattgttgaaaaaataaaacacaccaaaaaaacgtcagattgcatgagactcacttattatcaaaagaacaccatggggggaaccacccccataattaaattacctccacctggtcccacccttgacacctggagactatggaaactgcaattcaaggcgagatttgggtggggacacagagccaaaccatatctctcaaataagaaatcaaaagagaaattggaaagttatttgagctgaaaatgaaaacacaacataccaaaatcagggagatgcagctaatgtatgcttggaggcaaatttaagcactaagaacctatgttataacaaaaaagaaaggtctcaaatcagtgacttacattttcacttaagaaactgaaaagagaagagcagattagacacaatgtaagctgaaaaagaaaataataaaaagaacggaaatcaatgaaagagaaaagtaaaaattataagaaaaatccaagaaagtaaaagctaatcattttaaacaatcaattaaattgttaaacttctagtcagttgataaagaaaaaggtaaaaaggcacaaattaccaatatcaggaatgaaagggtgggtgtcaccaaatattctgcagtcattataaggaaacaatggactattgtgagccacttttttctaataaatttgataacttagatgaaataagctaattccttagaagccataaattatcaaagttcactcaagaagaaatagataacatgaatatctattaactaaatcaagtttttaattaaaatcccaatgacaaagcaaactataggcccaggtggttttcatggtgaagtctaacaatatttgaggaaaaaataacaattctacacaaatccttccagacaatagaaaatgaagaggtactttttttattcgatgaagagaatgttactttcctactaaatcaaacagatataagaaacgacaacagagaccaatatccctcatgaacaatgatgaaaatattcttaccaaaattttagcaaatctagtttatctaaatcatgacaaagtgtagtttacctcaggaagacaaagttgatttaacattcaaaaatcaataaatgaactttatcttattagcggactaaaaagaaaaatgcgcatgatcatctcaatagaaaaagcacttaataaaacccaacattgagtcatgattaaaaaccctcagaaaaccacggataaaaatgaaaagtcctcatagaataaaggccgtctacacaaacagcaacaacaacaacaaaaatctatatcttcctaaaattgagaacaaggtaaagatatctactctcaccacttttattaaacattgtactggaggttctatctcatgaaataaggcaaggaaaataaataaatcatctagattggaaagagtaacactttccttatcatctgtgtagatcagcccatggaatccatgaaataaaagccactagaactagtaagtgagttagcaaagtggcagagttctagattaatatacataaactaatggtatttttacatataacaatcagaaattgaaattttaaaaatgttatcatttccaataccattaacaaatataaaattgttagccataaaccaataaaacatgtgtaagacttgtacattttaaactacaaaacattgctgagagaaattaaagaagacctaactaaatggaacatgtaccatgttcatggataggaagacttgaagttgttaagctatcaattctcccaagttgagttatagatcaatggaatctcaatcaaaattccagaaggatttttaaaatgaaaatcaattattgaacttcacattttatatggaaaataaatgaaggacctagaaaataactttgcaaaagaagaacaaagttggaggacttatttatctgatttgaaggctaaatataaagctatattaaaacaatatagacaaatagatcaatgaaacacatagagtttccagaaataggctcacatatatatggccaatggatttttgacaaaagtacaaagacaattcgatggagaaagtatagtcttttcaacaaatgatgctgaatccccaaaaaagtgaactttgattcatacctcacagcatatacaaactttaattcaaatgaatcatagaccttaaactataaaatttttaaaagagagcagaaatctttgtgacttcggatacaacatcaaaagcataattcacaaaagaacaaattgataatatgcatttcatcaaaattaaaaacttccactcttcaaaatacactgctaagagaatgaaaagacatagatcaagagaatgtatttttaaatcacatatctgtaaaggacttctatgcagaatgtataaaactctcaaacctcaataataaaattcaaacatccaataaaaaggggaacaaaagatttgaaaagacacttcaccaacagaaatattgatggcaagtaagatcatgaaaagatgcttcatatcattattcaataaagagatgcaaattgaaaccacaaggtgacaccactacacacctgccagaatgtgtaaaattaaacagactggcaaaccaagtgatggcaaggatgtagagaaattagaaacctcctacactgctggtgggaaggtaaaaatggcacaaccactttggaaaacagtttggcagtttactaaacagctaaatacacctgccatatgatccagccattctactcatagagaaataaaagcatatgtctatataaaggtttgtatgcaaatgtttataacagctttatttgtaataaccaaaagctggaaccaatccaaatgttcatcaactcgtgaatgcgttaacaaattgcgtgtattcataaaattgaagactcttcagccatagaaagaaatgggttgttgatactgccaaaaacatggatgaatcttaaaataattttgctgaaggaaagaagccagaccccacaaaagtatgaggacatacactatgcttccaggtacataaaattatagaaaatgcaaactaacctatgataactgaaagtaggtcagtggttgcctggggacaggctgagggtggagaattgcagggaaggattacaaagggcacaaggagagactggggtgatggatatgtttattatcttaactgtagtgatggtttcacaagcataaacatacatcaaatgcatcaaattttgcactttcaatatgtgcggtttattgtatgtcaatcatccctcataacactgttttaaaaagaaatattaaaattaaattgtaaattatcaaagaaaaagataaccactgaaagcactttttaaaaacgtataactataaagacactcggattagactgagagcaaacttcacgattgcaacaatcacgaccacacacaatggaacaatatattctaagtgctaatgaaaataatcatcaatatggaatctatatcctgctgaacagtgttcaagagatagtataaaatgactgcatttaaaaattacttatttttaaaaattcacacataatactgtatgtatttatggggtatgtagtgatgtttctgtacatacaatgtatagtcatcagatcagggtaattagtgtatctgtcatctaaaatactgatcgttttttgtgttgggaacattcaacaccctctcttttagctatttgaaaatatatattgctgactatagtcatcccacagtatataaaatattagaacttattcctcctgtcaattttgtgtcctttaacaaatttccctatatctcccttccctttccagtctccaataattgaacctaggaagatggaataagatacatgaagcttggatgagcaaagaaaatgcaagataatacaggcaaatctaaaagagcactgagtgtgtaaaataataatactgacaactactaatgtaggtaaaaaatattactgtttatgagatcaactttttagcttctacgtatgagtgagaacatgtttaactttctgttcctggctcatttcatttaacactatgtcctctaggctcatccatgttgccatggaggacaagacttcattttttactgctgaatagtatttctgtgtgcgtgtgtgtgtgtgtgtgtgtgtgtgtgtgtgtgtgaaatcacattttctttagccattcatctgttgatggacacttgggttgactccatagcttggctattgtgaatagtgctgcaacaaacagggagtgcggacaactcttggatgtactgatttcctttcctttggctatttacccagcagtgggactgctagatcatatgctagttctatttttgtttttttgaggaaactctatactgttctgtatcgtgactgtacccaccaatagtgagtaagaatttccttttctccagctccacaccagttgttattttttgtattttgacagtagccattccagctggggtgagatgatacctcactgtggttttcatttgcgtttatctgatgattagtgatattgaactttttccatatatttgttagccatttgcaggtcctttggagaactatctgttcaaatcatttgcccactttaattgttttttttcttcttttgctgttgagatgtttgaattcttcgtatattctagatatgaatcccttgttggatgaatagttggcaaatatctctcaccctatgcaaaattaactcaaaatggatcaaagacttgaatgtaaaacctgaagctataaaaactactagaagaaaacacagggaaaatgctttacaacattggtctcaggaaatattttacgaataagacctcaaagcacaggcaacaaaagcaaagataaacaaatgggattatataaaactaaaaagcttcagcacaccaaaggaaacaatcaacagagtgaaaagagaactgacagaatggatgaaatgaagacttttagaaccaaaacatccgagagattgtcccactgaagacctacacacaacaccacactaagaggtatactttgaccaaaagtaaattgaacctgagaagatggaataagatacatgaagcttggacaagcaaagaaaatgcaagataatacaggcaaatctaaaggagcactgagtgtgtaaaataataatactgataactactaatgcaggtaaaaaatactactgaactaaaaccttatagaagataaacactaacttatgatttaaggggaacaacaacctcctaacctaagaataaaaaagaatttccttatcctgataaagatgattaaaccctatagaaagtattacctttaattgtaaaattcagcactgctctaaaatcagctccatttttatgcctcattgggctacagagtctggaagcacattgtgagaagaaaaaaaatcgttatagggtctaggaaggaaaaaaactaagctattactatgtgcagaacatttctgaagaggaaattcaagataatctagacagctattagaattaactagagagttcaatgaattgcaggatataaattcagcataaaaattactagcaaaaattagataagtaatataagattccattaacagtgaaaaaacccacaaggtttccagagatacatgtaatgatgtgcaagaccttcctgttaggaggaaatgggtaaactttgttggaaggcatgaaagaggacctaagtgaatggagaaatataccatattcatgaatggggagactccgtcatgatgaaaactatcattacattgatctaaagattaaatgtatttccaaaatatttttccaaaattagtttctcatgctgatttacaaaattaatatacaagagcaatgagccagaaatagccaagacatacctaaatataaaggtgagagagataacggatatcacaacttattttatagagccgcaagtcttaagagagtatgacatggttcagggatgggtaaacaaaataatgaaactgaggctacagctagaaaaagacccatgattatatgtgaacttgatataggatggggggcatcacccctcaatggggaaggggttcactacttggcacgtggtgctggagcaacagaaaacaaattcatcaagaaaaaatgaatcacagataggccaacacctaaatgtgagaatgcaaagctgtaaaagataacatgagtttatacgaatatcacaaaacataagggaaagtttgaggtatcagacacagtaaaacgtaaaattctgttcagaaaaaggcaccatcaataaagcaaaaaaatttacaagactcagtctgagaggatatatttgcaatccacataaccaataaagtatcactacccagatccataaataactctgaaaatcaataagaaaaaggcaagcgacccaatgggaaaatgagcaaatgataagaaacaataaatatcaggagaaaacgatgggcaataaatatgtgaaaagaggctgagcttcactgctaacactgagaaacacaaattaaaacaactagatgccatttttcacccattagagtgtaaaaaattaataagtctgatactactgagtgttgccatgaatctgtggaaatggaaactccgtctgttgctggaaggagtgtaaattggtataaccactttggacagcaacacagcaatacttaataataatggtaatgataacgctaatggttaatacttattgaacatttataaagtgccaggcactgttaaaagctggcgtggaaagctgacaacacacattcccacaagccaggggctctttctgcagtggcctggccacggcaccagcagacacaagcaaggctgctcatggtgtggtgggaaagcagaattcatttgtaagttcctgagtggggaaggatcattaatctgtgcctcattggcatgacggaacatttactccagttaacagaaacacactgaattgatgtccatcaatattgataaatttcaaaaacttgatgtgagcgaaaaaagcaagttgcaagaaccttgacactattttgccatttatgtcaactttaaggcacataaaatattggtggatgcaagcatgtgatagaaaagtattaacttgtaggtgggaaatacggacaccagccctcctccatagtgagctgagagctggctagggagctgctggagcctgccatccgtccatctgtccatccatccacaggagccaggccatctccagcgggggaacaccggctagggaagcaggagtcagccttgaggagctggaacctggaggaaggttactctaggaattcaaggacttacgacgtttgaaatctactaatgtcgtttgttatgattcagtatacgttaaaaagtcaggaaacagcagatgctggagaggatgtgaagaaataggaatgctttttttttttttttttttttttttagacagagtctcactctgtcacccaggctggagtgtagtggtgtgatctcggctcactgcaacctccgcctcccgggttcacgccattctcctgactcagcctcctgagttgctgggactacaggtgcccaccaccatgcccggctaattttttgtatttttagtagagatgggatttcaccatgttagtcaagatggtctcgatccgcccgcctcagcctcccaaagtgctgggattacaggtgtaagccaccacgcctggttctaagtctttgctattgtgaacagtgccgcaataaacatacgtgtgcatgttttatagtactatgatttataatcctttgggtatatacccagtaatgaggttgctgggtcaaatggtattctggttctagatccttgaggaatcgccacactgtcttccacaatggttgaactaatttacactcccaaaataggagtgtaaattaaagacagtgtggttggaaggaacaaaaatgcacccaaaacctgtgtgaggaaaagtaaaactttattggcagacacaaaagaaactttctgagtaaatggagagacatgttcttcttgaatgagaaaattaacattgtaaagatgtcaacggtctcccaaagtgatccagatgtgccgtggaatcccagtcaaactgcagttgcatcttttatggaatttgacacactgactgaaattcacctggaaaagaacatgcttagtaaacatggtttcctgggggcggggcggggggagggggcagaggggagggaacaatgaaaattggtcccgcagacaaggttcaagttagagatcccagaaagaagcagatgtacctccgtgcagtgaggtacactggagcaggcacatcccacggaaagggcagggtggacgatggaaaacaggctggaaaacaggctgccaggggacaaaatcaacgcagatttccaagtcacaaacacaggcaaattctgtggattaaagaaagacatctaaagatctacaaacacaaataaaaagaatgcttgatttcactggaaatcaaagatgttgatgagagtaataatgagaaattgtttttcacccataaaattgggggtggggagataaggattagactttctaacaatgacaaaagtgtaagaaaaacaggtaattggctgcgcggctggtggtgaatactttttacaaccttctcagaaaacaatatggaaatgtccaccatgaaggagcagagaaagcctgtttgaggcctccgctgtagctggggacgcctgcctgaacacagaagaatcatccatatccatgctagttgcagtttggtaatagaaaaaaaaaaaagaatcagaaggggaagaaaagagaagcaccttaattcttcgccggcagaggagagctccttacacagcagcatcgcccacaggacagaagcctctgcagccatcaaagaaaatgaggtcgaactaagtgggccaatgtagaaagctcccgggacatcgtgttaaatgtaaaaagcaagttgcagacaacgcatgaaatatgtatgattccatttgtgaaaaagcagcatcgctagacaaaactgtgtattttatttcgtatgtacacacgtgtgcaggtccatgtaaagaaagcagtccagacggtggggcggggttggatatgaagccagccctgctttgtgtctagataccctggcatgcttggagccccccaggcccgaggtcatgtgctcctgccataatttaaacaaatgccttaacagcaaaaagaaattagaatagtcagctggacgtggtctggagtgcaagacgaaggggcggtgcggagagaagggaggcgacctgaccaggcagtgtcttagggaccggagaggagtgaggcccacggcggtcctggggagcggcccacctagagcttgtcgccagtgaacagggagccgtggcgagagggacggggaaacccaagagaccgtggggtggggggaaagccagggaagccccaggcttctaggaagggcctggcgcggagtcagtggggaggagcaggaggccggcgtggccttggacaagaggctcggcggcgcgggggagccccaggacccggggagctgcggagggaagaggaggagcagagcgtggctggaaaggcggtgggacagggaggggtaagctgtgcggccgccttgtcccctacggagaggagccctgggagctgcgggaagagccgggagagagaagaggctgtgggcgggggacatggtgggggggtggacgggggacatgggggggtggacaggggacaaggggggtggacgggggacggggcggggcgggggcggggcgggggggtgggcgggggaggggcggggcgggagggcgagggctgtctctccctcaggactggggttagcgaggccgggctgcgtgctcaggagccgaggcagagaagtcgtggctgcgcagagggaggcggtgctctcctcgcggggtctggggtcccgcagcgcctggggcgggagcagtgagcaagcgtgggtgggagccgcggtctgggtccctgcgccctcccggctgcccggacagcaggtgcacccggggggcctcggcgcatttccagggcgaatgagtccagggccctcggcctgcaggctaagcagcgaggacagcggcaggggggctccgtggcacggcctggggggtcaccgcgcacgcctaggccccgggagctcggagacgcagcagccgtcgcgcggggctaacaaggcactccaggcgcctgcgccaccgacacggagaagggcgagctgcggagcgcggggtgcggacggccacgcccctcccgccacggccaccccgagcccaggctgccagggcggcatccccagcaggagacccgcgcagcagcccctccagcccccacaggagagggcaacagaccgcgctgggtttctgccggttagatgctcagatgctttgttaccgcggcacgaactacccccaccccgactgtgcgtgggtgccggagcctttgtccataaggatccgtgtgggcagtggcttaaggtggcttagggttccccagagacacagaaccagcaggacacacacagtcccgcctgcatctcagtgattgcaagcgctgacctcacacacactgtctatatcccataagattataacgcagcagaaagcctccagggtttagtgacatcttgatggtcctgatcctaggctgatgtgtgtgttcatgccttacttgttaacaaaaaagtttaaaaagtaaaaatttttttaaaaattaatagggaaaagcttatagaataaagatctttaaaaaacatttttgtacagctgtacttgtttgtgttttaagttattacaagagtcaaaacgttaaaaaattacaaagtgtataaaataaaaaggtacagtaagataagattaatttattattaaagatagaaaaaagtgttaatacattcagtgtttataaagtctacagtagtgtacactaatgtcctcagccttctcagtcacctacactcactcatgactcacccagagcctctttcagtcctgcaacctccattcatgggaacagccctgcgccagtgtgccatttttaatcatctatgccctgtttttatggtaccttctctatatttagatacgccattacttgccattgtgtcaaagctgcctcccgtgttcagtacaagtgacactctgtacaggttagtagcctaggagccataggctgcaccctgcggcccgggcatgtggcaggttgtaccgtctcggtttgtcagtgacctctgtgatgcttgcagaggacgaaatcgcctaaccacacgtttctcagaacacatcctcattatgaagcaacacttgactgcgtgtctgtgtgctgcgtgtgtgtgtatacatgaagagatttattacagaaattgacccacaagattatagaggccaagaggtctgaagcccaaagagctgctgcctgtaagctggaacaccaggaaggccagtggtgtggctctgtctgagtctgaagccagagaaagagcatcactgaggtctgggggcaggagaaggtggctgccccagctcaagaggagatggaggatgtgccctgactccacccttctgttctacccgggccttgggtgggtgtgatgatgctggcacatattggtgagggcagatcatcttcaccagttcaaatgctaatctcctctggagacatcctcacatcgacaaagaatgcttaccagctacctgggcttcccttagcccagtcaatttgatgcatgaaattaaccccacgagtccaccctttgtcaacttagcatccatacaaatcttcaactatatttagtctccaataaatacaatccgatcacagtcctgcctaatctgatacaactatcgtacatacaaccaaaaacacactaattccttccccaaaagagctggtcaagtccttgagtgatagtcacttttctcctgatgtcccgtaacataaaaaccaagatgtaaaattaacagcgtttaaatactgatacgaagttgttacattttatgctacatgctaaggagataacagagaaaacaaatatatttggttaatatatgtatatattcacacaaacatataagttacaaaacgaggaggacattctgacaatgacagtccttatttctcccaccagccatgtagttgtcactggtattaataacccccttcttccaccacccaatccatatccctttgcccttagcaagcgccgcagctggccatggttctttactggtggactgacccaaaaccttcattcttgaagggtctgagccaatagaggtcctgcctgaattgtattattgtggtttccagtgactttaatcacagagcatggcagtgccaagacatgcctgaggatctcctgtctcccagacacactgttccttccctccatggaggagtgcagtccaatttcccctcagtattccaatcaatcaccccagccagcgcctttattcccctctcagcctgctgactcttgaggcttgagggtcccaaaatggcatactaactttctttcttttttttttttttttgagacagagtctcactctgtcacccaggctggaatgcagtggtgcgatctctgctcactgcaagctccacctcccaggttcacgccattctcctgactcagcctcccgagtagctgggacgacaggtgcctgccaccacacccggctaattttttgtatttttagtagacacggggtttcaccatgttagccaggatggtctcgatctcctgacctcgtgatccacccgccttggcctcccaaagtgctgggattacaggcatgagccaccatgcccagccctaactttcaattcaatgggatcactgttgtgcctcctggttgaagcatttctgcctctggaactaagacccataggccagcagaatacaaagttgcagggagcacctggtcccagccctgcaaggtattgccatctagttggtaattgaccttcaaaaggccatcgcatcattctatcacaccagctgcttcaggatgcaacatgagcatcgttgcacttctttggctgtgaagtgagttcctcggtgagaagcagtgcgaggtggaacaccgtgacagtgggtaaggcatcctgtgagtccatggatggtggtttttccagtaaggacaaacctctgccccttccatgctggggaccatgcaatgttatcaacctgccccaggtagctggctgatcgcctgggaatggtgccatatcaagggcttggtgttggtctccgctgctggcagattgggcagtcagcagtgtccggagccagttaggccttggtgaatgggagtccatgtttctgagcccatgtactacctccatccctgccaccatgcctgcttactttatgagctcattgggccatgacaggggtggcttggcaagaggctgaccagtgtccacagaaggagtcattctgtccacttgattcctaaaaccctcctctgctatggtcattcattgctgaccattcacatgggacagacatatcttcatgatttttgcccattctaagagggctatccacatatcttttcccccaaatatcttcttcaccaatttttccaatccttctttccatgttcctgaccatccagcataaacactgagcacggcccgtgaattagtccatcactgcacaactgcccactgctccttccaagcaaagtgcacagccaggtgcattgcccacagctctgcccaggaggacttcccttccccactgtcctccagggatgtcccaggaaggagctgtagttctgcagcatccactttcagatggtgcctgcatatggggcagagccatctgtaaaccaggcctgaattatctcttactctgtcaaatgatcatggggagctcccccacgaggccacaggcacaggctgggagagaggatctcagctgagaaaggcagtggagcaggggtggggaccgtgggcactttggccctttcatgtaacctacttgagcattcagggtctggttggacccaatcacatacgtaccacttccatttgatgacagagtgttgctatgcatacctaaccatgtggcttggtgggtcagataacaccctctgacacacagacgtctcaccaataaatgtagagtagttgctacttcttgctcactaagtccaatccgcacaatgtcatcaatgtaatgcaccagtgtggcatcccatgggaaaagcaaccaagattcctgcagactaaattataatgtaaggctagagagttgatgggacactgtccctgagatgggacagtgaatgtgtattgctggccttgccagctgaaagaaaactgcttctggctggccttctggacagggatggacaaaaggcatttgctggatcaatagccgtgtaccaggtaacagaggatgtgttaatttgctcaagcaatgaaaccacatctggtacagcagctgcaattggagtcaccacctggttaagcttgtggtatttcagtcactctccaagatccatctgtgttccttacaggccaaatcggagagtcgagtgggaatgtggtgagaatcgccagccctgcaccttgcaagttcccgatggtggcatgatctccacagtccttccaggaatatgggattgtttttgacttatagcagtcaccacttatccctggtttcactttccacattttaagtgacctgttgcacagtacaagatattttgagagagagaaatcacattcgcagagcttttattgcagcatattcttctaattgtttgattttattattgttgctaatctcctacggtgccaaatttataaattaaactttatcattggtatgtaagtataggaagaaacatagtatatatagtgtttggtggtttatatgtccatggtgtcaggcatccactggggtcttagaacatattgcctgcagataaagggggactactgtattattttcctaagcagttgcaatggcttctacttggtcttcttcactgtaatagtccttactccacaggtcagggacccaatgtgtagatgctaccagctcctcaattacgtctcttccgattatgcattctggaatggggaaataactacaggatgggtttggggacccactgggcccactgtaaaatgaacctgagctaaaactccattgatcattgagctccataagcccctactctgcctggatggccacagagaccttttcaatcttctggagtcaatgtcagtgcagagccagagttcagcagtccctgaaaggtctgagtatttccttttccccagtgcacagtcacctggtaaaacgtaaggtaggtccctttgggaaaggctggggaaaagattaagagtatacatttcggggaatttacagagttgtttcccagggggacactgtcgtcccttcattcgctggttctgagtctgtagattggctcaggtctgagaattggttgaggggccatgactctgtgctttgagagtcatgattttattatttgagttagacttttgtttttagagactggatatcattacgtcatccaggctagagtgcagtgatgtgttcatagctcactgcagcctcaaactcccaggctcaacagatgcccctgcctcaacctcctgagtaactgggaccacaggcatgtgccactatgcccagattcgacttagacttttgttcacttgacctaaaactttcctgcttatacagatcatgtaaggatttagtaggcttctgatcaaattcctttccaggagccccatgataacgggccagagccatgagtctcatgagccaggttgttctgattgctgctgtgccactcctgcccattgctatgcctgcacccaccttgcctgtgggatcccccaccacaggatccagttgctccccttgcacttaggtctccagctgagtggctgtggttcccaccataaggtctgacttacagggacgagttatggcggagctcttcaaggaagctgggaccccctcacacagttctttctcgaggtgttggtgaaaggccagtcttccagatccccgcgtgtgggcaactaggtctgaaatgacaaacccactctaacacaccagcttccctgagccctttaaaccccctctacattaaaccggggagtttggatctttccagtttgctcacggcagggcagactatcttttgacccctgttccgccatccaaccaaactgagccctttctaactcgttgacctgcaacattaaatccagaatcattgcttactgagcccatatcaataaatttggcctgatccaactttatgttccttccactaccatcccacacccttaatattcattcccatccatgttccctggatttctgctcgtataaattagaaaacccatgttgttcttttggagagcagcataccttctcatgggtcacagtttgtccctcaccttcagggcctactggggtttgggtctagttatagggctagaggcaaagaggggcggtgagggtgggtcctgaaaataatcagcattgtcctgcttggccaccacctcagaggaagatattactcaggatgcgggggactccttcaagtcaggtggaaaggctacaccactgttggcagggatgctcctgccaccagggatgtgaaggccactttttttgagcgtggggggacctcttccactggcaaataataaacatcagaacttaggggcttgatacccccagcttcatcagggtcttcccacatgtccccattgcaacttacagtatcccgttctttcccagtcaatttccccactcaagagtagacattccaggaggctgggagctcaacttgcattgtattaataatttggccaattgcaggatgaggtcctgagtttgattttcagaaacttcagccctgtggttgtatgagataaggctcctggggcaaacatagaaactcttaggtcatttttgtggctcttgagctgggaatttgaatccctgagctcatctttttcttttaccactttgtccaatgacattagaagcaaccaatgtcattatattcctcagttttcctaaaatgttcaaaagtatcatatacagagtcatgtagctcctcgcttcttacaagtagtttattagaaggatccaatgcagatattttgcatatctctatagtttgtgccatggatgatcagtgctctctttactaccggaaatacagtcattagtgtctttacatatagttggattaaagagccaattccagaaactccagaaagaattcagaaaactcgtcctcaaaattctggtcctctagatccactcttggtaccaaaatctatattattcagagttctacaaaaaacagaattaatagaatatgaacatatatatgtatatatatatatacatatatatgaggagatttattataggaatcaacttatgtagttatggaagccaagaagtcccacaatctgccatctgcaagctggagaaccagggaagtcagtggtgttattcaatctgagtccaaagaccagagaatcagaggcaccaatggtcgagggcaggagaagatggatgtcccagctaaagaagaaagtgagttcacccttcctcaggcttttcgctctactcaggccctccttggattaagtgatgcttgctcactttgatgagggcaggtctgtactcagtccactgactcaaatgttaatctcttccagagacaccttcaaagacacatccagaaatgttttatcaactatctaggcatccctcagtgcagtcaagttgacacctaaaattaaccaccacaagcagggaagatggtgtgggaggtgagatgtgtgtctgtgagcagaagccgggtgggtctctgcatgaacatgtagatacgggtgcaagcatgtgggagctgctggtggcaaaactcaacagaagcaactcgtatttaggaagcgaatcaagcgtcccatcctttgagccccatgacatttcatgatcgggaacaataacagactcttagagcaagatgtataataaaaagctaaattttcaagtatggtttttggaagaatgtgacttctgaattttaacaaaaagcagaaacaaacactttctttcacacttaagaattgtctgccaggcttctggaggcacctgggccatgtgggttcactgtggtcattcagggaatggatggacaatggtgagtttctggagcacggacatgacctttggggtagagggagggctccaacaccaaggcccccagcacacatttcacgaggaaaaatgaccatcaactctgctgaaactgagaagggaattttttctaattagaggcttcacattaagcatgcattggcttcatctggagtgtgcagtacagaatgattctcttccccattcctcaccaagaacagtaattagaatgcaaggtcatctccatataatgcattatgactttaatatcagtaaactccccttacgtgttagatgcagtgaggaaatagtagttaaattatcacagactagtatgatcagtttccgctaggataaaatgtgataaatgggttttaataaactgaggagaattataggcaccatcttcttggttgctgtcaattttatttagagtaaaatgccattgcgataattagttggtttttactgtgttcattaaaagcttttctaatgaccgcttgaggaataagtaaaattaatttctttcttgaacgtcgaaggaattaatcaaacaaacaaaaagcaaacttcagggattgtgcgagacgggatgagggccggtggttttccgtgcccgctgtggggacagcactttcccgccgtctgtcgttggtgttgcagctccaggccattcccccgagctgtgctgatggagagggatgcaagccccggggcagaggccttggccgtccttctcaggtgccattgagctgtgactcccaggccgcctcctccaggcagctttccttgactgctccaacttcagggctctcttctgcctggcccacacacttgagctagggctcctcagtctcagaggctgaggccaggttctctctctgcctgtggccccttggagtccagcacagggctaggcactctagagggctcaagggcttgagcctgagatcctggcctgtctcctcttggacaggactccttgggcctcctggccactaccctatgtcccagcccctgcagtgcttgcccaagctcagcctttgttcagcacaccagccctgtgaaccacactgtccctggagggactgagggatgtccaggggtcattggtggcataaaggatggagccactgaaacgcagtgggtggatgcaggaagaggagggctgcccagcaaggccacacctggcctggctcggaggatgccaggaggagtctccagcaggcaggcgtggccagaggggccgcggggtagccagatggagtctttgtgctgaccccacagtccacagggaggagcagaaaagtgggtgaggcctgcggagatgccatcacctggctgggggtactcagtggcgaagggagagacaaagccagacaccgctctggctagtgggaagagcaatggtccttctgacctcctgtgccaggtacagcactagcacgggcctgagaacctggctggtgagcacatccacctgcacctgtacccatccccactccccacacacgccacacacacacacacacacacacatgctcatcacacacacaccgccacctgcacccatcagcactctccacacacatcacacacacactcatcacacacacccatcgcacacaccacacacacactcatcacacacatgcttatcacacacactcacacaccacacatacattcatcacactcacacacacaccacatgcttatcacacacatgctcataatacacacacctccacctgcaccagtccccactccccacacacatcacacacaccattgcacacacaccacacacccactcacacacaccacacacacgttcatcacagacacacacacaccaaacacatgcttatcacaaacttgctcatcacacacacacacccctccacctgcacccatccccattccccacacatcacacacacactcatcacacacacccattgcacacacaccacccaatcacacacacacatccacctgcacccatcagcactccccacacatcacacacacactcatcacccacactcatcacagacacaccacacacactcatcacacacatgctcatcacacacactcatcacacaccacacacattctcatcatacacactcatcacactcattacacacacacttatcacacacatcacacatatgctcatcagacatgctcattacacactcatcacacacaccacacacacacaaactcatcacacgtacacctgcacacagccacacacacaggcccatcacacagacaccatgcaccacacacacactcatcacacatacacacaaacccaaccacctcacacacccattcccccatcacactcacacccccacctctgctggatggagccccaccatccttcaacgcccagttgacagctcatcgtccttgacgcttccccaccccaccgtggcctactctgcgccccaccacacttccctctcccgcccacaaggacctcggtaatgtcgcccctaaaactgctgcggaacctgcagccggctgtgacgcagaattggcatcccagctcggcccctgcacacccgacgcccggaggggtgccttagtcctgagactctcctggttcttctccctctccagtgaggtgagaaggtcaatccggccctgtggggtatgttgagggttaagtgagaccctcgtgctcatgaagaggccaggcaggtcctctgcgagtgccacagccccaggcttgtgcagccagctcacggaggcctcccaggccctgaacacacacaggacagggctttcttgcattatcacctgagtgacactgctagggggctgctctctggatgtcactgcggccgggtgccgggacagccggctgcttgactccaggacttagagcttgacttggccttttaagcctctgtctcagtgccctcgggtcccttccgccccctctgtggctcacctacctgtccctcggcctctggggtgggctggcagggcttgttctgggacccaggtggggtggcagcagtggctgtcatggtgcagcaccagcttcccggagtgcccggtctggggatccccagcgaaggcaccgaagctctcttcttggctcccgggcctgtgaggcccagccagctccaccccagcccctcccaccccaagcctcacaaggaacccccacctggcagctcaagcccagccccctttcctggggtcctgggagttcccaccaccaccttgtggcaatcaagggtaatgtgtgggctgctgggcccttggtccctgtcagggtcactcagagaggcccgggtggacatgaaagttcaagtctaagccgcatccaagccaagactcaggaacaagcagggaccctggctgtagcgcccccaactcaggagcagctctccggcttctcattcccctggctctttctggctgagggggcttctctgtgtaactcggccaggtcctctttccagcctttttattcttcctgcagtcagaggcaggggcagagggggcctctggtgccagctctgaggcctctcttgaagcccagcctgaaggtggctgaccccacccgctgccacccccaccctgagatgggggcttagcgcctttgtcttggtggcttgccctgctgggaccccttcctctaatctcagaatggccgacccctcgcctccctcacggcgccatttcagagctacattctcaggcagacccccgacctggcgctcctagttcgcccacccacctgtgctgcgtgttcccaggcgtccgccacctgcagcaggccacccggtcacgtctccctcctggcgcgctttcatcctcgagccccttctggccccatcctccagctcccgccgtgttgctcagagcagctcacggtgggcacgcggcgactctgaggaatgggcgttcccacagctccccggcttccgtgacggccacgaccggctctgcagggcaagctggcctctgcaatcaccgcgcagcggcccctcacaagtagcatttttgcacttggcagtctacacgctttttcattttaaaaggagtttgtccctggtgtttgagaaatatgcccaagaacacagcccttctcagagagtctggattctaacaaggaaagctcttggttacacaggggagtccacggtggtgcaatgtcggctgaggcatggccagcgcagggcaggagctgggggactggcgcctctgaggacagggagacactcatcggagcagcagcacgctgcttgcacctatagaggccgcgggctcggcagagctgccctcacgatactggtgatttcgggagctctctctagagggccgggagatactgcagcctcagaagtggctgccaggagtggctctggcagatttagacggtgatttagtcggtgatcctgctgccgtccgtgttcattctccagcagaagccacacctcactctccccttagagcgagggagagatatgctcaattaagctgggggcaaatggcgtctgcacagccagatccaggggccaggaggatgggggactgcccgggaggagtctccacgccatgtgagtcaatcagggaaccctaattggaaagcagtaataaaaagtaattgagtttaatacataatttagatcgttacccgttaagctaatgcctcccgcttaggtgtggggagaaaattatttatctcgtagacggggaagatttcatttgtttttataatggaatgctcgccaattgactttaataagagcagtttgttaaatcagattttgaattggtgcatagatttgaagttcatatgttaatatttgacatgatatacttagcgcctcccttctccccttaaagtggctggatttattctcccgtgaggctgtgcgctcattgttgtcctacattatggaaattaaatcggttctctctggtgtcttgatgggaggcaatttggctcctgacttctacctttttttttttttttaaattaaaaaagggacattaaagagtctctgcttgcttctttgcagggcctttttcctcttgaaaacagtcccagggctgcaaacaaatgctttgcttaaataccagaaaggaacttactaacaactccttacttgggtccagccatctgccattccttagccgtttgattttctcagcaatcctatgaagtcaagcggccactaggaacccggctcctgcgtgtgcacatcgaggcctggggcctggtccccacccgtaggtgggcgccagcctggcagtggagaccaggcttttcacacccgcaaggcagggccgcctgggcctggacccaagctcctctggccagcctattgatggagactctgggactcagtttccctatcaacagaagagggataagatactgagtacctcagaggggattttaggatggaaggaggtgctgcctgcccggggcacggaacacagccagtaccaagagcttaactgtgagcactgcaactaccccagtggagtggctcccggacccctccccaaaccagctcccccgaccccaacagccgtaccacgaggcagatagcatctgaccgagagggccccaccctcacatctgcctctcaccagctgtggggcctcaggtgggcgtccctgtgctccaggcctcagcatcctcggctatgaaacaggctgctgaggcctccctagggcacccagtgtccctgtcaagggcagaggggatcttgctgacaggctacaggagaccaccccaggagccaggggtttgcacggtctcctctcggggcagccgtccaggcagaacctcagcccccagatggcaggatcggggcgaaagctaagtcatcaggaccccaggtctggaggccgtccctgcccggttcctgcagcagcctcagtggcaggtgctggggaaagccctagtgccggcagcctttacctcgggtccccctggactcccaacccctccagctccagcctctgtgtcccacagagaccccccagcgcattgcagagagagctttccacagccccagctgcacccccacttccaacttgcctctggaaacagccatgaatggcaggggagggcaccagaaggaaggcctttagggagaacgaacacaggtctccactctcagaaacaggagtctccacagagcccccaagggaccctgggacaccctggaagtgtccactgcacactggagccacctcaagagccatggggcttggagccccacggtcctggagaagctctccccggtggaacatcggaataaatgtgtgtagctgtgaaaccccactttacataaaatcagaaagaaagcctgtgtaaaacagatttctaagtacccaaggcctgagacacaagcctctcctgctgagcacctgtgcagcctcttcctgcccttctcgcctccaagccggcgcagctccttctaaaacaccttggtgcacccagggtgcccagaggaaggtgggagcccatggcagccatgtggacgggagcgagcccctccaccagcatgctgggaggcagacggtcggggaaggggtgccctgccactctgctgcggaagaatctgttgccgtggaagcatccagagcaacaaggaggagatgactttgtaccccaggaagtggggctctctgcccagggacgagtgagctcatgtgcaaggagggcccttaggactgaggcacctggggtgggggtgccaatcccggtcctgcccccaagggcactcggcatggatgccctcagcaaactctcctcaagaccaggcacagggcgaggcaccttaggactgaggcacctggggtgggggtgccaatcccggtcctgcccccaagggcactcggcatggatgccctcagcaaactctcctcaagaccaggcacagggcgaggcaccttaggactgaggcacctggggtggggtgcaaatcccggtcctgcccctaagggcactcggcatggatgccctcagcaaactctcctcaagaccaggcacagggcaaggcagggcctgtcctggagctcccaggctgggcagtagggacggccagggcgaggggccctggtgtgaaagtccaggtgggaaccgccctaatcgctcccccgtcccagacctgaagctgcccctggggctgaggagcctcactctgtccctgggccagggtcctgggctcccccgcctgtggagcaagagccgcagggcagggatgggcaagcaccagcacccacggctgcggccgcagtccagccacctcagagtccccaggccttcacccagcctcgcaagccccgttgcccacacctgggttcatggatttgagccaagctcacccatctgcccagtggctttggatttgagagcgtccatggctccccctacgcccaagccatgcctcatagtcccctggggtgggctgaaggtctctgatggaaacctgctctcactgtatggagcacaggccctggcccactgagacacccaaacagagtcactcagtggttcagaaacagggtgggcaggactcccaggtgcaggggcagtggggattctgagccctccgggaaggggtgttggaatcattagagtgaatgagggaggggattgtgtggttgttggagggcagccacccagcaggactttctaggaggaggaaacagtttctttcttggctccccgtatggtgccacatgggccatgtgcacctggcgcgtggctggcacccagcgtcagttcctttcattcacttccctttaagcagctccgtggacgagcagccactgtcctggactcacacaaagtctcagccggcgtgtgaaagcctggggggagctcagcccctccactcagaggcggcggccgtggccactgccccgaacaaaaggaagagcttgtttacaaattgtccattgaaaattgagttgcaaacatcggcatcaggcctcgcctgccaggccacccggattggagagtaatttatgaagattgctttacctggggccgtgctggtctgtgcctgcaagtaattcacaccaggctcattttggatgcagtcaaagacccccgtatttcacggtgacaacgtaatcacagaaccacattaaaaagtcattattgtttagaatccagcttggtttgaaaaactcttactataaaattcaacagcctttgtaaattaccgaaaggtttactcaagaatcctaggtgccgtgatttagaccgggaagttaccactttattgattctgtgggattttgttggtccccgcatttataaggaatgattagtgagtgatcagagtaataaactcctctgtgctggttcataaataatgatgaattgagtttgcatcctcaaatttctcatgcaaaccactcctattccgaagagtcccagatgcaactttggggcagtgtggccgttagcccccacggggacagaacacagggggatctggcttctccgcttgcctcttcataggatcccagcaggcctggccactgcatcccaggatagcagccgtggagccggactccatttccccccagctcgaggggtgctgggggccactggcagagctcctgcagatgcagatgctcctctgcctccatcatggcagtccagggagcagatgtgtgtctgcacaagccctcgtcactcacacatggttgaacaggcaggacgtggccaattccttgtcagttttgtcctgagaggcagaaagcttgcccctggcggccttgaaatgaggggctcatttggggctcctgaaagctgaaactccaacccaggaagtgccccagagccaggcaatcctgacacactcactctccttccacactgggagacagcagctctgctctgcccaccggcccagctggcttccagccaggttctgccctctgaggccctgaaactacacttgtccctttttagaagttgtcaatgcccaccagtgcccaggagactctaggaaggactgcagtgaaatgctcaatgtgtttaatccatgtttcccactggcccagccatgcctttgacccacaggacagcagccatgggtgtgcttgggaaaaccaccatgatgggtccaggcaagagcaccagcctgagcatgggtcacgctaacgtgggtggctcaattaaggaacagggatggacttcttgttctgtggcccccacacgctcctgcttcatccggtggccatttctgggtgaggcctgttcccccacatctccgcagtgggtccctctgcccaggctgctgccagctcccacctccctcggtgcccagcgtgaggctggggcacagtggaaggtctgtgaacctgtattaagcaaaatagaaactaaatgtggacttgaactggactgaaatgaaattgagttagactgaatgaaaatggattggaatggaatggaattcggatttgaactgaatggaattgaattggaagtggactaaaatggaattgaactctaatctaaacaccagtcaggcaggagagatggacgggctgagccaggggagctgccctcaccccacctgccccctgccctggggaaccctctggtcaatactgctaataggaactgaaaattaaagaaaatgatgctgatggatttcctttaatatgcacagacgcagctcaaagagagtgtttctggaaaagcagtaacagagcctgcagaggtcacgaggcacctggaccaaaccctgagatgctcccaggaacagcacttgagttgtgcagtttaaattcgaagcgctgtccaccttcagcaagcacctgagccacagaagaggcccccagaagccgtctccagcagacaggaatgaggaggcactgcacacgggcagggtgcatgcgggcctgcagtctgaggaacacacctgacgtggggcagcaaggattttccaccacagggtcactctgtctgttcagggtcccaagggcaccgagaacaccaaagacttcaagggcctgacatcaaacactgctctaaggggtgagcagacacctgccaggagcagagggagggccccctggagagcaagaggactcagccttccagcactggccgagacgtggagctgcgaggtcactcaccaaataacacaacagcctctagaagtgggaacggccctaagctgacagcagcaagaacacagagacctcagtcctgcaaccttaaagaactcagtcctggtcacagcccttgtcaccagtgggatctggtcttatttttacaggaaataaacatggtctatgagaatgttaccaggtccatgcccttcacccagcacccttcggcctgcttctcctgcacatgagaacattgttttaatcagcaccacaccatcagcatgttcgggagacttacaggaccccattctggcatctctcagggcatggtgttggtcaagaaggtgtttccggagcaaagcgtgccctgctgacccccaggcaggtggcattctctgcttcagggactgtcttcattctcctgtgtctttcgggctggatgggcggtccaatgtccactccacatttccccaatttcaagttctttcctgcattgagggggagaagccaggaaggacccccaggccctgtcccctagatggctccagtgaggttggcaacaggaggagtaaggtgaaatttggaaggtggcggggggacccagggccttttcaccagctggtggcttctccggcttttccacccactcccccgtcaccactactgatggcgactcgagatttgtggtagtttcctgggtaacccctgaggacccctgccatagtgattcaggctgggcccatctgggctttctttccagcccctcctacctcacctccctgtgctggaccctctgctctactgcttggagccctccatttcccagccccacccaaacccatccatgcttgaattcttttctgctctatttcttgttgttcttctttcatttttctttttcttttctttggaggcagaaacaaaaagatccctcttctccctaaatgcctgtatctctactctcctccgctttctctgtggctcagaggccactccatggcataaggttgccattctgatgtttcccaaagcttgaggctgcctttcctggctgggcttcccactccccaggaagctcactctctacccatggctcccccacatgtctgggtggccctgacgtccttgctccaatacccatggagatcaccttttctagctctggcgagagctccaggtccacaccttggctggagcggaccggagcctcctctcaacccccagccaagtgggcacctttctctttccagacctgccaagccccccgcagccagtgctgcatcggccactcccactgccagcaacaagctgggcaggctctgagcaccgcccctgctgccccgggtcctgggtccacccctacagagcaagcccacccgtccagtccccaccgtaccaccaggcacagccctccacagccctcagcagcacaatctgaaagcttctggatttgctcttcctggctgtttgcctctctccccatggggaggctatcaggggaacccacccccaatatttcaacgtaggttctttctattttccctacgttttggctggctgagaaataaaaagaaagagtacaaagagaggaattttacagctgggcctctgggggtgacatcacatatcggtaggaccatgatgtcctcctgagctgcaaaggtttttattaaggactttcaaaggggagggggtgtacgaacagggagtaggtaacaaagatcacatgcatcaaagggcaaaaaggagaacaaagatcacatgcttctgaggccaataaagatcacgaggcaaagggtaaagcaaagatcacaaggcaaagagcgaaatcaaaatctcctgataagggtcgatgttcagctgtgcacgtattgtcttgataaacatcttaaacaacagaaaacaggattcgagagcagagaaccagtctgacctcaaattcaccagggtgggttttttcccccaccctactaagcctgagggtactgcaggagaccagggcatatttcagtccttatctcaactgcataagacagatactcccagagcggccgtttatagacctccccccaggaatgcattcctttcccagggtcttaattattaatattccttgctaggaaaagaattcagcgatatcttccctacttgcatgtccgtttgtaggctcttataggctctctgcaagaagaaaaatatggctctattctgcctgaccccgcaggcagtcagaccttatggttgtcttcctttgttccccaaaatcgctgtcattctgttctttttcaaggtgcactgatttcatattgttcaaacacacatgttttacaatcaatttgtatagtttaacacaatagtggtcctgaggtgacgtacattctcagtttaccaagataacaggattaagagattaaagtaaagacaggcacaagaaataaaagtattaattttgggaactgataaatgtccatattaaaatgaaatctttacaatttatgttcagagattgcagtaaagacaggcgtaagaaatttataaaagtatcaattttggaaactgatatatgtccatattaaaatgaaatctgcacaatttatattcctttgccacagctccagccagtccctccattcagggtccctgactttctgcaacagacacaactctctgagtccccaggacctgactctcacagtgctcagtgattatttgttgaatgaataaatgtccttgacaccacctccagcagtctcccctgcttgcttctgagacggtttctctctttcacacctgtcctgactccactggctcgctttcccaccctattctgcgaccctagcatctttcgttttcttgtatttcttcttaggttttgtttttcttcatgatctgtgttctttgctccagtgttttattatgggatagttccaacattgagaacaaattacgtaggataatatgaactgaacccaccacctgggcatgacaaatattagcattctgccatatttgctttaggtaatcatttttagaagtaaagcattatgaatagagccctggtatatcattcagcaatcacattttcctctctcctccacagccttctcaatcatgtttgatatctttaccacaatctatcctgctgtttagtaaagatatgttttaatactttacacaaatcgtaccccacggtgcttataatgtgtgccacttgtttcttttttaactcaacattgcattttcaggttggtctgcatctgtgcaggaccaactgttgcagatgcctctgtcttactaatttctgtgagttctctacacacgctggatgatgaacactggtctgtcatgtgtataacagaccaactactggatagtactttgtacacatatgccatggatgtatagcctgtgctcactcgccagccttcattgttttgatgggtcactgtcataaggggggcagcagcccacattcctggggaacctttcttgtgcaaacatgcaacatggtccctagtctaggagagagggactttgccaggtggagggacatgcctggttccagcttcactaggagtagccaaatggctctttgaaaggtggagccaatgaaccttcccttcagcatgggctaagcgctccctcgcccactgccagcttttttactcttagatccctaatctttgttaatctgatgactgtaaaacaaaaggttactttaatttgcattttcctggtaactggggagagtctgcatcttttcacggtcattgcatgtctcatttccttttctgttaattgtgagtttgtatcattcgcctggttttcactgagttcattacacagtaaacatgcatatgtaagcacatatatctttactgaaacaacaggatacattgtagtaaagatttcaaacatgattgataagactgtcaaggagagaagaaaatgggactggtagatgacataccagggctccactttattcataaatgtttcacttctctttgtctcattgatttgtgtgagctctttatatgagatggataatcatcgtctgcctgttatgtttatagcaaacatttcctcctgagtgtggccggtcttttgactttcagctttgtttatggcatcttttgttgtatagaagctattaatcataacatagtcaactttatcaaatttcagttttatggggtttacgtttgtatgtcttacttgagaaacttttctgggccaggcgcagtggctcacacctgtaattccacctctttgggacgctgaggcaggtggatcacttgaagtcaggagttcaagaccagcctggccaatatggtgaaacccgtctctactaaaaatacaaaaattagcctggtgtggtggtgtgtgcctgtaatcccagctactcaggaggctgaggcaggagaatcacttgaacctgggaagtggaggttgcagtgtgccactgcattccagcctgggcaacagagcaagactccatctcaaaaaaaaaaaaaaaaagaaaggaacttttctgtattttgacatcataaagctatttcactgtagtttattctaaatgttttaaagttttgcatttcgtatgtaggactttaacccatctgagctttattaccggtgcagtgttagataataatgtgaatattttacctttctatcagtggcatttgaccaacaaacccccattcctgttgacgtatggatccctgtggtgcacagcaggtttccactccgtgcaggtctgcttttgcctttctgttctgttctgctgatctgtttattcttgaatagtctttatcaaaactagaggaaatcgctggctatttgttagagaaaacatctctaccctctgcttcttcttcaaacctgtcttcaccatctttggtcctttgctattccatgtgaaggaataatccaccttatcaggtgccaggagaaaatgctgctaggatttgaatgaaattgcatttaatttattgattattttacaggaaaacagaacatttgaaactgagtttttgcattcatgatgtagccttccaattagttaaatctttgtctatagcccttaataaaattgtattagtttctcatttaagatgtcccacatctttattatacttatttctaaatacctcagtgttttattgctattgcgaatggtgtgttttttctattacagtctccaattagtgttggctattgcatagccatgctgtggacttttatatcttcttatattaaacctcattagctctcattgtaaattcttagaaaattttatgcagaaagttatattgtctaccccaaaaatatgaaaatgtatgtctcctcctttccaatcctcactcctctttttccatcttggcctgtaacattggctagatcatcagaccatgctgagtgatggctatgagagagtcaactccctgttttccactttaatgggactgcatctggagtttcgcgggaagcttgaggcttgctgcaggctggccgtggtggccttttatcaggcgaaggtcgtccttgtagcttttgttatctacgagcctctgctgggaaggagggtgaaataaatgtgggttacatcctctgagatgaccatagcttctctcctgagacctgctgatgaggctgatgataaaagtggattgcctagcgatactttatgcttatgttcccaggacaaagcttgcttggtcataattgattctgcagccagttgcccatcctcacccctggtgtggccagccaggctggcggtgtgcccaccctctgctgaccactggctcttgctgatgacccccacccccacatatacacatagctcaatggacaaaaaattctaggaagagactggagccattatccaggtatctattaccaaagagcctcccatagtggggtagttccatcaaaagtagtaaccgacccagggaataggtggatgtatttctctccagagcaaaaaggttgatgcatacacatctgttctaccaaataggcaatctggtgactgttgggctagggatctgagggcctctctgggttctccaagtgcattctctcccaatgccgggatgcagggcctgcctcctctgagtggctgtcatccgctctgtctctaggacgatgcacccacagcaccatcagcccagcacagcacccaccgcattccttgctgccctccgacggctcaggtgtcccagacgttgggtgcagtctagcaatggggtggcagggccgtgactggactcctggcatctcttatgttagatttctttcctctgctcaatgccccccaccccgaaaggaaaagatgtgttccagggcagaggatgcgagttgaattcacccattgaagttaggggtaccgttgacaggggcagcggtcagacacagccatgggtcagcagtgcataaaaacgatttgggagtcatgaggctgaggatggcatctgacaccacgggagcatgtctgactcactcacacgcccgccatggggctgagggtgagctgatgaaggaagaaaggaaagaggagctggcagataaattggttttaaaatgacttacaatgttgtgattcattggttactccctgggcctcccctcgcctgctcctgacactgggactcaccgtggaggtgtctggaccgtgctccggggggcagcttcaagcatccccaggtgtctccttcagccattctcattactctgctccagtggtctctgaccggtcactgctgtgggagagaaaagctatccctttatgtcacttcgttgcagaatttgtgactcgcaaaatattaactgactgatgtttagagacacgtcgtccttggcagaactggaggaacaacttcccttgaaaagcttcagaggcaggtggctttggccacctggccctcctagtggcactggtctctttctttcaagtcaagggcagagacttggggcgtctgatgcgactttccactttaaatcatggaagaggaatgctggaagcacggctgtgtccctcccttctcagatcaacctacccacctcttctgaaatggatgctggctcctgggtggactgagtcctccctgctccagacagggggcagtagaaagaggttgagagcagtagcaacttggaagacttacaaggcttactcataaacatgtagattgcctagtgataatgtagataaaggtatcactaggcaaactacattagaaatacatatgcctatgtatatacaccactctatgtatatatacatatatttacatatatacacacatatatatcagtaaggattcgtgaacatttatttttatttattatttttttgagacagagtctcgctctgtcacccaggctggagtgcagtggcatgatctcggcccactgcaacctccacctcccagattcaagcgattcccctgcctgagccaaccgattagctgggactacaggcacacaccagcacacacagctaattttttttctttttttttgtattttagtagagactaggtttcactgtgttggccaggatggtctcgatctcctattgtgcactgcatgtgctttattttgttgctcagattattccagctttggctattgggagctctttcagttggttcctgtgtccctctggcataatctcattcttgtgggggttttaaacacttctttacctcctggcactacacgatgctctaggcccctcttgtataatccttaccctagccctagaatcagccatttatctaaagatttctgattccttttattggagagagactttagaaaccaagatgtgggcactgggtgcacttattgtgactggagtgtcaatggaaattctggagattaaaagtataatgattaaagcggaaaatttactagagaggtttgatggtagatttgaattggcagaagagatcaccaactaatttaatgacaaatcaatacaaagtattcaatttgaagaagagatagaaaaaaactaacagagcttccgtgaaatgtggaacaccactaagcaccctgacctgcacatattgggagtgccagaggagaggagaaataggaggagacaggaaaagtactcaaagaaataatggctaaaaactttccgaatctgatgaaaagtactagcctcacatccaggaagctcaatatggcaagtgggataaaaacaaagagaaacacacccaaacacatcataatcaaaatgttagagacaaacacaaacagaaaattttgaaagcagttgatgacagaaaaatccaaatgttgccaaaatatatttaaagaggtttactctgggccaatatgtttgactatggcccaggttacacaatctcaagaggtcctgagaaagtgtgcctgaggtggttgggttatagtttggttttacacatttcagggagacaggaattgcaggtaaaataataaatcaatatgagaagggtgcacattggtttggctggaacaggcgggacatctcaaagtgggggcttacaagtcataggtgggtttaggggattcttcagttgccagttggttgagagagttaagctattgtctaaggacttgaaatcagtagaaaagaatgcctgagttaagattagggagttttggagaccatgttcttattatgtagatgaagcctcatgggtggcagctctcagagatatgatagctgatgagtgactcttttcagactttaaaggtgtcaggctctcccttaatctctcctggatctgagaaaacctcctggaagggaaaatacctggttatattcatggagattctctatagctgcaaattgtccccataaaagatggctttgcagggccattttaatctgttggcactgtggcagccattgcaaagtacattaaagaaatatattttgtggtaaaatatttttattaatatgtcctttagagtctgctatctgtcatgtgatattataccaaagtcaagtggaaagcaagccacattttataaaaacctgtctgatgagatttttatggtttgtagagcatgactccccagtccccttagataggtatttgggcaagagaaaaaaggtccccatttactcctcacagcaagagaaaaaaaaaaagcaattcatgcaaagggacaccaataagattaacaactaaattcattagaaataatagaagccagatggcagcggaatgaaatagtcagtgttgaaagacaaaacactgtcaaccaaaaatcttatttccagcaaaaccatcttgaaatataaaggtgaaataaagacattcccagataaaaactgagataatttattgctagcaaatctgccttacaagaaatactaaaggaagttcttcagactgaaagcaagcaacacaagatagtaattcaaatccacacaaataaacaaaagtgtcagtaaaggtacttatatagataattacaaaagactgcataattgcatactttccctttattttcttgccttacttaaaaagtaattacataaaacaatatatgtaatatacaggtgtattgttgggcctcaaaatggcatcaaaaaatggggagagaatggaggaatataagggtaaagctatatttctctggaaataagtcagtataaatctgatatattaagatatacactgtaagccctagggaaactgcaaaaaaaaaaaaaaaaaaaactcaaaatacaatgtaaacattatttaagaaattagtgatatctagtgttgcattagaaaatatctacttaatacaaagtaaaacaataaaggataaatcatgtaacaaagatgataagagacctatagaaaaaggtaaaatgtcagatgtcaatctaactatatcaatcataacattaaatatgaaagaattaaacaatccaatcaaaaggcagagattgtcagactgaatttttaaaagatcgaggcggggtggggtggctcacgcctgtaatctcagcactctgggaggccgaggtgggcagatcacgaggtcaggagatcaagaccatcctggctaacatggtgaaaccccatctctactaaaaatacaaaaaaattagccaggcgtggtggcacgtgcctgtaatcccagctactcgggaggctgaggcatgagaatcacttgcacctgggaggtggaggttgcagtgagctgagatcacactgctgcactccagcctgggtgacagagtgagactccgtccaaaaaataaaaaaatacaaaataaaaaaaaagatcaaattacatgttgtttacaagagacacattttacaagcaaagatacaaatgggttgaaagaaagggtggaaaagaatacaccatgtaaacaacaattataaaagacttggagtggctttcctatgatcagacaaaatacgctttaaaacaaacaagtgtctgggcatggtggctcacgcctgtaatcccagcactttgggaggccgaggtgggtggatcacaaggtcaggagttcgagaccagcctggccaagatggtgaaaccctgtctctactaaaaatacaaaaattagccaggtgtggtggcaggcacctgtaaccccagctacttgggaggccgaggcaggagaattgcttgaacccaggaggcggaggttgcagtgagccaagttcgcaccatcgcactccaccctgggcgacagagcaaaactccatcaaaaaagaaaaaaacaaaaaaacaagtaaaaaggttactagagataaagaggaacatcttacaatgataaaagggttaattcataaagaagctaaaacaattataaacatatatgcaactagcaagagagcccacaaacattggagataaaactgacagaactgaaatgggaaatagatcattcaacaataatagttagggactttaatatcccactttcaataatgaatagagcaactaaagcagaagaccaatacggaaatagaattgaacactggaaacaactagacctaaaaaacaccaatgaatatgccaccaacagctgtagaatatgcattcttctcaagtacacgtggaacgctccttgagatagatcattaaacacaattgtcttgtgttagacaattaagcacatccccataaacttaaaatatttaaatgatacaaaatattttctccacccacaatgaaattaaattagaaatcaataataaaagcaaatttaaaattcacaaatagtgggaaataatatacctctaaataactaatgtgtcaaagaggaaatttcaagggaaatcggaagattcatttagatgaataaaaatgaaaacacagcataccaaaacttgagatgcaaataagcaaataaagacgctcagagaaaatttatacctgtatctatattttaaaagaagaaagatctcaaattaattacctagccttccaatctcagaaagtagaaaagcaagagtaaactaaacccaaagcaaacaaaaggaaggaaataaccaagattagagtagaaataaaggaaataaagaatataaaacaataaagtcgacaaaacctaaagttttgttcttttgaacacaggtttggttctttgaatagatgaacaaaagtgacaaatctttagctatactggccaagaaaaaaaagagagaagactcaagccactaaaatctataagatgtctgatcttacagaaatgaaaaggagaataagggaatgctataaacaactgtctgccaccaaattagacaatttagatgaaatagacaaattcctggagagagaaaactactgaaactggttcaagataaaatagaaaaccttaacagacttataacaagtaaagagataggattagaattaaaaaaacaaaacaaaacttcgcattaaggaaagcccaggtcctagattcactgccaaattctaccaaatgttcatagaattaatatcaatctataagttcagtattaacctgatacaaaaacctgacaaagatatcataaggaaaaaaaataactctggtgaatcctcttctgaatagagatgggaaaattctttaaaaaaaaaatactagcaaactaaatccagcaacatataaaaaggattatgtaccatgaccaagtggaatttatcccagaagtacaaggttaatttatcattaaaaaaaatcaattaatgtaacacaccatattaatagaataaaggacaaaaatcatattatcatctcaatgcagaaaaagtactaaacaagcaacattttttgtgataaaaaatttaacaaaccagatataaaagggaacttccccagtccgataaaaagcatgtacacggccagatgcagtggctcacacctgtaattccagcactttgggaggccgaggtgggcggacacgaggtcaggagtttgagaccagcctgaccaacatggtgaaaccctgtctttactaaaaatacaaaaatgagccgggcgtggtggcacaagcctgtaatcccagctactcaagaggctgaagcaggagaattgcttgaacccaagagacagaggttgcagtgagccaagatcatgccactgcactccagcctgggcaacagagtgagactttgtctcaaaaaaaaaaaaacttacagcaaacttcatacttaatggtggaagaatgaaagccttgccctctacagtcaggaataagacaaggatgtctgctgttgccatttctatttgacattgtactgaagtttctagccaggacaattaggcaagaaaatgaaataaaagcattcagattagaaaagatgtaaaactatctctgtttgcaaataatattattttgtatgtttaaaaaaccccaaagaatccacaaaataaaaatcattagagctaataagtggcttaaacaaatttgaaggatacaggattaacatattaagacaaaaatcagtgtatttctatatactacgaaagaatactctgaaaataaaattaggagaaaaatccgttactaattgcattcaaaacataaaatctttaagtataatttaaacaaaataagtgtaaaccttgtacactgaaaactataaacattgttgaaataaactgaaaacaatcaacattaatggagacatatcatgttcatgggtcagaagatttattattgttaaaatgacagtactgcccaaatcaacctacagagtcatctcaatccctatcaaaatcccaactgactgttttatagaaattgacaaactgactctaaaattcatttggaaacacaagggactcagaatagcaaagaaaacaaattgaaaacaaagaataaagttgaaagactcacacttcctgatttcaaaacttactacaaagtgacagtaatcgagacaatgtgatactgtcatgaagacagacacacagatcaatagaatagaattgggagtccagaaattaaccttttcattcatagccaattggttttcaacaaggtgctgagacagttaagtgggggaaagaagagtcttttcaataaatggcattgggacagctatatttccacatgcaaaagaatgaataacccctaattcataccatacacaaaaattaaaactcaaaatagatcgtaaacctcaatgtctatgagataagagttaaaactacagaactcttagaagaaaacataaaagtcaatcttcatgaccttgggttaggcaatggtttcttaaatagcacaccaagagcacaaacagaaacatcaaccaaaaatagataaactgggccatatcaaaatttaaacttttatgctacaaataataccaccaagaaagcaaaagtagaacaccatagaattggagaaaatattttcaagtcatatatctgctagaggccttatatccactatatatttaaaaattcttggccgggcacagtggctcatgcctataatcccagcactttgggaggccaaggcgggcggatcacgagttcaggagattgagaccatcctggctaacatggtgaaaccccgtctctactaaaaatacaaaaaattagccgggcgtggtggcgggtgcctgcagtcccagttactcgggatgctgaggcaggagaatggcatgaacccaggaggtggagtttgcagtgagccaggctgcactccagcctgggtgacagacagagtgagactccatctcaaaaaaaaaaaaaaaaaattcttatagctcaataacaaaaagacaaaaataccatttaaaagggggcaaagggcttaaatagacattccttcaaagtaaatatacaaaaggccaataagcacgtgaaaagctgttcaatatctttattcatcagggaggtagaaaccaaaaccacaaccagattctaccccacatcctgaggacgtctaggatcaagaagacagacaatgacagctgcagacgaggatatgaaggaactggaagctgatggggttgcaacatgctgtagctgctttggaaacaggttggcaatttcttataatgttaaacatagatttaccatatgacctggtaattccactcttaagtgtatatacccaaaataaatgaaaacacatgtccacaatttttatatgcaaattttcatagcagcactattcgtaatagacaaaaattgaaataactcaaatattcatcaaccaataaatgaataaataaaatgcattctatcagtacaatgaaatattatttggcaatgaaaaggaaatgaaatactgataaattccacaaaatgttgatagtgatgaaccttgaaaacatgctaagtgcaagaagtcggtaacaaagaaccacatattataggattgcatttgtaataaagtgtctaaaacaggccaatccatagagacagaaaatggattagaattttcttagagctgggaagtgagcagagaggaatatgaatgactgttaatggataaagggtttcttttatgagaaacaaaaatgttctaaagttagattatgatggtggttgcacaaccctgtgaatggtgaatgtactaaagcacatcaatttgtacactttaggtgactcatatggtatgcaaattatatcttgatgaaactgtttctttttttaaaaaaagtcaccaggtttaaacaggtcaaagctggctttctctatataataatacaaataatttcaatgttattttgaacattctgggacatgggaaaagatgggaaattttaattgtataagtgaaactttaattgtataattaaaagagaacagaaaaagataactataaactgactcacaatatatatgtaaaaagaatctgaataaaatattagaaaatagaacccagaaatatatttctaaaaatctgctatgaccaagtattatgtgttggttttcaggaatgcaagggtagttcaataccaagaaactagctacaaaatttagtatatccatcaaccacatgatcccatcaatagacaccgaaaaagcatttgaggaaactcagcaatcggtcctgcaaaaaaatctggagaaaagtaatactaaaaagaaactattaaaaaagagatctcaaatcccagctgctatttgtaggggaatggctctcccatggtgcccctaccatgttgcacatctccttacaggcctcctagaggaggcttggccacagtctaagctgagtcctgggaatgactcctcctgaagcaaggggagattaggctggggaggagtcagcaagggcagcccctgatccgtgtgagaatgcctccaagggttgctcatccatctccccggtttccgttgagcacaaagctcttcctcaccactcccctgtcatgtggagctgctggcttctgtgtagtctgtacaaatgcttggccatagtttagagaggactcctcaatggcagagtgacccaacactcaagccgacgatcaccagacctttctgtttcagtcgacctgtggattaggggcaccaggacctgacactgcactggttgtggctttgctgtctgtgtgagtaatgaactgtcttgaatcctcttggctgctctgtcttcttggcagcgaggtctatgggagtgaaacctgctgacctcactgccgctgccacgctccctttagggatgacttggccacctgacacagataatatccaaatcatgaaacaccaaactaatacaattaaaaccagaacttagcaagggaggtccaccatttttatttgatattgcactgaggcttcaagcagatgcaaatggccaagaaaatgaaacacatactttaagcgttggaaaagatatagctattagttttcacaacccagatattgtatttaaaaattagaattaaaaagaaaatgtgataggatgagatgatgtcatataattatgcagaaacaaatgcactatctcttttcaaatgataggcatctagaaacggaaaggggaagaatcagtctgtccacaacagtgacaaaaccgtgagctacttagggagcaatggaacaggactcgggaactgtgtgcccagcatctgcccactgctgctcggagccatttcctgtcctgccctgctccatactccaggctcccttcccttctgtcttccagtagatttggccaatgggcggtgctgacccaagattgaagggtgggatgaaaggacacgtgaggcccttctctccctctctctgttccagtggcacctccagctgcagctgggtctcctcggtggctgtgggctcccacctgaaagctcctttctccatggtcccaaatggggctgagagtctcaatatgattagagcatgctctacactgaccctccaggcccagccctggggtagaagtgacctcaccaccatacaaagtaacccctacaaccagctccctgcattaaattccctctgcttaaaagatctagagtgatttctggtttccaggtcagaacctgactgatacaatccctatgggataaaaaaatgataaaatcttatttaaagacacaaagcagacacatttttctggataagaactttcaatttaaaaatgtcaattctcttgaaatttatcttttagtcaaatgccatttcattagattcccaacagagttttaggggttttggtgtggtcttgttgggtagaattatgtagacatttttatgggaggataaatactcgtgcaagatgagacaaccctgccactgtacacacactgacaacacgccacgagttgggttagaaaaccagaaaatgacctcaggataagcaagaagataagaccaagcttcatttgtttcagggtaaacagaagcatcatttaattaatggactagcacacccagctgccatctagaagaaaataaaagtggatccactccttcatcttaatcaaaactaaattctaagtggattaaagacttaaatgtaaaagaaagtaaaaataaaataaaaatactgcaagaaaatctggaagaccatgccagctagggtaaggattcctcattaagcaagactgaaaactcagaaattcttagaagaaagtataaatatgatggactataaaacaatttaaaactcatctatgaatagatacctaaaaccaaatcaacagacaaagtataagtttagaaaaacaaaaagtgggccagatgcagtggctcacgcctggaatcccagcaatttgggaggccaaggcaggtggatcacctgaggtcaggagttcaaaaccagcctggccagcatggtgaaaccctgtcttactaaaaatacaaaactagctgagcgtggtggcatgttcctgtaatcccagctacttgggaggctgagggaggagaatcgcttgaacccgggaggtggaggttgcagtgagctgagatcagaccactgcactccagcctgggcaacaagagtgaaactccatctcagaaaaaaaaaaagaaaaaagaaaaacaaaaaaaaaagtgatttatgatgaaaacaacagtgagaaagctgttatctgtaagatatgaaaagtgcttacaaattgataggagaaaaaaatccaataggaaaagggtcaaaacaatacacattcacaaaagagtaaatccaaatggctaacatcatataagaaatgttcaaaactaccaataattggtgacatgcaagttaaagccacaaggagctgtcacttaaaacccacctgaccagcaaattgaaagggcagcaggaccgattgcaggagaggatgcgaagaagagagagcgtgcatcactactgctgggaagcggacattcggcagcatttttggaaagttatctagaaatgtcagttcaaagaaacaccatccatgctttttaacctccaaatcccaatctgtagtatctgcttgggtagccacagcacagcagcacacatggtgcccttcacgggaggaaaagggattctcacactctcggcggctgaaggtccgaggtcaaggtggtggcagggctgctttatcctgggcctccctcctgggcatgtggtgtggtcttttccctgggtcctcacatggttgttcgtgtgtgtgtgtgtgtgtgtgtgtgtgtgtgtgtgtctgctactgttccccctgccaggaggtgatgacctatgggttgcctccatcctgcccaggatgtctgatgtcagacagagcctgaatcctgttcccagactgaacactggtatcactcagactgagtccaaatcctgatctcagactgagcctgaatcctgatttcagactaagccctaaaaattctgcctcagattgagctctgaccctggtctcacactgagcctgaatactgatctcaaactgagtctgaatctttatctcagactaagcctgaatcctgattttagactaagcctgtattagtccattttcacactgctataaagaacttccctgagactgggtaatttataaaggaaagaggtttaattgactcacagttccacatggcttgtggggagcgctcaggaaacctacgatgatggaggagggcgaaggggaagcaagtgccttcttcacaaggtggcaggagagagaagagcgaaggaggaacttccagacacttataaaagcatcagatctcatgagaactcactcactatcataagaacagcgtgggggaaccgccccatgattcaatcacctccctccctcaacacatggggattacaattcgagatgagatttgggtggggacacagagcgaaaccatatcaaaacccaaatcctgatctcagagtgagcccaatactgatttcagactgagccctgaatcctgatctcatactaagcctgaatcttgatctcaggctgagctataaatccttgtctcagactgaaccctggctgtgctacatttccagacctttctcacccccatttttgttgccacctgaggtcccctgggagcttcattctgggctggcagatgccctaatgttctagaacaggagctctggagtacctgttcactttccagtccccttttcccatgtcccctcccagttgtcctcttgcagcctgaagaagtctcatggttctagactgcagacttctgctggggcagcttgtttacctagaagaggtggccagagcccaggtgaccagggaaggagttccctgcagtgtaactccacctggggactgatcactcaccattgcctgccacctggggaggaaaggctcacctccacttccttctcagatggccccacccttgcatcctctggttgccataaaattcttttgcacaggaggttcctgcttagccctgtgtcacctctgggaccagcctgcaggcctgcccagtgctgtggctctgcccaggacagcaaggtgagttcagaagcagaggttgggcactctcagactcccaggggccaggtatagcagccctggctcaggcagctgctgtgaccgactgggatcccaggccgctttccacctctttccttcctgggaagcactgccagtccttgtccttccaactgaccaggacaggaggtcagaggggaggtcatccccacagacagggctcccaggacggcacctgcaaagctgccctctgtggtcccgagagccagtgcctggcacggccgcccgcttcagactgtggctgtgggcaagtgtgtactctccaggaagaaggggcctgttgcctcactgttgatcatccttaaaaaagaaactagagacaccccgggtgcctctctgcggccccataaatctggagaggagggagctgcaccgagcgagcttaggcttttgaattttaaatggccaatttggtcaatgaatcaatttcactgggctgaggcagcgtggagatgaaagcggttttaagacctattgaaggcggtgagagcctctttgtccatgcttttctcaggctgccgccctctaatatttcatctatattcatttttatggctttccaaattatagatgtcagctaaaaaaactgaaaaaaagagagggtgaagaaaggagggggaaattcactgctgttgaatagaaaggcgaagttatccctcccaaagccagccagtgtgctgggacgtgacccagaactcacagccggtccttccatatctgggcctcattcctgcatctggtctgtgacccaaggctgagcctttgctgcccatggggcaaaggatgaggcagacagttctccctccagtggggagctcatgttctagtgggagaaggagagagacctcctaaaagtgagcagaacaaagaccctggtactcagggcaacacagagtgggtgaggcagggctgtggaggagggagttgagagcagggtaggaatgacctgcccttgtgcaagcattttctttccaatttccaccatgctcaaactgtaacctgaggttatgatgcccattcctgggaattcatgttctactgatctggaataattctgacctaactggctaaaaattaatgtgtacattatctttgataaagggcttgctctgcaatttgtagtataaagggatcacaaggtaaatactttaaaccagggctcagcaaactttttctgcaataggctggctagtaaatatttcagccttggtgcaccatgcaatctgttgcaactactaaactctgatgttgttacgtgaaagccgtcatagacagcaatacggtttggctgtgtccccacccacatctcaaatgttagctcccataattctcacatgttgtggaagggacctggtgggaggccattgaaccatgagggcaggtctatccagtgctggtctcatgatagtgagtaagtctcacaagatatgatggttttacaaatgggagctcccctgcacatgctttctctcttgtcttctgccatgtaagacagaactttgcttctccttcaccttcccccattattgtgaggcctccctagccatgtggaactgtgagtccattaaacctctttttctttataaattacccagtttcaggtatgtctttattagtagcatgaaaatggactaatacagacagtacgtaaacaagtgagtgtggctgcattccagtaaaactttatttataaaaatgggcaacaagctggatttggcccataggccacagtttaccaacccctgcttttaaataccaaagtgaattcactggtttttctgcagtgtactgtcccatccagtgaacttttcacttcagagattggcacaatttgccacttctagaaattccacttggaatttctgtgtcccctatttctctcctcgctctgttcatgttttcctttaagtccttgagtatatggaacatatttataacaagtgttttaacatcctggtttgccttttccatcacctctgtcagttctgggcctatctctattattaataactaattttttcctgtcgataggccctactttcctacttgtttgtctagtgatttttgattggatgctggacattgtgttgaatactgtacattgttgagttctgaattcacttacatgcctttaaagagtgttgggctccattctggcaggcagttaagtcacctggagagaagtttgatgcttttgagggtgagtctagagtcacctttcctcttgggtgagttaagccccactactaaagcaaaactcttctgagtctctagtgaatgcccatgtcttcaataacttctctccattctggctggtggaaacttagatggttctaagccattcaccttgcagctctctgataattgttatttcttcagcattgcccttgaagtttcacgccttgcgtgggacaattgacattcaggcacagacctatgggaacccctatgcagaattctggcactctttttctgcctatttccctcttctctggtattctgccagcaaattctagccatctcagcctcccaaaattctgatctctatctcctcaatccaatgagaccaccaggctctgtgtggatccctcctctcataagaagacaaagagctgtcagccttaaggaaggacggagaactgaaaaaatgtccagccatcctaaaggaatctccaaatcagtaccaaggaagcaggtccaccacaccttgactaaggccttccttccccatcacagcccattactccataatccagtcctcagcatagcagccctcctggacattgtctccacacagaaagtccaggcctcagaggggtcactttatttgtttccctctgaatgggtgtctcagttctgcacttgctgtggtttgaatgttttccccccaacctcatattgaaattggattcccagggttggaggtggggcctaatggaaggtggctgggtggtggaggtggacccctcatgcatagatcatgccctccctcagggaggagcgagctcttgctgttagttctcatgagaggggcttgttgaaaagggcctggcacctcccccatcttgcttcttctcttgccatgtggtctctgcacacaccagcttcccttcaccttcccctgtgagtggggaaggtggcacagcctgaggtcctcaccagaagttgagcagatgctggcaccatgcttctgtccagcctgcagaaccatgaggcaataaagctctttttcttataaattaccgagcagtaggtattcctttatagcaacaaaaatggactaagacagcgctcactctccaatgtctgagaacagtcgtttcatacttttttgcccagttttctagttgcttaactcagaagagtgagtctggaagctgtagtaggagactctgcccatggatcttaaataatataaaagtactcatttctatctaacccactttaccactttaatataactgtggtgagttggcagcatcacagactttaggttggacggagcttagaaaccacgtggtgctagcctttcacattgcagacagagaaagggaagcccagggagtggtggggcatggccgtttagcagctggtggcaagcaggctgatacaagacttgtctatccctgcaccaccctcagctactgcccacccatgtcctcctgcagcctgggcacccaggtaacagctctgaactccgtgtttacaacccccatgccgacacacatgcacactgctgcataagcatcaatttcctaccaagttggtccatgggccagcgggctgcacctagaggagatctgtccacaccagcccgcctgaaaacaaccgagccacagtgctgggcccagaacccagtacagccccctttcctctcaggccatcccagcctaccagaggagtctagtaatgccagccctccaaagcaaggttcctcagcaaaccacaccccgcccacaccacagagccctcaggccacagcataacacacataacacagcttctcattcatttaggggctaaatgtcagcaactgcaggcacaggtctctgctgaggccaaggtattagacctgctggggagagggaggagcagttatcagcctgccctgagctggaggtgggtgtgcctcagacctcgtgccagcctgggtcctgccaccctctaggtgtcaccggccccctgggcccccacacagagagtgagactcattcagcaggaagggctgagaaagctgggaggggtggccggcagctggcacagcacaggcttctccatgcacgcattacctcccagggttgcctgactgactgttgagagtcaggcttcatcctggtgctgcaggtgccctggagacatgagctgctaaggtgaggctgccacagaggagggcggctccccatccctttgcttgggactgaggggtttcccagggcatgggactttgaatgccaatgccgggaaggccccaggcagactggatgagttggtcacgccaccctagtgtaatagctgataggctgacatctcaaagattcacatcctggtggctggggcctgtgaatgtgtgacttcacatggcccctgccggtgtgattaagtcaaggactggagctagggagtggctcttggatggggtggaccctgcatgcaatcacgggaatccttttaagaggaagcaggggcagatttggcaacgcagaggaggagaccgcgcagacagaggcagagatggaggggtgcagccacaccagggccacctggagcccccgaagcctggagagacagggacgagattctccctttgagcctccagagggaaccagccttgctgacatctagattttaaagccatgagacttgttctgaattcctggcctctggaaatgtgagataataaagtaacgttttctaataaggccagacctccaaagcaaggctcctcagcaaaccacacgccacccacaccacacagcccctcagtctgcggattcacaacacaacccaggagataggacccgggagacgccggcccccgcctgcagccaggctgagcttgacggccacaataggggcagccatagcagagggctgcctcagaagttctgcttcaccaccggggaaagtgccaggaggcctggcacgtcccgggatagtgaagacgggtagccactgggccacctggaaggtgactgcggcacctgcaccccccgcatggttgctccccacccccagagctgctgcaggcacacctggcgcctgctccagccagccttggcatcttcctctctgttcctccctccgggcagggcaactgggcaggctggacacccagcaggggagctgtccacatcaagagctccccttctactaccatttctgggccacgtcctccgccctcaaaacagcaaacccgtctccagtgccagactcggggctgcacatgaccagggcaggagtaactgaactcgcagaggacaaaaagaagaaagaggaagggaatcccttcagcgccacagctgagctgtgtttgctgtagtttctccaatttctttgtgaaaatgtaatcgcggtcccggagcacgtgggaccctctgcacactgacagtgggagggagactcactgcaggggctgccgagagcccccgcctggggtccttgacctgctgggctggggggctggggagagtctgtgggtgcagagagctgagtctctggggctggggcccctcctcctccatgtctttcagacaaggtgtcagggccccacctgggaccacactgacctatcatagccaaggtgaccttggctggctggcccctgagtgaggctggggaaggaggcaggaagcaacaggcctggatttgggatgactgccccgctgggacctcctagaaggtgtcaccctgaggggccaagagggaggtgagcctcagagctgaggtccacctgcagcctttgcctgacctttggttctgggggcagcttggggacccccacctgccactgtcagcctttccacctgcagggtcaggcaacttaaaacctgaggacatcacaaagcaggaaatgagttcctaaatagaaacccactggggtctcccacctactaccacccctcctcctctcctgcctccctgctcctcctggcatgttggctcccccagcaacgccgccctcctctcagacacacactccctacctgcctgcacccttaccccacccagcctcctctggcctccctggcccccaagttcagcctcctcgttccctgtccctgctctgtcccacccaaggagcagtgtgcagcccctcccctgcacccctccctggcgacctcaccccacatcttggcgccaggcacctccagacactctccccacttgtctgccattaaggagacctcttgtcctagaagcttccagcaaggcaaccaccacattgcagacccccttcctcctgccccctgccccaggcccaggtttggagcagctgcccatcgcagagcagccaccgtggggtgtcagctggccggggtcaccttctcagtgtttggccatttcctcactggcaggaccctgaagcttcatccaaagcaagaggagaagacaggtaaggactgcaagccacactgggcgcttggatctggaagagaagggcagagacttggctggctgagggtgaacctctcctccaccgtgggcagcccaggccctgcctggagaacaagcagagggggagattctccctcaggagagagcggagggggagattgcccccaggttgccatggggctgggatagaagattctgtgaccaggaaatggcccagcctgctgctccacctggctgcagccacccctttctccaagaccagacttatgggtctgtctccctgctgcctccctctgccgttctgcagctctggggagctctgtaactggggggcccaattctgccattctgcagctctgcaactggggggcctgggtcggtggggaggtggaagttgcccctgcagagagtgtgttctcttttcggggagacctgggcctcctggtgctggaggggctcccagctgtgagtaggcaggccccatgtagcaaggagacagctcgccatgtggactcccttgggtttggtgattggtcactgcccactggcgtgcactcagtgcgttcctgggcccacccaggcttcttgatctcttgtgatgtttgtaatctggcatttgggagagagtgaggtaaaggcaattttgcaactgcaataaaaccagcaaagtgatcctctgatggttcttaatgagatccgtctatctcccctgactgagccggcagactgcaaccccatgtgtgaggtcaaaatgaatgtcacatggtcccccacagaaccagagaagccatcaccatggtgcctggcctaatctgctccagcatccgacaggagtgatcagaagatactcacaggaaattgtttttcctgcctcgtaaccataacaacagatgagagctggtcttgctcaactttccgagtgagcatctttgtcaacatgtagccaaacccaggacacaaaagcagagaccagggctggcaaaagggcactttggagatatcagggtttggggctcctgtgaggtctggattctcccctctcctgccccacccgacagggatggcttagaacgttcctgagtgtggactagaaggtgggtggaaggacaatgggccccctggaagtgtgcatacctggcatcacagtgagctgtggctgctgcctgggcagaagctgagaggctgccttgctgcccagagtccccacaggcctgcaggtgggcaccagtccttgcttcccagattacagtcaaatgctctgcccatatcattccctaactctgacagcaccaggtccagatctatcccctaaactgcaacagtattgctgagagaaattaaagaagagctgaatgaatggagaagtataccaagttcatggatgggcagactctctatggctaggatgttgttcagccaccccaaaatgatcagtagaccgaatgtgatcttcataataattccaatgagctttttgacggaaattgattgattgattctaaaatgcatttgcaagtgcaaagacctggaaaagaaacatgatcctggataaagagcaccgttggactaatacgatctgatttcaggatgctgcaaagcccagtaatcagggcagtgagatactggcgaagaaatagacacttagataatggaagaaaatgtagagacaagaactagacccataaatacatttcccatcgatttttagcaaaggctgcaaggaaattcaataaagaaagaaagtctctttgacaaatgatgttggagcaactggatacatttatgggggaaataaaccccaaccccttcctcacaccatacatgaaaattaatttaagataaaccacagatctaaatctaaaatatggaccaggaaatacctagaacacacaggagaaaatctgcaacattgaggtaaacaaagactctttagagaggacacaaaaggctctggccaataaagaaaaaacaacaagcagaaattaatcaacatttaaaatttcaggtcatcaagacattgtcaaaaaacaaaaaggtatttcataaaattagggaaaaaaatatatgtgtgtgtatatatatgtgtatatatacacacacatatattttctctaactctattaatatatatgtatatatatatgcacacacatatacacatatatatacacactcacacacacatacatcttatatccagaatatattgagagttcttacaaatcaacaataaaaagacaatccacttatccaaaatatataaagagttcttacaaatcaataataaaaaatccaattaaaagatgcttcataaaagaagacacataaatgctggataagcacatgaaaagatgtgtaacatcattaatcatcaggaaatagatacgaaaatctccaggaagtagttttttgcccatcgggttgacaatactaaatgtcagtgtggatatgcagaagccggaactcgcctatactgcaggtgagggtacaaaacggtgctgccacttagaaaactgcttggcaatctcttacataattaaacctccacctgtcctatggccctcctagctatttatccaaaggaaatagaaacatttgtaccccaaaaatacttgcacaagaatgtttatagcaactgtatttataatagtcaaaaactggaaactacccaaaggtacactggcaggaaaaagcataaatagattttatatttataaaatggaatacccttcaaagataaaatggataaactacacagataaagctcaaaacaacttggttgggtgttggttatgtgtgtgtatttgtcaaaactcatcaggttgtacccttaagatctgcacatttcactttatgtaaaatttatttcataaaaagcaatttccccaaaacaatatgataatagcacaaaagggctgccctctcccctcagccacggccaagtgtgatgttgcactcagaccccacccgagcgtcctggctttgagtctccttcaggatgcccaggtgtacactttgctcggagctccggagcagcagacagggttgcaggggtggggggctgctgccctccagtggtgcatggccctagcaggtcccccctcaccacactacaagctccccactggaaccctggagcccgcatgcctcccagagggctcgtgcagggacccccaggcagcagatacgggcaccccacgagtgtggccacaggaggctccgtgaagggcagcagcctgcagccatcactctgccagtctccccgagacaccccagtgcgccctgcagtagagctggctggccgggctgggatctgcagacaggtggcagctccacctggaaggatagaaaatgcagttgggattgccacttctaggtcttgcctgacttctgccctttcccaaacacagggccttgtggtgccttcagctggtccctcctcctggagtcccctcccacccatcccagcatcacctgcagcactctcccgccaaggtcaggctcaggcagggcctcccacccccatccaggaggcttggccaggcccatcctctagggagctggggacctggccttccaagagccaccaagacatgtctcagaggtagatgggggctgggcagtgagccggagcctgccccctcccctcctgccccagggccaggggcagcagcatgaagcctcctggtctcccttccattccctggccaggatggagacgccctcagggctggtgcaggcctccagcccccatgcctagtggcctgggagacagccagccccaccagatgaggatgtgagccacacaggcaattttctctagaaataaatggagagaaattgctctaacaggcaaacggcctctgtttcaaagctaatttccacataatagaaccaaactacttccctttcctctcctctgtctcttctgcataatttgacaaattgcaaagctatttgattcgggggctcaaacacaagcactgactccaatagtcagggacagatggggagaggggagaaggcaaagctccccagaaagcgcccgctgactccagggctctgagaggacatttctgggactggcaggtcagagtgcaggggtggggcagtggccagggctgggcacctccgcattctgccaccatctccccaggcgagcagaggcccgtctgggaagggctgccgtggtagctgatgcacaatatgtcccgcggggcttgccagcgcgctcctggctctgatctggtgcctggcagggccagccctgctcccagccaagaccaaggcctgtgcttgtgctgccggcttggccacgtgctgagaccgagccagacccagccaggagaagcagctggtacctgagcaccccagccaggccacggtgcccgtcaccagcgccgcacagcccgccccatcttcagctccagccgccgagcttgacagctctggccctggaatccccacaggccctgtgtgtgtctctcctgcatctccttccctgtccatgtcctcccgggaactcagaacccccctcgccacccggggacctgcacatccctaccacacacgcagcccacagccgggcacgtggtacggtgcatcctgtgtgcaggggacgcatgaagaaatgcacgcagctggggctgaggacacggaggcctccaggcaggggtccgggccagcctcccacccacaccccaggcaggtgggcaagtcacggagcacaggggacagagagcagtggcatttcctaaaaggactttctattatttaacctattaaaagatgtctttaggctgggcatggtggttcactcctgtaatcccagcactttgggaggctgagacaggtggatcacctgaggtcaggagttcgagaccagcctagccaacatggcgaaacagtgtctctactaaaaatacaaaaattagctgggcatggtgatgcgcgcctgtaatcccaggtactcaggaggctgaggcaggagaatcgtttgaacccgggaggcagaggttgcagtaagctgagatcataccactgcactctagcctgggcgacagagcaagactccatctcaaaaaaaaaaaaaaaaaagaaaaagaaaaaagtatttaaatgaggatgttatttttaacaatattattttacagctatacaaatactacacgaaagcaggcttgatattaaaaagtgagagcctccttcacctgcaccccagtcccccatactgttccttccccgagattctccccgcagtgcacctgtgagcaccttccagagctgtccaggtacctgtaggcaggtctgagtatgcagacatgtggctcggggcagtcgcaggaggaatcccactcgcctgtgatcccctgccctgcgtttgtgcttctcatgtacttccacatagagaaacaagggtcacacatggaccctcagcaagaccatggacaacaagtgcaagacccaggacaacccagcccagcagatcctgcccgcccaccagctgccatgcagtgctcagaggctggaagttgagggtcactcgtgcaccacccctacctgcaaagagcacccatccaggggcacagggcacaggaagctccggccgagaggcgtgcagatgggagatgccctggggagtggtggggaaactcctgccacagggggccttcaggggccctcggaaccacagaatccttttggaagccaaggacatcaagagagaaggatcaaaagaaaccgaagcacaggcttgcgatgagcctgggtgacatggtgagaccctgtctctacaaaaaatacaaacattagtcagacatggtggcacacgcctgtagttccagctacttgggtagctgaagctggaggatcacctgagcgcaggaggtcgaggctgcagtgagctgtgattgcaccactgcactccagcctgggcgacagagcaggaccctgtctcaaaaaagaaaaagcacagaagctgcaacaagccaggcatgtcgggtgtccccaaagaataccccgccaagggaatggtgaggtgagggaggcagccacaggctgctgaggctaagcctgacagtggggccttagatgagaggctggggtggtcggggctccccccgtggtcagcgcagagccaggcagcgatggggaaggagagccgagacagggagcctggtagggtggcttcggcatcgccagccccgcgacgacaaggagccatgggaggggacaatgcagagccgtcctgtgggggacgcagacgttgtggaggctggcacatgctcggagcacacgctggttgaaatagcagccgagagacataattaagaaggtgaatctgctgccaaaacatgcaccgtgcttcaaagtcaacaacgtgtggtttgggggacagcctgtttctgggataagttggcccctgcagggcagctcacagggagtgagcatggtggggacgccttcagtcactctctggcatgggcaccccacaccccgccagggcagggagggaggggcagccgagggaagcatgcgcccagcgccacatcctccaaaccctggctgcagacacacgggacaggctgagcaggagctatcgggctgggctacaccacgcacacccaagcacaagcactcctcgggctcaagaaaggagtggagggtcggaacgttctagaaggcctcccaagggagaggggcttgtgcagatggggcactccaggccaggagcccagcctatacaaaggtgcggaggtgtcctgtgctggggagtgggaccaggccaggccgggtggctgggcccggggatacagaagatctgggtcagtcggggatcaagggggccaatgttcaggagaaggtgttgatggtgcagcccagctgcccctagctaagctgttccctcaggagttcaccagaagcccatcgcgtcagcagcagccccctcgggtttgttcagcagcatccatgcaaccacatcagctcagagcggggatttcagacccaaagggccaccaccaggggggatttgtcctgggatcagggaccaccgctcctcagcctggacctttcacatcgagtgcccagagaagcaggggctggtgggcacctgagggttccctgagagtcctgccctccagtggcttagagatcaacccctggcccaaaggtcctgcttgacaggtgccccagattctgtgagttacttaagatcaagtaacaaaaagatcaccctcatggcagatgagaggttaattcagtcacatcgttactggtgacagtcccacaaatgatttattgatttttttttaaataaaaatatgtcacatcctctggtatgggtatagaccaattctgtgcttgggccaactggataagaagttactagtttgtaccagatgccaacttgctattccatgccaagcagaaacagcactacccatgatacagcactgctacctggcacttcctcacgcaccacacacacacgcccctccaggagtccgcacagcctgcagtgagcacctcctccgtgccaggcgccctggcagggttgctgtgtactgtgggggttgccaagaccaatcagacttggcactgcccttgaggagctcaggctgcagaggcgagaatgggaggataactcagccccatgtgccgtccttgaatgggtctaatggggcccacggtcattgcatgtggctgacgtggcgtgactaggaggctgaggagggtgtccccatggaagtgacgttccaacatggactggaaggataagtacagcccagtcatgggaaacagacagagatgctcagcctgggcagtgagaaggcaggtgggaaactgaggcaggacagagtgtggtgaggtggaagatggcaagcagggcgtggagccaaaaaggatgagggtggggtggtgcagaggagtccccggggccccagggctgggccacaaagaggcctgtagatcttgctaagcccctggaaggttctgagcagaagagacttcaccaaatgaatgctttaagaatctccttctggcccgatgtccatcgcggatgaatggatgagcaaatcgtggtctagccacacaacagaatatgtattattcagccataaaatgaaataaaatactgattcctgctacatggctggagcttgaaaactttctgctgcaagaagctggacacaaaagttcacgtgttgtatgactccttttacatgaaatatgcagaatagacaacaaatccgtaaacaggaagatgaggggttgccgggggcttgggagaggggcaatggggagcgactgtgtcatgaacacaggacttctttttggggtggtgatcatgcttcggagctcggtggtggtgctggctgcacagcactgtgaatataccaaatgccactgaattataccctttaaaatgatgagttcacctcattgagaaggaggagaaggacagcagctgctccctctgacagccgtgcagagacaaggctgccggcagctgggtaggaactgggaagaacggaccgagacccctgcactgggccagcccagaggggacgatggccccagccagtgtgacagccattgcggggaagggcagagagaagtgggtgggtttgatgtacttttaggagaagagaacacgaggaattcacaattgcccagatatggggaggaaggaggaggatatgagatgcatctggcccagcacccgccctcaggatgctcatacgtccctaaatgacaagaggtgggcaatggcgatggactgcactccagtcgtgctggagtgaggccctcaggaggctcctgactcagctgggcatccaggaaggcttcctggaggaagcattgcatggagacagacccagggcttggggaacacgagctgcctcatgaactgcgttgtgagggagtgggagactcccacctggggacatctgcatgtcctgtcactcattcattcattcgctctacacatccacactgaatgcccactatgtgccaggtgtccttccaggcactggggagagggtcgttttgcgaaatgcctgccaacatttgaacgcactctgaaaaccagtggttacccggatagctcggaatagtagctggacttgagtttggtgtcatggaacccaaggtcagaggccgctgttgttgttattactatcatcggcacttacacagcatgttcgggggccaggcactgttctaaggccctggcagaagtcagcttgtttgcatctggcctgttcccagatatgaggcctttcatagacatgagggtcttgactctcgggctccaggcctttcccacccatgagtggacctcagtttccctctctgaaaaacaagcagggtaagtgtaatggcctccagggacccccggctcttcagtttcaaaacgtggtagaaagaccctggctgagtccagggagctgcacacagcagctctcccaggctggaggggctccgccgtggacatagaagggctggggtggagagtcttgttctcccagaaggctgggctgagagggagccatcctggtggaggcaggggtgcatgctacctggctcagcatgtcctggagcagggccaaggcatggactacggtgatgcttggagggcccagtgctggtcccgcactccaccctgcccagcacaaaggcctcacagaggcaagatcctgcagcaaggaagccgaggaaagtgattcctgccgggaaggagatagcccagcacctggcccctctcagcagcacccatggttatcgctgaacagagaagcaagagggtctggggaatgagagcggatggccagagggccttcccgtctgaggccagggaagttgaacagaacaggtcagtcacgtcccaagcagatctgctgggctcgaagtccgctggagcagggtaggcaggaggctgagggggaggcagggctggcagagatgctggtctttgtggagacagcatgtcagatctccagagtccctttcttctgaccctccttcccacctaatccacggcctcagggcctcccagtttcctgtcccctctctaactctccaggcaagaccttctactatgccccccaccccagaaagtttccatgacatccaaaagatctcttatttattgaagccctagggcgaatgttgttgaaatcaaatagtgcagtgtttcctgtctcacagcccaacagtgctctaacaggcaacctgtctgccaggagctcgccacggagttccacagcccggcacctccccagggggcatttcccagcacgtcatctgcaggggtggcttccctgcagcccttcccaccccttcccacccacttcggcagcatggcatcccagcaaacctctcccccaccctatgggccacacacacactctctccgctggagttgggatcacagcccgggatgggatttgacctctccaaatttgcttctatttggggaactctgtctccacctagaagtagctgctgcctgtatctgctgttcctgtgcttttggcattctcatgccactcaacaggaaacgccctcttatagttaagaattctttatattaaactttcactgttcaaattgctgcatgacgcctgtctcctgattggaccttgactgatagagagtcagtaccaggagccatcctgagggacaccccatgaggctgggattggattggtttgtctgtatttgtgacgcaagtgcagtgctgagtttattgccaataagaaatcagatgctgacgacccacagcccaaccccaagcccgatccccagcccaccttcacatcataatcaatcaagccgacacctgtggtggtttcatgaaacgccagctgaagcgtgtgcctcggggttccatgaggctgctgctctgacgtgtacagtggcaagtgtgatgacaaggaccacagtgtgggacagtgttcctgatgcactggggcccctccaaaagatgatgctcagctagggggcccctccccatgcagactatgctctgaaaaataaagtattcatagttgctccaaaagaatccctcattcctgcagccacagggagaatactgctgaaaatcaacatggagcaccttgtagtgccaaaaagtaaggaaatgcccacatcacacacacaaacacatacaaacacgcacacaaacacacacgaacacacacacacaagcatgcacacacaaacacaaacacacacgaacacacacgcacacacacacaaacacccatgcgcacacaaacacacacgtgcacacacacacgcacacacaaacatgcacaaacacacacaaaaaacacatgcacccacagacacacaaacacacacatgcacgtgcgcgcacacacacacgatggggcgtgtcaaagggacaccaaggccaacctaaagtactccccaccaggtgcgatgcttcacgcctgtaatcccagcactgtgggaggccaaggtgggcagatcacctgaggtcgggagttcgagaccagcctcaccaacatggagaaactctgtctctactaaaaaaatacaaaaattacccagacgtggtggcgcatgcctgtaatcccagctactcgggaggatgaggcaggagaatcgcttgaacccaggaggcgaaggttgcagtgagccaacatcgcaccattgcactccagcctggggtacagagtgagactctgtcaaaaaaaaaaaaaaaacaaaaaaaactcccaacagccaaagctggaacaatttgagcaagaaaatatagcattagattttaacccaaactataaaataaatatccataaatgcatattgatagaaacaaatgattaaataaatgaataaataaataagtgaaggaaaagaggcaaagcccccatgctgaagaactccacaccacttccgtagctgctccacaccccttacatgcgggctgtgcagacacttccctccaaagaggacgaactctacatcacttctgtagctgccccacaccccttacgtgcgggctgtgcagtcactgccctccaatggcagtgcagtcactgcctttgctatgagaaagagcaaaagaatgatcagtgtgctgaggaggcgtgagcaaggaagcctgacatgctatcccaccaggtgatagaggccccagccagccacgagccacatcaactgtgtgcgcccgtggatggcatgagcatggcacttcaccactgcggtcttcctcccccaaacctatgactccagtctcatcacgagaaaaacagacacatcctggttgaggggcagcctaatgcctgagcagtgctcttcaaaacttcaagctcgtcaaaagcaagggaagtctgggagctgtcacagccaggaggagcctaaggagacgtgatgatgaaaggtcacgtgggattctggacgggcccctggggcagaaaatagacattagagaaaaaccaggaaagaggaaagtgtgaatgaaatgtgggctctagtgaaaaatgtgtcggtattggttcattacctggaacaagcgcaccccactaaggggagacgtcaacatgggggaatgggacgtgggtgtgggaagcaggttcactcaacgccagtccaaagggagtgatgcagggcaggtgagccccaaagtggggctcagcccgtgagagtacttggcttcacccaagagagaattcaaaggcgagctggagatggaagaaacagctctattgaagcagccatgtcacagctctgtgactccttctgcagggcagggctaccccataggcagagagtagccgtgcagggtggctctgcagtcgtattcatgcccacgtttaattccatgcaggctaaggggcggtttatgcagaaatttctgcatcaacttctgggtcgctgggtcattgccatggaaaagagtggtaaccccggggttttgccacggcaatggtaaacggacatggcacactgctgggtgtgtcttatggaaggctgctttacctcacccctgttttagctagtcctcgatttggtccagtgtctgagccccacctccagagttgagtcccaactcccacctgtggaggacagcagagatcctcactctgccaagcccagaacatgagtccagacacttcccccacggcactctgcctttgcattggcttgtgcccctgtgcctaagactctccccactaggcttgaacaccctgcaagaaccgaacccgggccagattaggttagattcaggatgccctctctcctcaagacgccccataactagcacctgccactggttaagtggggtcagatctccaatgctccagggagaaagacacacactaagacccaggagggattgatttacacataaaaagaatcgcagtaatttgctaatataaatctgcagtaacatggggaacgtgtttgagagtggattaaatgggcgttagaccaaggaggggaggggaaatataaccttagattaggccaaattccttgacacaggtgcactttccagagagcttggatttcatgtgttaacgcgtgcatctggaggtggctcagacagcttacttggtggctcgactgaagcttgaactttgtcgtggcctacagttcatgtaggaggtgtgatgtggaggaaagagcccaaaagcttagggagaaaggactattgggctggatttatgtgcaacctcacagccacctcccagctgtggtccctgaggggccacaggacactctcttgactaaggtgtgaagcaatgctttcaccttggctgtaggctccctgcaagctctctggttgtagaccaggtgtgactgtggaagatgtcaccatgagaaattcctcccttcagtggggacgatggtatcctgaagtagcagaggctaacacagcacctagacatcagagaccaggcagcccaccgacagcgagggaaagcagggacacacataaccatggcaccttgatcaccaaggtctttggtggcagctaattaatcacagggtctcaaggacaaaagtggtgggcagcctactagggtattctttggtctaaataacaggagaaccccaggtgtgccagccaaacccccgacctgagtcaccgcagtggccagtcgcagcctctcacccatttgcacacccaactcaatgcacaatccaatgacctgtgatttgcagcccatgctggaaatactcctccacgcctttcccaaagggatgtacgaccattcatgggagtaactgtgagctggagaatggaactttgcagggctctgaattgatgctaatccttgggaacccaaaacacgagcacagcccatcagtcacatgggaacatacagtggtcaggtcatggatggaacccccattagctcacctctcacagggtaggctgtccacggacccacagtctggttgtatccccagttcctgaatgtataattggaatagacatactgccaactagcgggatccccagcatggttccctgagccctggagtgagggcatttgtggtagaggaactagatggaaaacgctgggacttcctttcctatccataagagaaccagaatcaatatcacattcccggggaaactgcagagattaacgccatcatcaaggcttgaaagaaacagaagtgatcattgcacacacacacacacacacatttaattcggctgtcaagcctgtgtaaaagttgggtgaaccttggagaatgaccgtgcactgatgtaaactgaagcaggtggtgaatccaggtgcacctgttgtcccacatgtattatctttactgtagaaaatggcatggcccctagcccttgttattcagctcttgacctcaccaatgtcttctctgtaccagtttggaaagatcaccagagcagtttggttttctcacctggccgggccaacagtgccctttcacagtcttgcttctgggtcatgccagttctcccacctgcagtgataagaagcagagattttcccacctacaaagcatcacgctggtcctctacactcatgacattacactgagctgactgtgtctgatgagcaggaagtgaaaataactttaaatgccttagtaagacacacactaactagaaggtaggaaataaaccccacaaaacatcagaggcctgcccatcagtgaagtctccagggcccagaggtgtggcgtatgtcaagctccttcctccaggatgaatacaagatgctgcacctcacgccatctttgtgagtgtgctccatggtcatggtcttctgggttctgtggaccacactgaggggccaattgtgcggatattggctgctgttttgaagatcgtctgcctcttccagctactttcaggatttttccatcttctgttttccacattttaatagacagttttgttggttcactctgtcactcttacctgggtctatagagtccctgggggctgcagcctggccactgtggcagcggcatagaattggaacccactgtctgtcgctcccaggactgcccattcatcagtgtgggcagagtgggagccatctaaggaggttgtgcagggagagtcagaagtgaaagcatctcagggaaggtttcccgagctgggtcagcaccacgccttgccaggatgctggggccacacaaaactgagcatctgctcagcctcagaggtggacaggggccttctgcttcatctccttagagcagttcaggcctctccccatcagctctacaaggtcccaggccacaggcctggcttccttatcctctccctggctgcagatgcaggccccctcagggtaccttcccagcagccatcctggtcctggagatcaggcttggagcctggtttcctgacctcccatggcccttttcccctgtggcctccaggccccttcctctcttaggatgggagccctgctgccacaagtatggctcagtgataacatcctgccaaggcctctggggtaaagtcacaggcctgcagtgtgctggcctccctcacaggcctgcgctcccccaaggactcgagcgggaacccctcctgcttcctccagcttctgggggctccagcattcctgggcttgtggaggcctccctccaactccgtctctgtctcaatgtgggcttcttctgcctctgtgtgcctcctccatgttctcttacaaggacatttgccattggatttggggcctgccgggtcagccaggatgttctcatcccaagcacaggaagccaggaggacagtcctgctcagagccctgaggcccagcttggggacggcagcagcctccactagaggatggggtctgtggctgtgggtggtgtggggacccccggccctcagtgctgctgccttccaaccagtctcctcccacgcagacccgcaccatctcacccccactgcatgggccttccctgaacatcagccatcctgggacctggggctcttcttccaggataacagcaacatccggattgtggccatggagctggggcagacacaaaggtcactggagaggccatcactggacaagagacccagagccctctgaggcccagcactcatccacctgatgagctctgagcccggtttgttcagctggctgccctcagacaggaggcgtcgtggcctccatcccacccggccacgcacagattccacggccacctctctcaccaacaccactgcacccgtctgacaaatcccaacataaacccccagctgtattaggccattcttccattgctatgaagaaatacctgagactgggcaatttataaagaaaaatggtataattggttcagggttctgcaggaagcgtggcacccacatctgctcggctcctagggaggcctcagaagctttcagtcacagtggaaggtgaagggggaacaggcatgccacagggagaaagcaggagcaggcggggcggagaggtgtcccacacatttaaaccacccagtctcacaagagctcactcactattgcgaggacagcaccaatccatgaggatccacccccaggacccagacacctcccaccgggtcccacctccagcactaggaatcacaattcaacatgagatctggcagcgacatgcattcaaactagatcccctgctgcctgattctctgtgtctccacctagctgctaaacactgtttgaaaagtcccacacaagccatggatcaggcctcctccagggtgtggcctcctgagcagccatgcaattggcacttcatttattattattattatttctttttgagacagagtttcattcttgtcacccaggctggagtgcaatggtgcggtattggctcactgcaacctctgcctcccagtttcaaattattttcctgcctcggcctcctgagtatctgggattacaggggtgtgccaccacacccagctaatttttttgtgtttttagtagagacagggtttcaccatgttggccaggctggtcttgaactcctgacctcaggtgatttgcccacctcagcctccaaaagtgctgggattacaggcatgagccaccgtgcccagcctaattttgtctttttagtagagacgaggttggccaggctagtcttgaactcctgacctcaggtgatctgcctgccttggcctcccaaagtgctggaattacaggcgtgagccactgtgcccagccctcatttattatttattgatttagagactgggtctttctctattgccccgtctggagtacaataccacagtcatagctcaccgcagccttgacttccccacctcaagcgatcctcccacctcatcctccctagtagctggaaatacaggagtgtgcaaccatgcagggttcattttttaaagggtggggcttactcttttgaaatgtactaagtgacagctgaggagatgttccagacccaggaaacaaaagaaacctcagaccctgctctacaccactaaatggcaaaagcaagaagattgacgacaccaagtgttggtgaggatgtggggcatctgagattcccgggccctgagggtggagggacatggtcccatccagatgctgacatcaggagccagccccgcagggcctcatgaggtggcgtacccaccccacaacccaggcactcctctccagggtgcccgcccaagagaaacgaaacctgtccacacacagatcggtgataaacaccatgcagccttattccttgagccaaaagggaaaagacccaaacgtccatccacaggtgaataaacgtcctgtccatccacaccatgaatggtccattggcaaggaaaagcaatgaaggctggtaaaaagatacacatgcctctcaaaatcagcgtgctgagtgaaagaagacagatgtaaggggattggtttggctgtgtccccacccaaatctcatgttgaatttcccacatgttgtgggagggacctggtggcagataattgaatcatgggggcggtttccccgttactggtctcatgagatctggtggttttacaaggggaaacccctttcactcggttcttaattctctcttgtctgatgccacgtaagacgtgcctgtctccttcggccatagttgtgaggcctcctcagccacatggaactgtgagtccattaaacctctttttctttataaattacccagtctcaggtatgtctttatcagcagagtgtgaacagacaaatacataaagggacacttactctacaactccctgtacaagaagctctagagcaaaatgactctatcatgaaagacatgagaacagcagctgcccctgggtgggaaggactgaacaggaagggcctggaagaacctggggtgtggagtgtgctacatcttcatggaggtgggggctgtgctcagatacgcatgcctcaaaactcctcaaactctacacttaatatctgcacatttcacttcaatttttaaaaatagatgctacaccaagaggacattttcctccatcagagtggcaagaacccaaaagcttgatagcaccctgcctggccaggccggggagagacagccctccctggcatgagcacacacaggtgcagcccctctggagggcaatgtgcacacttccatcaaaattacaaatgcatgttctctttcacccagcgactccacttttgaaaacgttgcagtctataaacactctcgttcacgtgcccagagagcggcacatgtagaggcctactcctcacagcacagtgtctagaggcaaactctacagcagtctataaatactctcgtacacgtgcccagcgagcggcacgtgtagaggcctactcctcacagcacagtgtctagaggcaaactctacagcagtctataaacactctcgttcacgtgcccagagagcggcacatgtagaggcctactcctcacagcacagtgtctagaggcaaactctacagcagtctataaacactctcgttcacgtgcccagagagcggcacatgtagaggcctactcctcacagcacagtgtctagtggcaaactctacagcagtctataaacactctcgttcacgtgcccagcgagcggcacatgtagaggcctactcctcacagcacagtgtctagaggcaaacttcacagcacctgcaaaggaacaggtgtactatgctacctatgctaccttttgcataaacatggaaacatgaatagattcagatttgcttgtaatttcctaaagaaactctagaagacatttgagacgttgataatagtgattatcagctgatgacataggggctgttgtctagaagcatctataagccacaattaacggcctgcactaaaggctgaaggggtgtgtgtccaccaggaaaggaaaacagatattgtgagagagcccttgagaaaataaaccagagtggaggcgtggcctgcaatggccacacacacaattcacacacactcacacacagtcacacactttcagacacacgtacacccacacacattcacactctctcacacatacacacagacacacattcacacacagacactcatatacacacactcacattcacacatactttctcacacacacccacacacatgcacacacactttcacacacatacacacattcacacacttacacacgtacacacaacacacattcacactttcacacatacatccacacactttcacacacatacaccacacactcattcagacacacactcatacacattcagacacacagacacacacatacacacccacacacatacacatttagacacacattcacacatacacccacacacattcacagtcatacacacatattcacacacatacacccacacacattcacagtcatgcacacatttacacacacattcacacacatacacacccacacactttcacagacatacacccacattttcacactttcacacacatacacccacacacattcacactcatacacccattcacgttcacactcatacacacattcagacacacattcagacacacattcagacacacacatacacacccacacacatgcattcagacacacacccacacacattcacacttatacacacacgttcacacacatacacccacattcacacacactttcacagacatacagccacattcacactttcacagacatacactcacattttcacacacactttcacatacatccacacacattcacactctcacatacatatatgcactcatgcaccacactcacacattcacaaacacattcacacacactttctcacacacacacattcagacacacattcacacacacgttctctcacacatacattcagacacatgctcacatatgcacccacacacttttgcacacactttcatgcacacatcccacacactcccacacatacgcactcatgcacacacacacacatacactcacacacatacactctctcccacacccccagcagatagccctcccctgttaaagacaagttactattaggaagtgacttcacacctatgcataaatacttcaaaaattaaaatgaaggaattatacataaaagacaaatgaaaaacattcacccctgggagaacgacccaaggaaacacaggcaaagttcagacaaaaaggtttcttctgcttcaagacaacctcatctcctaaaagggagaagcgctcaaaaaggagatgtgtggtttcaaagaagagatgataagataacagaaggtgtgagccactggagcccagaaaagagatggaagagagaagttgattggagaccataaccacatctgaacaaagagaaaaataaacatggctgaaaatgcctttaaaaggataaagtgttgagcttgaggaagtcacacacaataaagtgaaagtttctacaatgtaaaaataagacggtaagtacagaattcaaacaaagaagatataacacatgcacaattgatgttcctgaagaagaaaacaaaacacataagcctgaaaaaaaaaaaatagactctgggctatcacaaaatacatgttccttaagcctggatctgcagctctgcagagcacacattctgggggcaggagtggggccagcaaaacagcacgatgtatgctgctgccattgttaaacttcagggggttggaaataatcagacggagcatcacttaaatatcagaacacagtagctacagagttctgatggaaaaaatgtttgacttgaggattttatatccgataatcctgacttgacgtataaaggaaacagactcttaggtaggcaagaacttgaagaatacacagcgcccacaggaggagaaagcggggatctcccgggcctgtggcagcccgagattcccattgtcccagtgagacaggaggtggggcttgactccagaggaagggctcagacactggaccagattgaggactagctaaaacagtgctggggtgaaagcagctttcaatcagacctgcccaccagtgtgccatgtcaatttactgttgtcatggcaacgcccaggagttactgcctctttccatggtacccaatgatccaaaagttactgccccttccctgcatactccttaatctgcatgcaattaaaagtgggaacccaagtgcggtagctcacacctgtaatcccagcaccttggaaggccaagaccggtggatcacctgaggtcacgagttcgagaccagcctggctaacatggaaaaacctcatctctactaaaaatacaaaaattagccaggtgcagtggcacatgcctgtaatcccagctacttgggaggctgaggcaggagaatcgcttgaacctgggaggcggaggttgcagtaagctgagatcacaccactgcactgcagcctgggtgacagagtgagactctgtctcaagaaaaaaaaaagtgggtataaatatgagcagaacagccctgagcttcccctctttgcctatggggtagcccggcccagcaggtgcagtcttggagctataacaccactgaagctgtgacactgcagcttcgataaagctgttttcttctgcctctggcttgcccttgaattctttcctgggcaaagccaagaaccctctcaggctgagccccactttgcggcttgcctgtcctgcatcaccagcatagttgtccatagcaaactcttgctctaaaaagtgctcaagtttgagagggaaagggtgctacaaaggctacaaatgacattagtagaggctggatgtggtggtgcgcacctgtggtcccagctactcaggaggctgaggtgggaggatcgcttgagcctggttggttgaggctgcagtgagccatgattgcacaactagacttcagcctggtaacagagctagacctcatcttttaattcattaattacaggatattattagaacatctgacaacattggaatacagatggcatatcatgtaaaaatacttcttattaatactaatggagatgtatgaggttgatgactgtgttgaggttatgtaagagaatactcctgttcttacaacacaaatgatacagcaaatgggatagaataataggtaaatctgagcaatgggtatatggctattccttgcactctttttgcttttgtgactttgtctaagtttgaaatcatttccagataaaaagtctaaaaagtagaagtcaagtgctccaggtaggatgataaattacacggtgagccagcacaggggcctctccagcaacctcagatgacaaaatccaggtgacaaacgctgatgaagacaaaactcaagggggtaggaaccacagcaaaggctggggacaagctctggaatcatctgaatgttaaaccgggtgacagtgacaatggaaaccacggtgtgaggaacagaagttaaatgttacaaactttgatcacgtccaaaaaataataacgttagaaagcatggaggggttgggagtaaaaatgtaacttggaacccggaacatctggtttaccaacgtggagttcccttcgttcgcaagctctttcacggtagcttttagcaggtcttccagtgcttgagtctctgtgaggtgaaacctttatttcaagtgtttccttcggcttcaccttggtttgttcttgtgaaactcaaacacaggagatgctctttctgataaacgatgcccgtgactaacattatttctactcctgtccctctttccagttctactggacccttggaggaaagttgtcctttgtgagattgaacaaagttggttatctggaaggagagtttggagcatgcttttgacttcctcttggtctcctatgttactcagtttttaaatatgaggccggacctttcttacaaaacaaaaccatgattcttctttttaaaggggaggaaggggcttagcaccccatgccgcctgcctgagatgtgggggccatgatgctgctgaacgtccctcggtctccagggctttcccacacaaccgtggaggagatccctgccgtgtggtcacctgggttgctgccccgatgtggagcggtccaaccctgcccgggcctaatcagcagaatgacagccaggcatggctttctgcatcttgagggaatgcatgtgggcagcaggaccaactcacatttcacctccagaggaaatgagatgcatgttttccaaaccctgggattccaaacacagacctgtgaatggctttcgttgatgtgaagtcttcacctttcatgcacacgacttcatgagggctgctccccattctccagagctgcgtgcatgttgctgacagttttttaagctgactttatttttagaacagttttgacaggaatattgagaagatgtcacagagtccccatatagccctcacacagcttcccttattattaaaattttacattagtgctgtgcatctgccaccactgatgaaccagtattgaaacacaagtattggctaaaggccctgttctacatggtgcattcagatttccctgattcttccctaatgtccttgccctgtcccaggaagggcccgtccaggacaccacatgacatttggtcggcatgtctccttaggtgcctctcggctgtgacagtttctccaactttccttgtttttgatggccttgacagtttttaggagtaccagtcagaaattctgcaggatgccccactcttggaacgtgctatttttctcatgagtgactggtgttatgcgccaggggaaagaaagcgcggcggcagcactccactggcgtcacatcctacccagggcgcgtgctctcaacaaggctgtccttgctgacattgaccttggcccccggctgaggtcgtgctgtcagtcttctccgctgtgaagtcactgtggggtcctaattagggaaaaggagtcaggctgcagggagcaggggaagcaaaaagaagcagcagaagaggtataagtctgcctttcttcacggtgcaggacacacagccctcctgcacagataactcacaatcttcctgcacccagctatcaccagaccctcagctgatagaaaaatgcaaggtagctccctgcaaccctggcgttatcagtaccgcacgcagccctctgcagcccaagaaccatcctataaaacctccagcaagcctttgaaccccagcagtcagctcctcttctgctgagtccgcctgtttcctcctcgcaacgtattttcctattttctctaataaatctgcccttctttatctacaactgtcttgggaaattctttgatgctccccctaccccggaccaccaccacccagatagtcatcacccccctcaacagttatcacctgccttccataccacactcttgggaaggaagtcaaggtgcacagcccacacctgaggagggggactcgcggtcccctccttgagggcaaggtatctgcgtaaattatttggaatcctttggcaatggtgatttgtctcttctttcccatgtagtttattcagtcactgatgtctgtcagcactgactcatggacacctgtgtcatattttgggtcatgactcaaccctactttattttgttgctcaagttgttctggctttggccattgggagctcttccagttggctcctgtgtccctttaaggtaggatttggagattttttttagtacttcctttctatagatttatcttgtatatttcttgccccagtcccagaatcagccatttctctgaggagccctgtttctttttattggagaacagtattagaagccaagatctgagcactaggtgtgtttattgctactggaatatgattgcttctaggccgtctcagatgacagaggagaggtatatgtatactaattaacgcacatacgcatatctataaatatttctatatgtaatcgtttgtatctgtattatgctaaacatgagtttatactgataccttccactcaaattcaataatgcatgaaccattctagtctcatcccctgctttatctgtaaatcctcagagtgagaagcctgactcccactactcatgatccatttactgaatcactcaattccggccgggcacggtggctcacacctgtaatcccagcactttgggaggccgaggtgggcggatcacgaggtcaggagattgagaccatcctggctaacacggtgaaaccccatctgtactaaaaatacaaaaaattagccaggcatggtggcgggcacctgtagtcccagctactcaggaggctgaggcatgagaatggcatgaacctgggaggaagagcttgcagcgagccgagattgtgccgctgcagtccagcctgggtgacagagtgagactctgtctcaaaaaaaaaaaaaaaaaaagaatcactcaattccagtgcacatgagctgtgggatcagattgtgaatctgtacttccatgggaagcaccataagctagagtgcagtgcttatgctcagttcccttttgcctttggtcttacccactccactcatttatgcagtacccttagggcagcacctgctctcccattgtctcttcagtgaggtaattttacacatttgtaatacagttggattctctggtcacagtcagtattccctcctgggatcccttgacctcctaaataatttttttttatttgtatacattaagagttcctctgggctataaagttctataggttttgacaaatgcctgtcaaatatccattattacagtgcagttttactgtctgtgtcccatatattcatccctccctcccaccaaccactggaaaccactggatgttttactgtctttgtggatgtctttttcagaatgtcatatatttggaatcatacgtaggtagcattttctttttttttttttttctaggcagagtcttactctgtcgcccaggctggagtacagtgccgtgatctcagctcactgcaacctctgcctcctgggtacaagcaattctcctgcctcagcctcctgagtagctgggattacaggcacatgccaccacgtttggctaatttttgtatttttagtagatatggggtttcactgtgttagccaggaatggtcttgatctcctgacctcgtgatccacccacctcggcctcccaaagtgctgggattacaggcgtgagccaccgctcccagccgtaggtgacattttctgactggcttctttcacttagcaatacacatctaagattcctccaggtctttttgtggcttgataggtgggtttttaatcaccaaatattccattgtatgggtgtacaaagtctatctgttcacctattgaaggacatcttggttgcttttcgttttgagtgactgtgagaaagctgctataaacattcatgtgcaagtttttgtgtcgacatacgtttttaaatcagttggataaattccaaggagtgcaattgctagatcttatggtaagagtttatttactttgtaagaaactgctgaactgtcttccaaagtggctgtaccatttaacaccccagcagcagggaatggccaggcctggtgccctgactgctcaccaactttaggtgccatcagcttcttttctttttttctttccttttttgttttcactttcaccattctaatctgtgtgtagaggcatctcattgttttaatttgcaattccataataacaaatggtttcaaatatctttttcatatgcttatttgccatctgtatctttctggtgagctgtctgttcagatctttttcccattgttaatcagaatgtttgttttcttattgctgagtattgaggtttctttatatattttggacaacaattgaaagattaaatatacaaatggacagaccttatagaaatagaactctgaccaataagttgcaggaagcagccctggaaactaacccattatctatagtaaccagcccaggaagccagcctgctatacctcagacttgtaagatgtcagatcgctatctctaccaacagtccaggaagccaaacaatagcctttgcaacaatcagccccaaatggccaggacttgacttataactgactccgtcccatttttttgttcccacttccaacttaggatcaaccaaaggaagtcaaatgtgctcccctaaccaatcacataggagccccacttctagatagctaccccaacttctccaggtcaatagcctccaatcggggcaccactgaggcttgccattttcaatggtgtctttcacagaacaaaagtttttaattttaatgaaatctaacatcaatattttctttcttgggtcatgcctttcgtattgtacctaaaaactcattgccaaacccaaaatcactttgattctttccatgttatcttctaagatattatagttttgcaatttatatttaggtctatgatccattttgagtttatttttgtgaagagtataatatctgtgtcaagattcatctttttgcatgagaatgtccaatggttccagcactatttgttgaaaagactatcctttcttcactgtattgtattcacgcttacatcaaagatcagttgactacacttgggtaagtcagtttctaagatctgtattctgttccacttatacactttatacattgttggattcaattagctaattttttttttttttgagacagtgttctctctctgtcgcccgggctggactgcagtggtgcaatctcggctcactgcaacctccacctcctgggttcatgccattctcctgcctcagcctcctgagtagctgggactacaggcgcctgccaccactcccggctaatttttatttatttatttattttagtagagacagggtttcaccacattagccaggatggtctcgatctcctgaccttgtgatctgcccaccttggcctcccaaagtgcagggattacaggcgtgagccaccgtgcctggcctcaattagctaatattttgttgagaatttttgcatctatttcatgaaacatattggtctgcagttttcctttctcataatgcatttatctagttttgctattagggcaatcctagcctcataaaaagaattaggaagtattccctctgcttctcttttctggagatattttagagaattggtaccatttcttccttaaatgactggtagatttcaccagtgaaaccgtctgaatctggtgctatttttccagaaagttattaaccatggattcaatttctgtaatacacatgtgcctattaagattacctctttcttcttgtgtgagttttggtagtttgtgtctttcaagaaatcggttcatttcatctaagttatcaaacttgtggatatagagttattaatagtattactttattatctttgaatgtccatgggatcagtagtgaagtcagtccggctcagacatccacagaatgaacagattatgaccctccgctgggcctgggtccagaggttttgggcattggcctcaggggatttgagaccacatttgaaaactttgcatggattgctgagatgtagtccgaacttgctgtgtcactgggtttatttccaacctctggcctccccatctttaactggcttatggtatatggtataagtttgggtaagcatcttctttttgagacagggtctcactttgttacccaggctggagtacagtgctacaatctcagctcactgcagccttgacttcccgagttcaagcaatcctcctgcctcagcccctccaagtagctgggactacagggatgtgccaccatgcccagttaatttttgtattttttgtagaggcagggtttcttcatgttgcccaggctggtcttaaactcctgagctcaagaaatccacccgcctcagcctcccaaaaatgctgggattacaggtgtgagccaccatgcccagcccaatcttgcctttcagttttacccaggtgaagtggactattgagttctggggtcccagtagttgtctattttgaagcagacatgttctcaggattggagactgcagcccaaagcatggagatctggggcctttgggcagagatgggagggcttgtctgtgcccacacacagctgtggggctcagaggggacagttgtacttcactagggtcactggctcacacagcacaatgtggacataaaagtccaggatacaaggcaggcacacctgatggggagcaattggagcacggaggcaaggttcacaaacttgtctgcctagagcaactgcagaaaagtactgacacctgggccccataacccatgtcagagatgctcactcagttggcttggggtacagccccatgttcaggtgcccttgagcaagggccaaacacaggcattgactgcactttggagtaggaagaatgaagtagatgagcagaggtgggggaccttgtcgagggatccctcctcaggaggccaaggtcttcatccaccaagtgacaatgctgccttcgcctgcgacttggaacactgacaactcctcacaggagaagctggcggagccttgtgcagaccattccagtcccatgaggtcatcctcatacgtactaacaagctaaagagaccagacaagcccgatacctcccactcagtcttgaaaacgttgatgccttaaacctcccactagacattaaaggaagcttctgcctggggccctgcatgagaagggaggtgagccattggatgtcatcactgtcagtcatccagggtacaagaggagcctcaactggtgtttgcacaggacttgactacagaggcataggtttttgccttttcctccctggagtctatagcttggcttcaatcccaggtaaatgtcagaaggaacctggaaaaacttctagaatgcctaagtgcagccaagtaaacagaaacaggtttaagaaaaatgaacaaaatgtattggcttgtctaattgaaaagtccaacagaagagtggctgcaggctcggctgaatcaaggtgctccacgatcagcatccatctgatcccccccacccatgcttttctttcctctgcactggccactttctctcacaggctttccattcaccggaggaaattgtttccagcattggactcatgtctttccagttcaggaacctcaaagagaaggaagtctataaaccacatcctgcctttcatttttggactcttttctgttccattgacctatttgtctatcttcatagcgataagacattatttttattaatgtaggtttataataagttgaaattggatagtattaattctacaactttctttttttctccaagttgtcttgcctattacaagttctttgcatttccatatgaatattagaatcaacttattaattcttacaaaaatgcctaatgggattttgattgggattgaaatgaatctatacatcagtccagggagaattgacatcttaacaattttcagtcttctgatgtataaatatagtataaccattcatttatttagatcttttttagtttctttcagcaaagcattgcagtgggttttttgttttgttttgttttctgtttttgtttttgtttttgttttgaaatggagtttcgcttttgttgcccaggctggagtgcaatggcccagtctcagctcattgcaacctccacctcccgggttcaagcaattctcctatctcagcctccaaagcagctgggattacaggcttccgccaccatgcctggttaatttttgcatttttcgtagagatggggtttccccatgttggtgaggctggtctcaaactcctgacctcaggcaacctgcccgcctcagcctcccaaagtgctgggattacaggcgtgagccactacgcccagccagcattgcagtttttagtgtacaggtctctcatatatcttgtcagatttatctcaaaatatttattttatatgtttatattataaatgggtttgttttgttttgttttgttttgtttttttgagagagagagtctcactctatagcccgggctggagtgcagtggctaatctcagctcactgcaagcttcacctcccgagttcacgccattctcctgcctcagcctcccaagtagctgagactacaggcgcccaccaccatgcccagcaaattttttgtatttttagtagagacggagtttcaccgtgttagccaggatggtctcgatttcctgacctcgtgatccacccaccttggcctcccaaagtgctgggattacaggcgtgagccaccgcacctggcctatacatggtatttttaatttttattttctgattgtttgctaatagcacatggcaaacaatagatttttgttgattgatcttgtatcctttcactttgctgaactcgcttttttttttttttttttttgagacggagtcccgctctttagcccaggccggattgcagtggcacaatcttggctcactgcaagctccgcctcccaggttcacgccattctcctgcctcaacctcccgagtagctgggactacaggcgcctgccaccgcgcccggctaattttttgtatttttagtagagacggggtttcactgtgttagccaagatggtctcgatctcctgaccttgtgatccgcccgcctcggcctcccaaagtgctgggattacaggcgtgagccaccgcgcccagccagaactcgcttattaattaaaatatttttaaggattccattacactttgtatatagatgatgatgttgtctgcaagtaaaaacagctttattgctccctttccagtatggacgccctttatttctttttcttgccgtattgcacagactagaacctgtacaatattgagtagaagtgatgaaagagaacacccttgtcttgttcccagtcttagggaaagagcattgaagcttttacattaagcgtcacgttcactgtagggtttttacagatgccttttgtcagattcagaaagtttcctgctattcctactttgttgagagtttttattattaaagtatattgaattttttatgtttctgcatttttggcttcgtcatatgatttttcatggttttattaatatgataaattacattgattgattttctgatattaagctatacctgcattcctgacttaaatcccacttggttgtactgtctttctttaactaaactattgttaggttcattttgttaaaatgtgtttagaatattttcacctatgttcatgagggatatttgctgtaattttcttttattttaatgtcttggttttggtatcatagtatgatggcctcctggaaggagtattccctcctcttcagttttctgaaaatgtttgtgtggatttggtatcatttcttccataaatgtttggcataatttgctagtgaagccatctaggtgtgaggttttctttggggaagaatttaacagtaaattcaacttttggaatagatatagggccaaattatctgtttcttaagtcaactctggtagtttgtatcttttgagtaatttgttcattttatttaagttgtcaaatacactggtataaagtccataatatgtgcctttaccatccttttaatatttgcaaaataaatttgcagtgatgtcacctttctccttcctgatactggtaacttgtgtcttctcttcttttttcttgatgaatatagccacaggtttatcaactttattaagcttctgaataactagcttctggtttcattgattttctctattattattgcattttattattttctacttcattgatttctactctgatctttattgttttctttttctgctcctcaaatttaagttgctcttctttttctggcctttaaggcgcaagatgagaccattgattgaagttctttcttttttcataatggaagcatttttaaggctaaaaatttccctctaagtactgctctaatggcatcccacaaattctaatatgttttcattttagttaaatataaatacttcctaaattatattttaatttattttttgaccattgattatttataaatgtgttatttaattaagtatttaaggtttttacagatttcctttagttattgatttctaatttcaatccactgtggtcagagaaaacacttttgtatagtttgaatgctttttaatgtactgagacttatggcccataatacagtgtatcttggtaaatgttctgtgtgcacttaagaagaatgtatattctgctcttgtgtggagtgtcttataaatgacaattgggtcaaattgattgacagtgttcaaatctatttttcattagtttttcctacttgttctatcaattattgaaagaagactgtaatgttcgtttgtctatttgtcctcgtagttctatcagtatttgtttcaggtgttttgaaactctattgttaggttcatcaacgtttatgattgataactcttcttgattaactgacatcttggtcattatggaaatgaccttctttataccccaacaatattgtttgttctgaaatctacttggatattggtataaccataccaattttcttttaactaatgttagtatagtacatattttctcatacctttactttaaatgtatatgtgtctttacagctaatatttgtttcttataggcagcatatagttaggtcttgcttttttatccaatgttaaaatccttatcttttaatttgggtgtataggccatttttacttaatatgaatgttgatatgatctattaaattctatttgtcccaatttgatttataaggcaggatttgaacagatatttaaccaaagatgatatctgaatggccagtgagcatgttggaggattctcaacttatttttccattacaaaaatgcaaattaaaactacaatgacatacagctgcacactacttagaggggctaaagtggccgccctcacctggtgctggtgagaatgtggatggactagggctctcattcactgctggtaagaatgtaaaacagtgcaagaacttcggaaaatagtttggcaggtttttttaaaagttaaacatgcacctgccatatgacccagccattccactcataggtatttttacccaagagaaaggaggtttttctatacatatatctgtatatcgatgttacatcaacttcatctgaaattgtccaaacctggaaacaactaaaacgcccaccgacagatgaagagagaaattgctcctctatccatacagtggaacatactcagcaacagacggatgaactgttgatacgtgagacaacatggagaaatctcaaaatagttattctgagtgaaaaaacagacaaaaaagggagtacatatttcatgactctatgtgtgtaaaattctagaacacgcaaactaatccgtagtgacagaaagcagatccatggttgcctggggagatgaagccacaggagatagggaggaaggagaaagggagttcgaaagccaagaagaggctttaggagcggggatttgtacatcttgattgtggtgacgcttcacaaatgtatatatatgtcaaaacgtatcaaattgtccatttttaatatgtgtcactaattgtatgccaattacaccccaaaaaagctgtttttcaaaaatccaacttaaacttagaatttaccaccaaaagaatacaaataaggactaggccttccaaaacactagagaaaaaataaaatagtaaagaaaacagctcacaaagccaaagatagggaaagaaaaaggataacaaagcataaataacagatgtatcaacaaacatgtctgttttgacaataaacactatttaaagaaaaccatccaaatatacactcctcacaaagggtacacgtaaaataaaatacttaaatgttaaaaagaaaaggaaagcaaatatatgttaggcaagcataaacaataagaaagagagttggtaaaatgagtatcagataaagccaaaaagcactaaaagagacaaagagtaatttgattctgaggaacaattaaagacccaatgagggcacagcaacgattaacctttaagcagggaataatttatcatccaaatctacaaagcaaaaactgtaagacatacaactggaaattagcaacaaaaaggcaaatgttagccccaaggatcaagctatataaaggcacactttgtttaattgtgtccatttttaatttgaatggtgagattgttttgaatgagtgggagaaaatttacatcctccaacagcgactgtgagacacagcttgaggagtgcatagggaacccttagccctccctccccacctgcccagccctactttgggccacgaggagaggaggcagagcagagactgtcttcagccatgagagtgatggtgtgtgagagactattccttctcctagtggcaaacccagctcagagctggctcttctttctccctagagcccaggtctccagcccaaggaaccgcctcaccttgtcatcccaggagggttggtgcccacttatctgcagcttcctgacccaaatagccagaccttccacaggtttgcctacaagagggctagtgcgtcctgcaactcagatgcttttccatcaaaataaatgcccatatagaaggagtcaagaataaatacccacatccaccatcgcagtgtggtaagaacattacaaggacactgatgagaatgaagccggacatcactgagccccaccgtcctgtgtcatgttggctaaggccccgtgctccgtcctgtatgtaagaagccagccgggtgcctctcagggttctgggcatccctggggggttacgccctgtgctcactctggctggaggccccgactccagcagaggccactcgccccttcctcggctcctgctgccgctctcttctcctgagtccatgaaaacactgacgccaagttacatcctgttccttatttgtcccaacactcctccaagagcccaaactactgtgatctcaggagctggaaaaagcttgccgctcagaaaggcaaacaccttgcacatcttccaccaggacacctgaagtcaagctgctccccacaagaggcacaccagtgcagatggttaaacgacaacttctgcacccactcctcaaagaagtccataatctcttgcctcctcttggtcctgggagccatgtgctctctgcactcttgccttgagcccagtcccagctctgggaggcatatgctcctggccatcacccctaatcaaatggggaaactgaggctgggagaggataagggactcagccaagattgtaaccctactaggtttgtagcccactgtgcagcgcgtcaatacacagatacagtgtattgcactgggttgcagcaggggaagactttagtaattgtagggcagccgaatgaggagatgagaggaaacctcaaatccacctgcccaggaagtttgggatgggctcttaaggggtctgggcaggtgatgggctaaagtgtggggattgctgactggtggagaagtgtggaggatgaagaaaccgcattcctgtactttactgcttccttggtcgggggtcttcatacctgttggcctcagccgtgctactagaattcaggatctgaaaaacaccttaagcaattcttgagtaaaaagacccagggccagagagtctctctggtggaagaacggggcagcaggtgctcagcctgccgagggactctctgtgcattagagctgcaggggactgggtggaagtggccctgcacacccgggtcggtgcctcgctataactctgcctgaagcctggcttggattgtcgttaaccctgtgaggtgattcagtgtggagtcaggatccaatatgggtttatttcacatgctaacaccaaatgagagccagatatttgaaaatgcagatttccaagcttctcgggagcaccctcaagtaggtcagcggctgctccatcgggccccacgtcgctcaggcttaagtaaaacgtgcctggcttcaggcagacgagtgaatgtgagtgtgtctgtgagtgtgtatgtctacgtctgtctgtctgtgagtgtgtctctgtgtctgtgatgactgtgtctgtcagtgtgtctgtgtgagatcgtctatgagtgtatgtgtctgtgtgtgactgtgtgtgagcaaatgtctctgtgtgcctgtgtgtgtctgtgtaagtgtgtccctgtgtgtctgtagtgtgtgtgtctgagtgtctgtctgagagtgtgtgtctgtctgtatgcctgcaagtgtgtgcgcgtgtccctccatctgtgtgtctgtgagcacctgggtctgcatttgagacccctgccctcaccctacaatctccctgctgccacaccccaaagctccagcacattcctggaggaattagagagacgatgctgtgccactgccctccctttgaagtgcacctgatggggacacagggtctctgccatgatccccactggggccttgcccctgaccgcacacactgtcccatctcaggagggtctcactgctgccctttcctggctgtactgatggcccaaggggatgcgggaaccatcaagaccgagtccctctggaggtgcctcatccccgcaccgcccggccctcagtgcaccctctatggggtagcactaagccatcccccaggttgcaggagggagatgaactaatctgaaacattaagtatggctttggaaccaacttggctctccggatgacaactcccttgttccagatggttcctgtgtgcgcccgcgttcgttagcatgctaatttattctgactcattccggagctggcgcgcgggctggcgcacacctctatgccagcacgagtccccgaggcccgcgattcccagctggagcggccccctccccgggggctgtcacacacgccgaggggaataaagggaagggaacagttggggatgtggcttcagtggcagcccaggcaggctataatttcagccctggcgccctgacattcacagcaagctctcgctctgtggcagaatcctctcggaaggcagcgccaccctctgaggacgttcaggctgggaggtcccgggtggatctcccgctgcagctaaaacaccagtcaggcccccacaaggaaacccagagcaagcaaacaccgaggaagaagtcgctccctcaaaggcagcgtctgggggctggtaggaggctcccggctgccggccccacccctggttgtgaactctgtgaccaagacagcagggaccgagggctacccacactccacaagcgggagggatgggagccgcccgtcagtgccctgcccacctccgggtgcccgccttccctggaaacattcccaccgtcttcctgcagctgaagcagcggaatcaccctgggatggcctggggaggagcccgcagaacgacccgcatgaggacactgagctgcaggaagcacacgcagggctggggtctccggaccgtggggcagaacttggggggtcagagagaacacacacattcgaatccctaaattcctggttcaagggacagaccaaaccccaggtgctcggtgggaccacgggagaagccggcttagctcaagaaggcacaagggcagtggccaagtcccacccccaggctgagccctgccagacgccctttacaatgtcagcctgggagtctctcctgagtcagggcagccatccacaaagagtggaccccctagaagtctggggggtgtccttgaataacactgtcatccccaaatcagagagggagttcaggggacctggggatgaggggattcaggggacctggggatgagggagttcaggggacctggggatgagggggttcaggggacctggggatgagggggttcaggggacctggggatgagggggttcaggggacctggggataagtggagctctgcccttcagcggcgcccggagggcccgcaaccccatccccatgtcttcctcaagctcctgagggcgtacttggaaaagcacttcatgaattcccacactggtcccctgaccccaggactgaggagcaacacggtgggacccggcactctccctgctgccaaaccccaaagctccagcacattcccggaggaattagagagacagtgccatgccccaaagatttggaaatgcagtcagttctccctctacccgcaagcacggcttctgacgcgatgacactgtaaatacaactcggagctgcacccggcagcagctgctgctccagatgcagggtcctcatgggcatcagccaggcacctggttttccctcccgtccaggaaatcaggaaccctccagcccttgggctggagggaggctggggcgtctccaccacctgctctcagggacaccgcagcacccctctctgtgacagagtttggtccacagaagtgatggctgcagcactacctgggcctcatgctggcccatgcggggggactcaccatagaaccagagacggacacggagcaccttacctgccagaggtgggagacaagccccactgggtagcacagctcttgacacagccacgaaggagggagtggcaggcgagggagaggggacaaagcaagaccaggcccttccttccacccctgatgaccgagggcatcaccgatgcccaagggttaggccgctgggaattccgggcaggcggctgcagtgggagagttccagaagagagccctcccagcgagtaagatcctcacgtgagagagagctcctggctcatgttgggcctgggaggctgtagacacctgacaatgggacaccaaatgacaaggtggcccagctgccccatgtgaactggaggtcccctgatccactaagccctcgagctgggccacgcccaagatgctcctccctcaccaggtgaacgccacatgtgccgggccaggcccatgtgcccacaggccctcaggcacccacggctacacctgtggcctcatctgtggctcccgggctggctgatgggtggtctggaggctggtggcaagaggcatcatccagcagccaggcctgagcagggcacaatgacagtcacgtttccatgaagtgggagtgatgtgaagccacagtcctgtgggcccccaggtgtggccagaggctggccatgagaaggaccgagctggtgacaaggaggaagctgttggtggcaaggctcgttggaacagacacgggctgtacacacatctgcatccaggtgaccactcaggaagacccagatggggaggctgtgaatgaccaggtgacaagacaccccagcaggtgagccagaacaggggcaaggtggctccggggcggtgggggctcggcaggggctccggggcggtgggggctcagcagcacagactcccctcagggatgcccctgcttgggtccatgttgtccgcagccaccacccaggggacactgccaactgcctggtgcaggttggttatgttgggtggacaacaatccatcctctctaggaaagatggccattcggtccccagcccctggccccagcccagctttccaaatgtcttattccccagcaggatccccacagaatgccacttctgccccaggagccgctgcagaggggaagaagggaagagtgagcaggtgtcatgggatgacccggtctcatcccaaacccaccatgagcccctgtgaacagctagaagagtgcggaagatgaggggccgcagccttcttcccaccacaacaagccaccaacacagaggctccccatggcctgagtcctggggtgtgagggctgcacaggacagggccctgccctgcccccaccccagccccagcgttctccccagccccactccccacccctgctccaacatcctccccagccccactccccaccccagccccagcattctccccagccccctgccctgcccccacccctgccccagcgttcttcccagccccctgccctgcccccacccccgccccagcgttctccccagccccctgccctgcccccacccccgccccagcgttctccccagcccccgctccccacctctgccccaatgtcctccccagccccgcttccacccctccctcaccggtctctggtctgtccctcctgtccctcccagcccctcccagttcggcccttggaggttccacaaacgaggttgtcaaatgcctgtccaaagcacgtgccaatcaggcccagagggttttacagcctctgaggaggaggaagaggagttggggagccatgcctccccatccaggaagacaatattccaccatcaaggacacgaccctgggtatttacagatggtaatgagactgtccactgcttgaagttaccatcaataagcagtgaaaactgctgagtttcatgcaattctccctgattgcctggaaggcatcattattttaataaaaaaactcatcagccagcctacccagcgctcagcgtgttaattacagaggctagtgccccgcctccctctctcagccccagcttgactcttctccccacagcctttgatcccagggagtcggggcaggtggatggtgccgtccagtggggaggagtcccagccctgacccctctcaggtgcccagaccacctccccaccccacacagcacaatcctggcactgtcctttcccttcaaccacaaggactcactgggccatgggcacagaccaacaccagtcaagcccaaaattctatgtggcccctaaaagcaaggggacaaggacaatgggaccccaagaacagcagatttcatgaaaaggacccaagaagccaaggcatgtccagcacagcacgcagactgggtcaggcctgtctccagctacatggacaggcgtgtccaaacacatgccacaaccctgcaaaaagcacaaaaggaggcaccacacacattcgtcctcattgtgaatgcctgcagtgcgtctgtcatcatggctgggggaacaggcccaggcttttttatggtaaaagaagtgaattgaaagaggaattgtgtttcctctccgtaaagatgatagcacaccaggatgtccccacctaggggagaccaatgacagccttcccattatctcctgggccttctgggggcaggacctgcagccgctgattctgcccaggcatcagtgaatcctcttgaacataaatgtatcttgggtcaccttgcagccagcaatgaccacacagcacagttctgggccactgatgtaaggagcggccctgggtgggtgccccaggaagtactatagaagaataagactcagccatcagtcttgcttccctctttcactctcttctgtccttggtcctgacccttcttcctgcctggaacacggatgtgatgctggaggtgaagcagccatcttgcaaccatgaggctaaaagcagaaggacaaaagctaccttgcagatgaatgaacagaaagacagaaagagcctgagtccctgctggcaccatggaccccacaccaaatttgggtgcctgctgaactccagacttcttgatacatagaaattgaaaactcatttgccaaaccatgttaacttgggttttatgtagtgcaaagttgaatgtattcctaagcaatgtacccaagaataattgttactaacaacaaaaccgaagaaagccccttgtagtgagtggaagtgaattcgtgtaaccgtgcagctccccagctcctggatcctgtatcccgcctgccctgcaaagtcaggcatagtggttggacttggtttggctgctggaatgggaaaagttccgtgtcacctccgggaagccgcattcagcgggcagtgctcagctctccacctacttctatgttcctgtttcagaaaacctgggacaggtgacacatgttgatggagaagtcaacgctcagccctccccaggagggcaggtgccctggaggccttagaggtggtgtggggccggcagtgtggagttgctgcagctgggagatggcttgttactgccacacggtgcagccgagctcaacgtgtcacagaaaatagcgggggaaaggtttaaatggatctttatcttgaaaagtaaaacctcaaaaatagtctgatattgcactggatagagatttgagttttcactgccaccctgcgctggttgttagaatgcaaggagaatgcattgtttgagtttgttatctgttctcccaggaaaatgattggccacgctgcacgggcggctgcatgtgaaccccccacgacagtcacaggcccctcgacacggtgctcagaccatctccctggaagcatccttccctccaccacccttagcaatcagctcgcctttgattttcacctggaatgactcagcgggcactgatccgtcagtggctttgcaggcacctgcgctgtcccacccatcattctcagctcccgaaaccgcatcagtcacaggcaacttaactgcagtccccggtgaccggccactattgggagactgaccaataaggactggaagggaatcaatgttggggcaagtttggatgagggggttgagcaggctgcctccctccagacatcccccaggggacccccttttcctctcactgtttgtgctcccagcctgcctctctctgggcctcctcccttcctttttcacctggacgcacctcctggccctacagaaagaatggaggtcggcaccccatctcccaggccaaggagggcagctccctgcagcgatgtcggggtatggagggcaggggccgggagcagggggcttcactccaggctacagccagttcccccaagtcggggtcaaaattacagcctatcccacggcccacccatcctctgccctcccttatccagtcaaggtccctatccagtccaggtgtgcaggtgagggattccgagctgggaagggcaggcagacagttcctgcaggctcccgctcacatccagggctttttagggaccctgccccaaaagaggtccttgaagccacttggagaatgcccagctgtggatgtgtccagacagcagccaaggacgctcaggccagcgggagccgctgagatcagccaggcccagcctagcccagtggacggctcctgctgcaccctccctcctgggctgggcctgccaactctcacaactcccactccagccacggccagacctgagatcctctcctccctgaggctaaaacatctaccacattcggctggtggctgccccagctctgcctcaggtccctgacaggccggccccctgctgctggcagccaggcactggagtgacacatctgtctgtgcccacacctcctcctggggtctcaagtcttccagaaggggtcgcgagtcttccaggaggtccgccccaacctgtgatgctcctgttgtgggcgggggagcagctatgacggtggggagaattgccagtgcaggaaggacccacgggtgctgctgtgagggtggttttggggtgccgctgtgagggtggttttggggtgccgctgtgagggtggttttgggatgctgctgtgagggtggttttggggtgccaagtgacggtggttttggggtgctgttgtgagggtggctttgcttccacctgaatgcagagctcgcctccttcggctctccctccccccgggtgagcagcccaatcccggggacctgtgctagcccctgtctcgtggcctgttactgctgaggacagacctgacggcagtcccggtaggtcagatcccgggggcacccgcgagacctggggcaggaggtgggcaggtgccaacctcgggcacaactccagtgcgcagcgtccatgcccgggtggctgccgtgttgtcctgctgtggctcagcctgtccccttcgcagggaattggctgtgggagatctactttgcaataaacccgtccataaaagtgaaatgtcgattgaaggctctgtctcgtggggaatcggttttgatgtccctgtgcatcttgcagaagcagatgctgggcctcagcagcatcacagggagctgcgcctggccagggaaagtctggaactgcccaaagaacttctgctcaccagacctgggccccaagcagcagccctgggtaacctccctctgggaaccagcgggacagaaccagggggaaggctggggacggggaggacaagggagtgaagggggctggaaggacagagagggaaaggaaacttctcacccacctccactcaccagacgccctccactcatctctgccaaacctgggcgatctcacctatgacatcttgcaatgagacaggcggcatcacctattttataggagcaccaggttaagccactggccgaagtacccggtaggagacaggctgtgtgcagaggccaggcgtgcgtcaggctaacttcaggagcctggactcagggtggtgggtagggccagaccacgggaggcacctggcacaaaacccaaggaagccctctcagggggtgccagcccctccccgcaccccacagggcccaagatcgtgtgcctcctcctcttggcatcctccacggatgatgcaccgggcctggtggagaaggcgtctctctgcggaagccacatcagcaaaggaaccaagaaggaaggggaccaaaataaccagctggccactgccggggcagggacgcccacagctgctgacagccagaaaagagagaccagcagaaggggcacacggccgggtgggggtcagagcagcacccccgtgggtcccacctctagctacatcaaccaacgccaggccaggcaggggactgaggacagtgggcgtggtgccaccgccacagaccctgggcacactctgggacaaacagccagcctctgcaaaacacaaactgcacaggggaaaagaccggcagaggcgcaaccctgtagaaacagacacaggacaccggggagatgtgaacggtagctaagtatgcaatgatgtgaagacgttgtttttcattgttaggtataaccacactgtggctacttttcaaggcggccttattgtttagcgatatttacagatacatgaatccaaccctggggatttgctccaaaccccccaggtgtggacatgcagatgctggagaggagagaggagactgcgggtcggcactgggaggctggcggagggaaacggagtccacagcactgtcccctccccgtggtgtgcttggaattctccacaaccaccttttgaggaaggagctcacatagagacccgcagaggggcctggccactctggggtgtcaggggcaacagggccccactgcccaacccatccactctgggaaggggcccttcctctgtgcagcccctccagtcctcagcctgggaccccccccccaccattgtgagccaaacactccctgaggcacaaggatccaggcctctcgagtggagggcgggagccgagcagggaaagccaaggccgcctggggtgaggagacaggagggcaggagggggctggagctgactggaggtcccaagttcagaggtggggcaccccatggccgctgtctgtccacagctctgtggcacctgtggatttggccaacaccccctccgcagtgaggggggacccccaagaggaggggccacctctgtcctgctgttccctaagccccagcactcacacacatccctgaatccctcgctgtgccaccatcagccttgcagccaccatcgggcggcgtcctgccttcctccctctgaaaggcctactttgggaggtcagcccgactcagaggcgaggctgcagagctggaccttcgggaaccttcacaacccagccacaacggcccccagcacccgcagcctgccgaaggcatgcttctatcctcagcctcgctgccctcctgcaggccggggcctccctcctgcaatgctggctgtgggtggctgccagcgaacgtccagctgtcaccccagcccccgcggcatctcctgtccccacacaacaagccaggcagggctcgggctgggaggaaggggccctgggctccccttcgtctgcctggactgtgagggcctggggcagtgtgccagcttcatcgaatgatgtcagagaagctcattccgctggagctcggagcctcaacggccacccaggaagccctcagagtggctgcggcccctttcaaggggagagaagggcaggagccatgctaggcctcggaggggtgggggtatgcctaccttggaaggcaaagacccccggactctgctccccgccctcccctcagcaccgctgtgactcctctgtgcagggggcaaactgcacctcagaagagtcccatggcccatggtcatggcagctggactcaagcctgagtctgcatggggtgacaccaggagcagcagagccaggacttctggtggccctgagctcctctgcaccagacccctgagcccatcccaggcccagggagcccaggctgggagggggaggcaggctgccactgagccatggagaccagtttcccccagctgcccagggcacggggcagccccagcatcgctttgccatgttcctaacccacaccgccaggccccgtgctccagagtgagcctgtctccgatccaatacgctctccttcctggctaatccagttggagacttttcaacctcactataatttacaaggcagctggagcacaggatatttttaataaaaattaggtacaagcagatacaggggattaatagttgtattatgattttatagttctccatatacagcggcacggaaaagacaatcagagagcagggccatttcaggcagataaaatggggcatttatttttaatggaaagataatttcaggatgcatccagccatggagaaagctgctgaggcactgcgctgggcagaacaaagaggaggctggaggctcggcggcctcactgaaaagccctgtggagagattctgggcttgcgggaccaggggcaggctccccacctagtgggtctccaggtggggatcagcagtccaaaatcagagccatgtgagccctgccagaaagaaggacccaggaggggtccagcccctcacctgcctgctgtgcagctgtgggcgagtctctctgagcctcagtttccctacctgtacagcaaggactggatgagctcctagaaaagcggctgctctgcagagctggggagggggttgtggagatggccatccacagtcatctctgctcctttcccaggagcaaacacccaactgagcatctgccatctgccctggggtcacagcttcccttccctcaagttcaatctcagtggcttgaggccaccagcgctgtccctggggacacagctcttcttcccccatctcccatccccaccccaccccagtcatatccagcaggggctgagcctctccaggagctacgaggctggctttgaagcccagagcttgaaaaaggcactatagatggaaaagaagctgtcggggctgccatcttcaaagccagaggctgtggcagctgaagcccctgcttgggctttgctggagccccggcttgggctttgctggagcacatcgttctgaagacatgcccagccctgcccctcaccccaggctcccagcctcctgcatgaagctctgcacccctggagggacgagggactagggggccactcaggagcaggtggggcactcagggatagacaagagggctgcggtgacactgtgcctgggctggtcccccggggtccagggctctcctctggcccagagggacacccgagctccctgtgcagccttgtccaacctggagctcagaggaagtggccatcatggccctcaaatcctgtcccagtggacactggcaatgggctggcccggccagacaggctcacgtgggccagagggtcaccccctcttcctgcagcccaaggagaggagcccaaaaggagatcccctcagggacttccagcccacacagactgaggatgcccaaaccaaattatggccaaaggccccggggagctgagagaagacagggagtcagggaaggcagcgtctgcaggagcccccaggccccctcacccacccagggagtgacgccctgagcccccacagccagcccccagccaggcccccaagccctgcaggaaatggtcactgtgtccactcccggctggccacccctccccagtaagagtctctaacctgacccttccctagttgccccagaaccttccagaatcaaaggaaaccacagacttctctgccatgtcttctagttcccagggagcaggagaccctcctccgcacagcccatctgagggcaaggctggagaggcttctgctcccctgtctagatccccctctggagccagcagcagatgcctgacagagagaagcagttccagtgctgagaggcctggcaaagtccctcaggtgctcaggctctgacgggccacggctcgtggagagagcagtgtgccagatcacccctactcttcttccagggaccacctccccaccattccaggacacaccaacagaccctgtgtgtcgggctcaggagctgcccaagggtctgatgtcccaggcttgtgaggagtgggccaccaagaggatgggcatgcttggctggggacccccagccaatccaggtgggattcacttaactctctgtgcttgacacccagaagtcaccaaatgaagggacccacaaaatcactcatggtgaacacggctccatagggatataggctcaaatcacaagggcccatctcagctgggaaggtagacccaggctcggctgggaggtgaactcagacttgactgggaggtagacccaggctcaacagggaaatgaactcagactcggttgggatgatggccacaggctcagctcggaagtggactcaagctcagctgaggtgatggtcctaggttcagctgggaggtggactcaggctcagctgggatgatggactcaggctcagctgggaggtggactcaggctcagctggaaggtgggcccagactcagccaggaagtgaactcaggctcagatggaaagtggccccaggctcagctgggaggtggacccagacttagctgggaggtggaatcaggctcagctaggaggaggaaccaggctcagctgggaggtgaacttaggctcagctggaaggtgaactcaggctcagctggaaggtggccccaggctcagctgtgaggtagagtcaggctcagctggggtgatggacccaggctcagctgggaggtggactcaggtttggctagggaggtaaactgaggctcagtacaggttgaagcaccatcaccagggcagccgtgacaggtgatgacgttggactgcttttgtatgaaagaggcagcgcttagttctcactagaagagacgcttaatctgaatatggactggtctttcctggccacaaggcttctgcaaatatgaccatctttccccatcagcctggccttccgcacaacattgctgttagccaagggtctcccttcgagctgcaatggactcaacctcacagaatccactggtctgacgtccccactgtctggcagctgccagcctgagaggctggcagactggccttcggagactcagggatggcgccagctgggtggcgatgccctgtggggcctgccagggccctgaaggatacagtgcaggctcccagtcagtgacccacagctgggattcacggtctggggatctggggctggaaattggggcttttcatgtggtcacctctgtgatagttacaactcaccctttgactctcacagcctggtccttgaactgcagatgtgtcagccaatctcagagccaagcccagcagctccaggccagatggcctcacccacctccagcccaagagcatcctcttaggaggggggttaaactgagcctccagagaccaccttcccgtggcacctgctcgtaaactaactcatccgggaggtgggggaccactgggttccacatatggaaacaagggtggtgggagaggcggggtgcacagggccgagctcctcagcagggtccccatggatgggacaatcaacaaatgcagagcacacctaggagcctgcaaggccgccctgctgcccgcggcccctgcagaaccaagaggcttccactttctaaatcacacaaattaatttagaaatcagagcggctcccacagctagactgcaggtttcaaaatagcttaacaaattaccaaatcccctttaagaagacaaattattccagctcctccaccagcacctggttaatgatgcatgcacttttgttaggcgttaaatattcactagctgtgggtttgcacttgtgacccgttgcctcatttctatgtgggctggctgttgtgccccatgctgtcccagcacccggggatgctggccttgggaccaccgtgcaaggtgacggcccagcggttccaccttccctgaccatggccatggctcacctctgcctgcccagggctgcccttggtgcaggcagagcccacatcccctcaccagccttccaggccgtgccatagccttggcatgtgaggcctccttgccacccggcctccctccatccccatctccaggcacactcacccactggcatctccccggggctgctgtggcctttgtccctcttcctggtctgatgcacacccagggacagacatggggttttcctgacccgagtttcaggcctccagttcctgaccagcttctccacactggccccacaggcagagtgtgcctcgcccgcagagacgaggttatgttccccgaccatgggcgttcagggggtgggagaccaggagggcactcaggcatccagcactgccatccttcttgaggcaggtccccaggctgccagagttgtggcccagactccctggacagcagagacacctggtcaggactcaaccccagggccaactagagggagctgagccctgggaggacctgcaaccctagtggggccaccagagaagtccctccctcctcttccccaagacttgacagccgggctgtgccctgaacccgcccctactccccctaggctgcctgggcgccccgcattcactgtttccactcttgacagatggggaagggggagccaggcaggaaggaatgccccacccaggggccccccagcaacagtgccacccagcccaggaccccggcttcacacagacaggctccccagctgcaggggctttcctcgccctccctctcctcacactggggctcttctgatttgagatcaacttccaaatgtctttcttgaatgttctgcctaattaacttcacattaagaggactgaaaaggacatggcagccgtgccaatccacagcctgccccaccgcgacggggagaagcacatctcactcagcctccgacgcctgccacttcatgcgtgcaggcctggctcctcctcgtccaggacagtcagccctgctccccggtgcacacacacacgcacacacacactcacacaaatgcacgcacatccatgcatgcatacatgtatgcgtatgtccacacccacatacatggacacagatatatacatgccacacacgcacacacccatatacacgcacatgcgtgcattgcacacaggcacaagcttgcatgctcacacatgcacacagccaggagcaagctcctgaagccactgagtggtgccaccttgtgctttgtccttggggaccagctgaggagccactggccaacagggaccactcttagtgcccctttttcaggcacagaggagctgaggccaagaaagggaaggggcctggttcagagtcccccagtggccactggctgggaagctctgcaagcttgggtgcctggcagtgccttccccagccgccctcacccccctgccccagccttgtgactccccttggccccaccagtgactgtgtccacttcctcctgagcccacagcccttgacacctgtccttgccatagctgggcccagccacgctcttcagcaggcaatgtggccccctccacagggtctgagctgggcaccagcgttcagtagttaggaggttccatatctgtgtcccctgtccagcctggctggcaaagtggggactcagcctctctgtagtctccacctgcttccctccaccaggcaggtctccccctcacctcccaccctcctccatcatcagcttcccatcccagcccccagaggccagcaggctggggtgccctccccagccaggtggggatgggtgagggctggactccttcctccctgccccagctgcctgccccaccatgtctggccagcatccgcttacagagcaagagatgttcagctcagcttcctgggccacccagcctgctgtcaccctcctcatcccaggagaaatgggaccccgttccctgcctcgggccccaccagacacctggactccagcgcacccaccgggacccgcccctcagctcttgtgagcctcacatgcccaggccgagccaccgcccttcccctcgacagcccacagggcccgaggctccacagaacccccccagcgtcctctgtaaggatccagcagagacacaggcagctgccctgagcagcacggaggctggggcaggcgccaggttcatgctttcacgctcactttggaaactgttggttcagcagtctggccgactacctgctctgcgcaccggtgaccttaaaaccgtccatgcttataaatcacctgggatttacatacggactggtggcaggtaatctttcagaactcccccccactcacacgcagtcagtgtggttacgcaggatcaggatcctgggtggagtggaagagagaatgaactgacacggggctgggagcctgacaggcagcatcatcagggaagtttacggagtgggaggcagggctgcctgtgcgtccagctccagctcagctccagctcagctccagctcagccaggcacccaggctcaggttggaggggccgcagaggctgctcctcctgccccgctgatgtcctcacctctgctcagcccctgcgttgatgaccaccccgtggctgggaccccacccagcctgcagccctccaacaaagagcctccagggcctgcccagcgatggggagttcctccctctggggtttgctggttaagagcaagtcttgctccatggaaaagaagttctaacggcggaatccacaccaagagaaacggccacgaacagcctctgccccacacgtcgcgtgggccccagaaccacaacgaggaggatcaaaaaaaggagtcaaatacttcctggagacattttccaagaccactcccaccccatagcagaaggaggtatgccagcccgccatgtgtcccctccactttgatgctccttcagccatcacggactctcagagccctgcctgggtcagactgtgcgggcggcagtcaggactctgtgtgagcaggaatcaaggcccagggtgggccaggatcagagctgagtgagctagaatccgggtccagggtgggctgggatcagagctcagagtgagctagaatccaggtccagggtgggctgggatcagagctcaggatgggctagaatcagggtccagggtggactgggatcagagctcagagtgggctagaatccgggtccagggtgggctgagatcaagactcagggtgggctggaatcagggctccatgtgtctggaatcaggactcagtgtgagctaatgttaggcctctgtgtgaggtggatcagggctccatgtgggctaggatccgggctcagtttggggctgagtcaaaatgctctggcatggcctcacagaggtggctggacttgctcatggtcacacagcaggcgacaggtgctggtggagctcctgggtccatgcggctcaggccccattgctcttccccacctgcagaagaagccacccaccccccttgcagcccatgtctgggctctgagtccctcagagctctacggacacagctgtctggccaatgaaaggggtggccagggtcccctgggatctgcacagcacatggggtccaagcacatggaaggatgctgggcagacaccctgaggctcagacccacatgccccagcaaggacggcttggaaactacctcaccactccctggcagccagagggagagggtctccctgatgagcccaggctgctccctgagggagggagggagggagggagggagggagggagggaaggaggaagggagggagggagagcaaaggccgcctctgggcatgttgtcccagccaggagcaggtggctgcacagagcaagggcctgtagggtgagccttggggctgccttccaaggaaagagtcatcacagacccctcctcctgtgctgcgggggaactgaggcccctggtccctcagcccagcgcaggctgccatcactatccccgaactcgagagcaggggcagaggaccctcagccatcttcctgtcccatagaagaactcccagtgggaaaccccacccccagcagaggaaacagccctcaggacaccaacacccccacggctgccagatgctctggggaggccgcaccaactcacacggcctaacagccctgccgagggatcccaggtgtttggggacggactgcacacccaccctgatccagggctgtgactgtgaagaggagctccggcccttccccagaacacagcctgcctcctggcacaacaaagaaagccgggtgtgggcatggcccactgcacaaccccacccccaaagccagggctgagccggccagcccacaagccctcaaggggcacaggcgtgtgctgcctccctgagcaccgagcaccagggccaatggccaggcccccgaggctaggagcccctccccagaactgtctgcagccctcttgcctgtggggacccctgacccatgtgaggctgtgtgtgggggaggagggggccctggtgcccccagagtggagtcagcccatgcatgaggatgccactggggagccacgtggccccactgggctgggattcccccgggtgtcccgaggccaccgcacactgcagggcccatgagtttgcagtttgtcccagtaaaaaagctgccctgagcccagacacccacgtgggtccttcctgcccgagattccggccttgttgctcctgcccttaggaaatgcgttgctgtctctgggttcctctgggtagcgaggcttctgggcctgagggaagtgtgggacagccctacagcacaggcccccagtcccgccaatccccacccccggggtcaggccctgcctcctgcatccctcttcactggccagtcctccattgccacctggtggccattgccccacgacagccgggaccgccaacctgcccgacccgagctcctccaggcaccggtgcctcctgggtggacactgggcagctgtcctgggcctgaactcgccagactttggcagaaggcagggttcaggggtccccagcccccatcctagatggggaggcgccccggtccgggcattgctggaacagcgcccttgatcttgaaaaggagcttcagtcatcaaaggggctccatccctggagggcaaatggcaataaaaagacacaaacaggcggcgttagagtggcccgggggaggcgcttcctgattgcgaatccaattctcattcctgaaggtctttaaaacccttcctgagccatgtgattgtctcaaaagagctgttattactcttataaaaaaaaacttataaaaaaattctaatcaacattggtcttaaaccgcaacgtctcagcacccagcactgcctccgcagcttcgtggggctggcgggagggacatttacgagccatttcacgccccgcggctgcccatcaaccatggggcttttgtcacccaccatagcgatagcaatggttttgtaactcaaaagttatttattaatatcggtatcttccacgtgagtgtctctggcagccagggtggcgctgaaaggttgggggtcctgtcgtgggcatacatggtggtccccagcccgccagacccgagaagcctccaagacgtcactgctttccgctgtctcaacaatgcatggcgcctgtctcaccagcaccgtgggaagccaggctgacctgccggcaggatggggcatctgaggtcccaggcagctgctttcaaggccaccatccagccctgcacagggcagcaatgcctttggccagggccacatccaggcatgcacagagctggagcacaccggccccgggcccgcagcaccaccaccctgtggaccttatcaggtcagcctctcaggggcgagtctccccacctggtgctccaggattagcaccgtctcaaagtcaggttggagtcactctcggccacgcaccatgagtgacccgagcacccctcatcttcagagcccagagggagcagtccacgggctcggggagagcctttgcggacagagcacccagtgccccacagctccttagtcatcatctgggggagtcaactcctcacgagctgggggcctccagcgggaggctgccgagccagctctgggccccagggcttccaaggagcctgtccccaggaggagcgtgtgagctgcgggaagcaggcagttttgtcaccatgagtgtgcaagctgtggggggcctggcccctccgtgctcctccccggacccatctccaaggcagcttgcctttccccattccctccagttgcaggttctggccagtgtccccatggaggtcacactggctgttggctcctgaaccacctccagctttggcctaagggcaagagcccagccccgaggacaaggacaagcgccagggccctggagacagaaccagcagggcagtcagtgctcagcccctcggggccctcaggcctccactgcagcagcggctgcaccctctccttccccagagaggggccaagatgcgatttgctgtcccccccaccgcactgagaaagggggggcccaggcaggcacccccaccccacccagacacatgtcccagcccacgtgggttccctggctggctggctcacaacttcagagcacccccaccctctgctctaggcacctccgaccacccacaggggtctgtgcgaaagtaacggtggggctccagccagctcctgcccagggtcctgtccctgccaccgcctgacctttctgttcagcctccacccggcccaccctcaggctggagggcaccatgaaggggaagacagatggcagatgctcaccccatgggcagagccatctcagcctgagggcagcatccttgctgggcagagctccctctcacagccaccccagcctcctgtcctccgcacacatttgactccctgatggggctctgccctggcacactcaggctcccaggcagcagagctgggcaggatggatgagaccagaagacaatgtgaagtccctgctcaacccggggctgccggggaccgcagggttagtgcatactcaatggaggcaagcctgaggctctctgggaaggagagaaggggatgcacttaacacaggctctttctaggggtgattcccgagcttcccagagtgccccctggatgtcagttacacgcccgagtgggctggaaggacggccttgccggggtccagggctcctggccacgcggccttttcagtttgctgtctcggctctgcagaggccacagcttatctgtgacagacagacccacctccctgccttggagactgctccccagggctttcttgcacccccatgccatttgactgaccctgtcaggagggtctctgactcaccaccggtgtacaaggtgtgagcgagcaggtgctcagacagtcacaggtacgggctctgcaggtgagcactgaccaggtggctcggggctctggagactctgaatggagagaaccccaacttctctccctttgaattgtgtgaacgtgagctgaactcgctgaccacagcagagagaaaatttgtcaaaaatgcccacctgtgagacccaggtcttgcctcgggctttggagaggccggtttgtggtttaaggacaagccgggggcagggttccccaggagtgaccagtcactggaggctcgggcggcgcaaaagtcagaaagggcagaggacaatctgggggtgactcctggcccgcctgactcgtgagggccttggtttctcctgtgcttgttgaggtctgtgtgggggatggtagggaagcccctcggaagcggaggacccggggctggcagaagtaatgacagagggaatagattgcacctcaccagcctgcccgcacccggcttccttgcctccacccacactgcaagatggggcccacgggaaggcatttgcgcatacaacccctcagcaccgcaaacactgccaccccggtcctgggagccagggctgccctggcctgggggtacagatgggcaggggcacacctgagacccatcaagcaagacttgccaaagaaggaggctcaggagcgaggtggggcaaaagctggcacaggaggcccaggcccgcaagcacctaaggaggcccctggggtaggaagggccggaggtgggagtgcgtatggcacccagcctaggacgggaggagccacagccggctgtgcagcagggaggggccctccggggcctgaggtgggaaccaggagaggccagcacttctagacagcagctcagtcgctcgctccacctctcagagttccgtttccaatattctccccccattgtctggaatccaaatattcccacttttaaaagcagcttccagatagtggtgtgcaggaggccgagcaacaccgtctttgaggaggcagccgagatgaagataagaccagagaaatccatcacgccggcttttagagccacgcaccctctctggaccctgccgggattaaaatgcacagtcctctgttgtgggggcccatgaggccggcgctcctcagccacagaaatggaactgtaactcagcccagaagcagggagatcgcctcccagataaacacccagcagctctagagtgctggcggccctgggcatcctccccactcccagccccagggcagcctggggagcaggggttctggaggaccccggccccctacacgggccccccactccctaacgcttgcttgggtccagtgggggcgggaggctagacaatgaactgaggtgccccctgaggggcacctgctgcagctcggggaccccagggacagggccaaatggccatgacatgtctcaaaggcctttgccaagcctggcatcctcgtccataaaaggacagggcacgcagccgggcacggtggctcacagctgtaatcccagcactttaggaggtcaagacgggcggatcacctgaggttgggagttcaagaccagcctggccaacatggagaaaccccatctctactaaaaaatacaaaattagccgggcgtggtggcgcatgcctgtaatcccagctactcgggaggctgaggcaggagaattgcttgaacccgggaggcggaggttgcactgagccgagatcgtgccattgcactccagcctgggcaacaagagcaaaactccgtctcaaaaaaaaaaaaaaaaaaaaaaagatggagtttgccaggggcagggctgttccaccttcaccacaccaaggtgaggacagaacccaggctgcggccagggcaggaagaactgaggtcgtttgggccttgtctggccaccctaaggagtcagcccctctgcccaggagctcagcgatgctgcctgtggccacagggtcgcctgctctaccttcagcctcagtttctcccttgtaaaggggacatacagctccttgggagccatgagcttgggccactacttgtgaagcgcagagggagctggagcacagaggcctcagtcaggcacgtgctgctgccgtggtccacgtgggaggtcacgtgcatccccgcagtggtgctgggtgggccctgcaccttcagggcctccctggtgcaccccggggtctgtgaggccagctcgctgcctttccagctcatccaccccatttctctgctccagcccttccccagggctcctgcactcagcccctccaaccccagcttggcgagctgccccttctgtcctgctcccactgccacccccagcaccagcccctcccagcgcccctgagccctatgggactcctgccctgcccctagccacacctcagccgcaggccctgcctggacatcactcacggttggttctggggccacggcgcactggacacagggttcaagtgtgctacatgaatagtgacaggatctgtgcagcaaaggggggtccctgcgtccccagaaagcccctcctgccctcagcctccccaataccttcagcaggaaggtgtgtgcagggtctctggaggctgccaccctcccatccacagcagcggtcctgcctcggggcggccagagccagcacggggaagctgacgcgtcacagggcggcttccaaacaggatcatagcgagaacgccgcataaaagctctaaataaaccccaaaaaggaaaatgggactgttttaccactgaatcaattcacctctaattttaatgctctgaaaagtattttctcttaatgactccattattttatcatatggtgagcaataaactccctccccacatttgccagacagcctcagcctctccggtgtctgccaggcagggaatcctttataggcggctctgcacacacacagcacttggctttcgtttagtggtgattttatagaagattcccccatttcgtgtaatataaagcctagaacttaattagcctccgtcagctcctcgggctgctatggagtgggtgtgttcatgcacccgcagaccacacaccatgacaaagtcgccgaccgtctcaaggcagcatccctgtggctggcatgggcagcatgccccaaacatgaagcactcaggaccccagagggctcctggcctcccacctggcaagtgggtgcaggttattaatccccagctccctgatggctctcccaccgggacacacacatccctcacaagcaaacgtgattcccagcagggagctggcggtctcgggaatgacctccatgtgggctcctggggaagcccaggcgactgtgcaaaccctgctggcgagggtgccgccctccacggttttccaggccccagggtgggcacatgtgccggctcacggtgggtctgctccaactccagtgggaagaagagatgccgaggatgcagcagcaccatacgtgggaatggggacagctgcggggggctgggagcacaagtgagggacagagccagggcaggtgaggccagacgacggacatggtgagcagggtcggacacagttcctcctacaagagcctgcttgtgccctttgatctccaacatctctcctgggtgctccacatcgaggcgcccccacggcacatctgacccctcctccagtaaacctaaattagttccttattgtgcaacctggacaactgtacatggccaacattcaggggtcccaacaaactgccttgtaaattggaggccagagcctggcttccctgtgtggtgccaggcaaggcactgcagcttacacatgacacacacacggcacacatgcagcacacacgcagcacacacgcagcacacacatgcccctgctgctcccgcctgacgccggccacttactcacacgccttctcccccagacagaagagcaaaggaggtgggagggtaagggggagacttgagtaacctcacagtaccctagatgctaggagaacaggtacccgtgggccaggcgcgtgtgcacacctgcctgggcatgacacagctatggggtgtgtacgcagggctcacatgtggggcccagaaacctccctgcgtactcagatacctcgttcaatatctgtagcatgaggggcactcctgcaggggtctggagcaattcttggcctaagtggctatttgcagactcccctctccccacaggcccggaggagtcgcagagtggctttgtaacagtgcgttctccctgcgtttaccccagtgggttctacaggctgggccttgtcaaagtgacgggcaggcgctgggcactggtgacaaaggcagtggcagcacttggccacactcagcctctgggggccccggacgtgcatacatcgcggtcctccccttatgagcgaggagacaccatggctgcttgcacctcgcgtgccggggaactgggagagtggggctcacgtgtgcatctgcccacctctgctgaagcctggggccacacaaagcctcttggggtcagagcttgctggggccccgtgggggacgtgagacagagagagaaggtgtgtgtgtgcacacgtgtgagactcggtgtgcctggttgtgcacgtgactgcgtgcatatgaaacacagacaggcgtcggtccagcggaatttctgtggcacacttgagctgcgtgtagccccctgcttctgactgtacaaagacctcacgctctcatccgagaccggaaagctgtggacggggttggtggctcctctcggagctaagctccacctcccactcctcagtctgaccctggcctccctccccagccctccccagccctccctctctcggtttttttttttttttccttatccccacactcctctcctgcagccctggcttcaggcccctccccagcagaggctgcagcagccccggtgcagtggtgggatgggcctggccggactttccagtgcccactgtcctatgccccctgcctggcaccccagcctggcccctcgtgcccacccagtgctgggtagagaggccccgtcgtgagcccatcactgctgccgccagaggctactcaggcccagctcctcagagggtttttctcgggccctcttttagtgaccttctctgaacttcttgtggctggcttcatcgtgggattgcagaaagacccgagagccccagggaaggtggcattaaatcgcaagcaatggcacttctggcacatccaatcgattttgtcgttcgtaagaaatggaaacaggatgtggcaaggaaaaggcagtttcaggaacaaggcttctcccctcgggctctggaaagggcagggaaaggctctgttggcccatgcagcggcccctggagtccaggcccaagatcccaacccccggccacaggacacggtcagcaggtccctgcctggctgccccacctctgggagccctcctgccaccccggctggcctcctgcgggctctgagcaaggtcaggccctgggaacgagggaggggccgctcctgagtccccgaagccctgggctgagtgggccccaccaagcctccttggccctgcccagcttcctccactcagagctgctggtgcatgtgccccagaacggggcaagggggaggcaggcactgccccgcagaggagtctcacccatcccttccctctgtgtcccaagacagggccttggctgctgcccagggtgtcttgcagcagcccctcccccagccagcctgtccctcaatgctctccagcaggcacaggaccagagagccacaagctgtgtgcccaccctgcacacccacccacagccctccccccatacctcctggtcctcgagcctatgcttcccacaggctcctacctggtcatccaggccagctgccatggcccaggagcctgcatccatccttccctcagccacagtgacacccaaggcggtgctcacagctcatccctgccctcagggccacccgaggggtcaccagtgccacagccagtcatgttatgttgcactgacttccccagccaaatgcctggggaccggggctagagtttttcctccattgtccattaatcatggctaccattgttgcatgggttcctggaggtctggaccacctgccatgtgacgtactaagcatgacgtcacgaatgtagctgatcagcatcattttccgcagaccaggagtgtcccagagcactggattgcaagagtagcaagaaagtgccagtggctggagcactgctgtctctcacaggcagctgggtgggcccctctctactgaggtggttgagaaggacacacttgctagacacaccgcacacacccagggccagaggatgtggtgactcggttcagtcgaggtatcgcatccggcggcgcattttccatgtgggctgactctgcgttgggttgggttcatccatcaccatcggccatgatgctgctggtttttgtggaccatatgggtgaacagagtgggaacagtggggacagtgggactgaccatccctgtatcttttgagtctttggggatggtcctaatttctgcagatgctcaggatgtgtggaatgactctcttggccagggtcttagaagcttccacttgttcgtttgggtttttttcctgccaaaatggctcataatcattaggtcaaggaaccaatgggcaggctctgccaactgcagagtacaggcagccccttcccttaggcacgagaggctgagggtcccagggtcactgcagggcgggcttgcctccaggtctccgggagcccttactctacccacagcggggttctgggtcccctgatatcactgccagctcagagcccgtacccacagctctcaaaagatcaggagagtctcctgcccagcacatagtttctgtgggccctggacactgacttctgccctttcaggccagctgctcctgacacggtggaaagatcaggagaagctgccctccccagtgggccggagggctccaggcggcaacagggagggcagcaccagtgacgggcacacctgggctgagggaactttgggcacccaggctctgggccactcagccactgccaggtgggcacccgcgtgaaccagaactgtgtgcctgcccggccagcccaaccttgccgctttcacaaggaggcacacagtagcccctcagaacctgccacggccctgcaaggagaggattcccctggggcaggaggtagtagctctcggccaggcactgactgcccaaggtggcaggcccaggacagggtgtgggtggggccctccctcccccggttctggtgccaagctcttcccagtgtcctgtgcctgtgccccatgtcccagcagctgtgtgcaggggagtcatgaccaagggcggcacccagtcccctggatctgagcccactccgtaagctgccgcctcacagcccggcaaggagcttccccctacagagcccctgtccttatctgccaatgaggccaggcctggggctcaggaggcggtggggagggaagaggagctaagccctgtgaggagctaagccgttgcacacaagtatgcattctgcccatctagcgcttggagagcatggttaatggaaagacccaactccgtagaacacggagctttcttctgagccaatatgagtgaccgcggcccaggaaaaagtgcacacacccagggagccctgagtggggggtcctgaggcagccagacaccagctctgcttcccacccaccttagtgtgacggaattgcaggcagtcatagttcaaggagcttctacatcggttcagcccagaaaggcagggtgtcttgaagcagggggctgacaggtcgtcagcggggccagagattatttcatttgcaattagttaaagaagtaaagctttgtctataaatgtgcagtcatcagaaaggaatgttttcggtgaagattaagaagtcttttaaccgatacaccaggtcacagtggcgtgtggggtgcatgacttgaccctgggctggcggccttcggtcctgtttataattcgagtcttagggtcacagtcctctgatcactaggttaacgtcactactggtcagccctgcctgaactcccgcagggaagggggagagcgaggcacgtctgccctcctgtcccatcatgactgggaactcagttgttccggtttctctggagtccctttggccaagaggagcctgttcagtcggttggggccttagggttttatttttattttacagcacgtagcacttttgcacacggacagcgtggccctcacagttcggcgcacatgtccacagatgtgtggcttgcctgcgccacagagaatgcacgcttctggtgtgagaatgaggctgtgtgtgacgtgtgaatgctcggccccggccggccgcagccaggtccctgcggtgggtcctcaggcccggagaccagggatggcgcccacagtgggaacctgggctgaccggctgcccccggggcccacgcctgcagtcgccccactgaagcccagacagacccccacacggcctcgcctcagagcccagaaccttcagcaggtcaggcggggtggtggaaggatctcccggcccctccagccagcccctaagatgctgctggaaaaacagctgtggcaggcagctcggggggccccggctcggttatggcttatgtacagccccgacagccaactggctttcagggagggaccaacttcatagataaaatttgtcatcgtatcgatggctcctgtagagaaaaaaggacttttacagcctcttggaggtcatgaataatagaggaggaggaaaggggccgctttggttagtgttccgcggggcccagaggcccccattatctcagctgatgggagctgggggggccccagcagcctatggttctcactcgtggaaaccagtgtggtcatcacccagggcccccaccacactcagggctgggggcagtgcccatgcgtcctgtattcttaataagggctctgacttggcgacggggtgaccatacatggccctgtcaaagggccctgcctcagtctgagaatgacaagctgcaggctccatggtaggggcctggacctcccactccgggccgtgacctggggcaggactctagctgtatctgcaagccggaagagcagcatctctccaggcagccgtatgtcaggggccagtgagcagacacaggggccagagcgtcacaggtcacccccatatgcccagagtctgctcccccgtcctcccacctccctccccacccgtggtctatggggccctgaagagtccccaaaggcaaaaatcctcctttgcttgcctccagtgatggggaactcactaccttactgtcggctgttcctcccatggacagctctgcctggtgggaagtccccccaccagcccctgtgcagagcagcctgtgcctgtggagccccagcccaggttccggctctcacccagagcatgcgtcagcccctctaaccccaaacccacactcctccctcatttccctcatttcctctcctcttctcctggaccccaccctcaggcttcactcccaccaacccccagggtgcctgggccaagcccacctgtgaccaccacgtggcaagtcctgtgaggacttcactccttgtccctcctgacctagcactggctctgagtgtgccagtggcaaagacctgctcatgcggcctccaccggccctggactcacccaccaccgccacccctgcctgccctctcccgtagtcctctccagggccttctcaccgtggtcatggtttatggggcctctcatgaccccatcagccaccgtccccacccagctggagaccctcaaccaagccctctcagggggtttcctgtggtcatgaagcagctgacgacccactgcagagacgagagctacaaagatgcattcccactgtagcagagggagctgggatcaggacagcctcagctgcattttcactgccccagagggagctgggctcaggacggccttagctgggcgttcccacgacagcagagggagctgggctcaagacagcctcagctgggcgttccccctacggcagagggagctgggatcaggacagcctcagcccggcgttcctcctgctacagagggagctgggctcaggacagcctcagctgggtgttcccactacagcagagagagctgggctcaggacagcctcagctgggtgttttcactgccacagagggagctgggctcaggacagcctcagctgggcattcccactgcagcagagagagctgggctcaggacagcctcagctgggcgttttcactaccacagagggagctgggctcaggacagcctcagctgacaggggtgcagccctgagccccggagacgcctggagaacctttggacccatttccaccacaagccctggtgctgcagtcggccagcctgcacgaatttccccccgggctgtatgccagacaggggaagggccagcctccaggcctctgcgcaagagggccacggccaactcccaccccctgggccaacgctggcctctcttgtgcctggggtccttctgcttcaaccagctgtggaccccacccccatctcccccacccaccggccctttcttctctggcccaggtcagcctagggcctccacaccctccagccccacccccgaccctgcctggagccatgtatgaggccatgctgaggcccagggctctccgcactccagccagaccatggtccagggagagctgggagtctaggccagcaccacgtggccatgaccagagtagccacaatctccagcccctgcagcctccactcccacgtgccgccctactccaccccggccaccttccaggaccaccccaaggaaacagcccagcccagccagctcgctggactttcccagcgctcaggagtgcccagccactggacatgctccgccctcccgctgaatgacagctggccttagttgctgtgttcccggggcactgctcagggtgggtgcaccacaaagatctggggagggtggggcatccgatcattcccagctcccggggagagatgagggtgtggcggaggtcacctggctgaacagtgacagagctgggcccaaacctgggcaccacgtcattggcaccactgcccgtgggcacatgtgcccacctgccggctgcaggcaggcctgacacaactgggctcttccctggcactgcctggcacaggcactggggaccctccgcggacccggcagctcagcactcccctgggccagccttatcttgccctgcagagcccaggctggagtgaggcgcaatggacggaggcgaggagggtgcagccgagccctatcagatacggccggaaatatgaccccgctgggacctgagccctgagccgagccatcagctcactaataaattacccagagcgaatgtccacagggtcagcccgcatcgcctttccagggagcacagagagggggcggcacccaaggtctgtgggctgaccgttccctcccctctgtcaatgagaagggtcaggaaggagttgtcccggagccccccgacctcgggcagtgcagcctgacctctgaaatctgggaggagcagctccagccctgggaagccaaggataagcgcccagattgggcacaggcgggagagggtcttgtctggctacaggacctcactcttcccaggaagccagactgccagcaggaccacccagccttcctcagtgctctccctggaacaagcgtcagcgagccaaggccctcctgccaatctggcccaccccgtttgtgtagacacagagcgcactgtgtgccatatggccctgtaagagaaaagtttgctcccccatgccctgtactgaagacggcagtgaggggagggccggtctgctgaaccccatcccagtggctgcgttgctcatgctctgacggtgggttccaggactctgtgtccatgcagccccacggctggccctgagcagtcaccctctgtgcacactgtcccccagcctggcacaccctgggctcccaggggtcctgtagctttacccaagggagatgcacccccattcctaatggagaaacacgggtctctccacacctcctccagcagtcccctgaaacaggtcaaagccccacaaaccaggcaggggtctgcccacatgtggtggtgccctgcgccagtgatgccctcaccagcctctttcagacctgcctttacatgcaccagcagacgggggggctggcgaggacgggccaccaagcctgagccaggctaccacctccgggctgtgtgactctggacagggtgcctcaactctctgagctgcactttcacctacaaatgaggggcagactcagcagcgccaggcagggcagttggacgcccacccaggacagaccctgagaaaggctgatccctcacccctgccatcgctcactgacccatacattgccccttcctgccagggcaatatcgagggtcggccagtgtgccccaaaacggcagcttgggacccattctttgcctctccctctggcaaccccaggtcaggactcacaggggcacaggggcctggggcagggcgggcactctcgccaccacggaggccccatgctgggtcagggtcttattggaggctggactctgtgatcacctcacctcccgcagccccacagtgccctccctctcccactctgccccgaattccaatccataggtttttccaagagctgcacagctctggaattgacctgggagggggcacatttgggccgggaggggtaggaacagcagcaaactctggtcttatctgaaatcatggtctgttgtccaccgggggcctgggaaacagccacccccttctgctccggggccagcggcctgtcctcgggttcactgctatttctgccaaaggggagaggtaattatagcctggccgctgccagctggcccagctttgcgatccagcagagagggctggagacgggacgaaggccacaacagacccggccctgccagcgggcggtggcgcctccagatcagagccctcgggaaggaggcctgggcgggcctggcccgttcacctgtgtgccctgcagttctgcccgaggctcaactctcaagggcctgggaggggtgctgccggccaagagggtccaggacctcactggactgtgccccacagggagatcccgaagagcctgtttctgtccctcggggagccaggagggaaccaggtgagttccagccccagggagagggggctcacttcctgcttgggtatgaagatgccagagcggagagattgccaaaggcaggtgcaggtggggaacctgccccagctgggcagcaggtgtgggcagagactgggcagagcggagagattgccaaaggcaggtgcaggtggggaacctgccccagctgggcagcaggtgtgggcagagactgggcagagcacacactgatgatcctgagtgacctgaacaagctccagagtggccacccttcccccttctcctgggactgatggtttccctaaaacggagacagtcccaggccggccctgtgtccacactgaggccaggccgcctctgggggaagcagggaacacggccacttcaaacttagcagcgggggtgctcctggccacacaggagcttccaaagggcacctgatgttgcgcgaaacagcctgggcagtgggagaaggggctgcactctcaggggaatgcaggcagccgtgccaggcatgaacccagccagccttccctgaagggccttggtggggggcatcctccgagggcaagtctacgcaggcccagcctagcaggaatggattcgttactccagtaactgaagcctagttctcagtgtttgggaatccctgagaactggctcttttctgagccgtcagtcagaaggaatccctgtcctgccctgtgtggccatgggacccccacccagcactggacgccacgccatttcttgggcactactgagctttgcagtgccctggacagttggcaaacagcccccattccacatatgggaggaagggcctgggggggtcccccgccctgtctgtctggagctctcgaggcctagggtggcccctgcacccagcagatgagcagccatcacccggtactgctgctacctcgagccctaactgcacctcgggatgtgagggcccatctaggcatggagaggggcctcagggggccaccaggcagctcctgctcctgttcctacctggtagggcctgcaggcacctgagcaagcccagtgggcggtcagcccagccaggggcctccccacaagttctccctcttacttaagtcgagaacgcatgttgtctggggagctgccagcgtggttccagtggtgagcgttgggctgggagccaaggcttttcccaggagcccagccaccccgcctggctgtgttctgcctccgccctgcagaggaaaggccagcgaggcagtgtccatggtcccagtcttcttccaccggaagaaggcacaacctgcatctgcagccccagggccattgggttaggcctgtggccaaactactaaggtgctgggagactgaggaggcccagctcctcctggggccaccaagcccgtggttgacggcctccccatggaccgggctgtcccgagagcagcaagtcagccggggccctcagggccgctgaggccactgctcagtgtcgccgtaatggaaacttctcagctggttgtgagccgcaacagctctggttcacaccctgcgacagcgaggctgtgaccgccagtggatctcggggctgatcaggcctgagccaccccggaggtacagcaccagcaggagcccaggtgggcaggggcagagagagagagagagagagagagagagtatgtatgtgtgtgtgtgtaagtggtgggggtgggggctgtgagtctccagcttctcccagggaggtctctggcttcccaggagcctggccccctgtctccagctcccaagtgagttgccctgggggaggctgcacctggaacagggaaacagggagcctggccccagcctgcactcgctcaggccccgggaccctctgcccctggaaggctgtgaggctgccgtgtgaatgggtgcagtgccaggcgaggggtgagccgggagtgtggggccgcacgctcagagccgaggaagggcagtgccaggcgaggggtgagccgggagtgtggggccgcacgctcagagccgaggaaggacctcccatgtggggtgggtgggatgtcaggatttctcacgagccagctgctgcatggggggcactgcccgccccgaggaaccctcagggaggacagagaaacatcaggaggtgggctgtgggcaaaagggcgggcggcacgggccaggcagaggcagcagcctgggaggaggcgggaagccagcgggcggcgtcctggaggacggggcaggagtgggagggagcagcagtggctgggccccagagcttggcgttatccaagccacagaaccaggcaagaaccactggcccgcccccacgccccactgcaggctggtctcgagggggagggactcggcactgccacggccgctgggctccatcagtgccctcacgtctctcagcagcttcaagatgaggtggggtctttggggtactgggctagacccccaaagactgttggagggtcacaccccagaccaaggtcctgggcctcagccctcatggccccacctcccaccagcagtacgggctggtcatgcccacaactgggagctccgggccctgactcccgcctctgtcccaacccaggctctgaaacctggcaggctgttctccctctctgggcctcagtttcccctccgccagggagctcggtgccccctctcagtagaggagctggtaagaaccccccagccccccagcaccaagggaggcgccatggggttcctgttcccagagtgggggtagagtcccctcgggtggacgcgccctccccagcagcgggcctagcgggacacttacaggtccaggctctgaagctattttccgccctttatctcccatctgtcacgaggcctccagttacacactgtccctgccagaggccccaggcctccccgcccccacctgccgagcatgccagagccactccttccctgcttccactggggaaaatgaggcccagggaggtcacaccacttacccgaggtcacagagccaaagaaggacagagcccaggacttgagccagacctctcttccagaaggggaagcgtgaagcccagttagggaggggatggcagggctcagggaggctgtctgggagcagagcatggcccacgtgaaggtgcatctctggagaggggaccgcggagctcagggaggctgcctgggagcagagcgtggcccacgtgaaggtgcatctctggagaggggacctcagggctcagggaggctgcctgggagcagagcgtggcccaggggaaggtgcatctctggagagggccccagggctcccggaggggaggtgtcatcccataggatgtcctgactgtccagacacagccagagccacctgagctctgttcctgggcacattccctccccgagtgatgccaacagtggctgatggcacagagcacaggcttggtgcggactcgggtctgtgcactgactcccaccctcacgcgagcccgcagaggctgctgctctcctcacccccatttcacagctgagcagaccaacgcccaggcagattaggagacttgcctaaggtcacacgtggtcacacaaggtgctctggagcccacacctgaagagggggaggtgctgtcccgtaggaagtcctgactgtccacattccggcagaactctgtgccccagaaggcgaagtcgcgtcctccccaagttatgctgctcagcaacagatggttaatgccacagccaggcaccctcacaaacacactgcctacgcctgcacattcacatacactctacacaaacacacacacattcacccacacatacgcagatacactcacacacacacacgggcacatgcatggacacacacacacatgcatattcacatgcacgcacagaaatacaagtacacatatgcacacatagccacacctccatgcacacattcacacacacagacaccccacacgtgcacactcatgccctctgacacacgtgcccactctcacacttgcacactcaggggaatactcacacatgtgtgcactcacacacgtgcacacacacactgttttcccaccatcccttggacagaccccaggccaaggaggggtgaatagcgagagctgctggcaggagctgggggagactgcgtccagccctgcatccctgcgtgactccgtcggcccaagcctctccaggcctgtttccccatgaggagtgaacctggctgggccccctggaatgctgctgcagggtcgcctggcaaggggctgtggccctgggcacgccagccagccccaggccgtgcagccccaggaaatgaccccgaatgcacaagcctccttccgccgggcagtgggagagcccgggctctgggtccaagaggtcactggggggctctgctccacccccaaccccaccctgggctttagcagagtttctatcccacccagggtggaaactgagtcaatggcatccagagagcccttccagccccagccctgctacggacaggcagtcaaggttgccctgccaggcagcatccccaaaacaccaggacaggcctggcactctgtggcttccctaaccctggggatcacgcagagcccacattccaggtgacctggccccaggagacggggccccagctcagctgggcctgcaagcacaacctctcccacagccactctctgagagcaggtcctgaagataagccgcccctccccgccacccccctggatggccggctcctgccacaaccctatttgcaataaaaacctgatccggcgatagcagaaaattgctctcttttgaaataattgaacccgtccagacagtgtcctcccagacatcattaacagggcactctgcttgtctgcagtatttatgcccacttggggaggtggtcatggccaccctgttatctcctgtagaggacggcacacggctgctggagtcactgcagtatccacccaaaccactcctcccacaggcctgccctgaacctctgaggcacccatccctttgggggaccctggaggagttatccttgaggaccatgtaggcccctcactctcaccctcccccttctcagcccttgggggcagggtccttggaggaccacggggagccagggaagcatctcaggaaatgcaaacacctgccctgtgaggggcaggggcggcagtaccctccaaggaccccagggcaggggagaacctgaagggcagcaggaggtccccacactgccccctatccagctgggagcagggcagggaggacctggcctggcatcagctcccagggaagccccagccccctctggcctcagtttcccgacctgaagcaagagaggcaggctcatcacccccagagcccttgaaaggcagacacctgcacctgcacagatgcctggtaggcactgcacccctctgtagggaggagtgcccaaaagtcaagaaccctgccaaggctgtgagagaaaattcacacttggggggctccaccggtgagcacgaatgaggagagcacagcctctgccgccaaagacacgggggtggaggcgaggaggcgccattcacagccaggaagcaaccagcgcaacagaggaggggacagagagacagagatagaggtagagagatagagagagaatcagagagaggaagggggacagagacagaaacagggagatagagacagaattagagagaggcagggagacagagatggagacagagagagagacatagaaagatagagacagaatcagagagaggcagggggacagagagatggagacagagagatagagacacagaatcggcgggggcgcggtgcagagagagacacagagagagagtgtgagccgtgctgaggggtgggcccccaggagcccaggggcgccccaccagcaccagcccaaaaaggtgggcatgaccctctgggaagcctttctgtggacccggtctcagagccctgacaattcccagtccccagccccagggcttcccgctaccgaaaggagacaaagcaaagatgtttcttgcagccttatccatgacctccaaacattgcaaatgacaatactaaaatgcaaccctcatgaatacccaatcatcgagggtgactttcagtgacgggacctcggcccagtggaatattatgcagccattaaagatgataattatgaagaccgtggcagcaaaggaaattgcttgcgatggcatttctgaacgagcagggaacaggatttacctgcactggggacaccacagaggaaaagtggtgtctgctcaacagcgtggccggtcgcaagcccgggaagccagcctggcttccaggaaagaattttctcctcctcttattttcattcctctgagtgccacttgtgcagtaaataataaataacgtctctgcttatcttaggaccatgttccagtaaatgaggactgcagcaggagccgtgagccctgactcccggccagagacacgacgtcagaccagaaagaatgaggaggccgcgtggggcccgcgggtgtgcagggcagagagggtaaggcgggccgctgggacacagcttctgcaagctggccttccactgggggctggagggggcagggagcaacagacgtggaaaggccatcctccaccccaggaatcagggggtgataggaggagggcagggggatcactgagggctggggggagcagcggggggcaatgggtgccttgaaggatttggtctggcagaggagattggaggcccccaggtggggcacagcttggcagaggaagtgggagccatggagggctgtggaagaggcagctcagggaggagggtgttggaggagggaagagggtggagagaggacaggtcaagactgtcaccaagggtcagtgttagggttaggggcccagacctcagaccctgaggctccatccagcctctgaggcactgccaggctggggcatgccacaggcacagcaggagctgggccagactcagcatgggcaggcctcacgccctcgcggggcagcctcgccagatgccgagcagcaggctgtgtacagcgagcaatgccccagccaggaacaacctcagagctggcccggctcccagggtgcctcagccccagttgtcaccatgtcacagacaaggatgctgaggttcacagcagcccgaaactcccactccatcttccagactcaggctgggcccatacacgtgagcagaccagcagagaaagggcccaggtaggcaaatgtgtaggagctgcccccgcctgcagcctgggaggctcggccccagggaaaaggaggccgaggccaccaaccagccctcctcacggccctggcccggcccctgccccatagagcttgcaaactctggccccttagccagagcccctctgccattgcagccccctccccctgtccacatgtcctggggaccctgtccagcagcctgcatccgagacagcgggcagacgaagagaggttcagtggggacttgcgtgaagagacggggtcaggaggggctcctgtcttgcctgggcccctgaggctgagtctggctgccctgcagtccctgtccaggagctgcccctcaccctacaggaagtgacaggcccagcatagcgcaccagccaggacagggtacaggttccaggacggtgctgctgggccccacatggctcagacctgggtaccagcggcctcccgccggggactcaccagtctgcttcccgcccccacaccaggaggacaacaggaagtgccccccctccatcctgaaacggagccggccggagcaccaccgcccagaggccaagccccagaggacctcgaggcgcgtgtggttccgagaacccccagcggtgaccgtccactgtaagagggcacccgcagcaagcagctgggagagggtggagtcaagcagagggaggcggggacaccggccacacccacacagctctggcagggcccaggacatgggggggccgtggccacctgccttcagtgccacaacccctgtaagacctgggcccctggggtcatctggacacacagtcccggtccatgaaacagcaactggaggagaacatgagggcggattctcaaatcatgactgtccctttgaggaagtgtcaggaccggctgggcctgggtctctcactgatgaatagtctcagggtccttcgggggtgcagggtgagacgagagggcgggggcgcccgatggactgaggcaggtgcccccagctgactctccattctctttcgcagacattgctgacaagaacgccacagccactgtcaggggtgagttctgagcccacatccctgtgccccactgccccctccgtgggtgcacccaccctcactccctccccgagggaggtgtcacagggccagggcctctaaggagtccccagttggggagctcttgttgcaaggagaccccaagaggctagggaggggccatgggcatggacagggtggaatctccccatcccttccccaccagccccagtcctccagggaagggtcgcgctggctggcgctgaccctgcctgccctctggccgcagtgcccggccggcccaggccacacggcggctccctgctcctgcagctgtgtgtgtgcgtcctgctcgtgctggccctgggcctatactgcggccgggccaagcccgtggcaacggcactggaggacctgcgggcccggctcctcggccttgtcctgcacctgcggcacgtggccctcacctgctggcgcggcctcctgcggctctgacgggcaggacgggcaggacgggcagggcttccaggagagctcaagcactccgggggctccgagacagcctgagccctggccctgctgcttggtgaatcatgggggccaaaaggggctgctgcctgagggctaactaggaaaagggggaccccgtggcgtgagatcggacatggggggcacagcaggcggccccgccacactagtcagcacagccctcctgtctcctgtgttgggtccatgtgagattttattagaaagaggattcgactgctaacagttgaggctccccaggctcacccaaagacccctccctcgtcccagcaggaactcctgctgctgctagggcctggcccggccatcaccgtgtgcaccctcttgaggagggggacacactgcccgtgttcaaggggctgctcggaggaggcaaacccagccttttgcgattatggcttgtggggaatccagacctcgaaaccccacggggagggaagggtctggttgtcaaggtgggtccctttgatgtgaggtgccatcctctgagcccaggtctgacccccctacccagccccgtgagtctggagaggccccagggaaggacccctcatcaggggcggcttcaggtgtagaagccgaggggacagcaaggggcccagacacccccgaccttcagaacagccatctgtgcccagctctgcaggccaggcacacccagctgagcccggggccagccagcaccacccaccagctggggcctgtgggtcccggagaccgtctgtggttgtggctttgtcgccggattgcagagctgaagggagccctgtggatgacaaacaccaggggcctctccagaccctacgtggggggagggctgaacaaagcagggaggcccacggttagacaccaggcagaactgcccaggagagacacagggacaatcagaccagcgtcctcgaggttagcctgaggcgggtgggcacggccgaccatccacccggtggttcctgtttgtcccaccacttaactgggagacactgttttattaaaacacaccgtggcttccttcagtcttggtgtttttatagaaatgagagaaaccagaaccgatttgctaaggaatcggcctcagtggccaaagcggatgtcctgggcgcctggaacctccccatctcctgcaggcctgggagtggatgtgtccactcgggcaggggctgaccaagcccctgggtcttgagggatgcccggccggctccctttgccctgcagtcagggtgtgtccctgcaactccaggtgccagggaacaggtgaagtggtctccagggtcacttccagctttggaatccagggagcccagagttgcgggtggaggtaacaaaaggggctgtttccagaagtggcccagaagggaccatggtgggggctcccccggggaccctccagcatctctccccaggcccagcccatcccaccccaccccaggaaggaggatgggcaggttcctgccccatattctggatgcagaagcagcggctcccagaggttgggtctctcagagcagtcacaggcccaggctcagccctgtgtgcttgggacacccctccagccccggttctgacgggggacaccgcacaggccgatctcccccagccgctgctgtctgtccactgcaaaggcaacgcaaggacgtgcctggctttgcggggtcccacgctacgacctcaggtgttttcgaataaacattgctcaaagatgggcaccacacccccaagagatccttcgaaatggatcctcccacctggggaagctgcatgggaagcagtgagactcgaagccactagaaaatgtacagagaggaaggcagaacctcgggaaggccaacttctaattcctaaaagcttcggacacgaaaggctcaaagcctgagcaaactgtgtgtgacccacaaattacagacagttagaaccacgagccaggccagccaacagcggagagggcagacagaagccccacacgctcctcctcatccctgttggagactcgggtgcttttgtttttattttgattttgaggaatagacacatgtaagcttaaggatctttactttcagtttagccagagtggaattagaacagggatatcattaacagccagccaggacagaagcgaaggcgtctcagaagcaacttggtggaccagcctcaggaaccccgggtcatgcctgcacttcccaccttcctgcctggggagaggcccaatcccctgagggaccctggagagcccacgaccagggccgccagcccctgcccagcacactgcaggcccagctgccccttcccagggcgatgtgtctgggctccggagacagcccagtccagggtgggtctatgtctgcatgcagccgaggatttccatcaccctggccatggggctgttccacacctgctcctgggatccagcagtgcagcccccaagaacagacccaaccggggccaagcctcaggttccagaagccacccctgcctcctgcccctccttcagggccctagatggctgtggcctggatcagggctgggcagagggtgaggcaggagccaccccaccttctgctggggacacagacaaggagctctccggactggaaagagtccccatgtccagtgggtcagggctggaaggggagacaggggaccccatcagcttagggggcctcggattctgtccaaaccccttccctcgaggacctggctgccagctggaaactcagctggtccccaaggccagagcccccttgagcttccagagcctcgatccccctggacttgacacccccgatgggcacctgccagcctcactcccgggacccaggatgatgcccccaccaggaccctccatgtggacccaggcacgtggcctccaggaggctggtgcccagccacccagagacacaagccagctgctgatggtggacagggtgggtcatgaactcagggagccaggggctcgcctctccccgggaaggtgggcgcagcagcagggagcacttggcagcactcgagccaagaaacggacagcccctcatcgagccccgggtggggaggccccccgcctccgcccccgccccagaacgagtcctctggaggtggaccctgggctttcctgaggggcagggtccacagccaagcagccccctacgccggggtcccaggttcacatcccagctcctccacttgcttctgcggggcctcagcacacagactctgcagaatgggaaggcagctccctcctctctcaggtggatgctgggcgtgggagcccatgggaggggcagaggggctgtccacacagcacccacggctcccatcacgcacacaatgctcacacgcacaggcgtgcacatgctcacatgcaacacacgcacattcacatgcacttacgcacatgctgcacacactgcagacacacctgcctagacactcacacctacacactcttcctcacactcacatgcatgcacactcatgtcacagggagtcacaccctcacactcacatcctcccaggcacactcacaatcaagccttcacacgcacaacagtcacaccctcacatgcagtcacacccacatgcacactcatgcacaatcacatcctcccaggcagtcactcgcacatgcagtcacacattcactcacaggcagtcacactctcatgcactcagtcacaccctcacatgcacactcatgcacactcatatcctcccatgcagtcacacactctcacatgcagtcacaccctctcgtgcacactcagtgacaccttcacatgcagtcacacctgcactgtcacacccacacatgcacactcagtcacatcctctcatgcactcatatacacaatcacaccctcccatgcacaaaggcactcacaatcacatcctcccatactcacccacacacagacccctgccatggctcctggcccagtcctctatgtggtacgtgtgcccccgaaatccccaaccagatgatgcccccgattctgtggagcccagattaccacttccctgaccctcagccaagcacagacaggacccacacacagtgaggtgaactcacaggcctcagaagcctccctgagcccggccacagggtctcccaggcctatggcacccacccaggagggggactcagctggggagggggccaacctggggccagaggctggaaggtgccgtgagctcctccccacacgcagcctctgcctggatggcagaattcatgcagaattcgttcagggctaagtgacatctggccacccctgggccagctggcatggagacagcatccggccagggttgggggagacaagctggacgccctccacataggctggccagtcaggtcctactgggacagccaaggggccctgtgcgaggcctggaggtgccccccgcccccgccccacacccatagtctctctgcaccatcctcatcagggagccggcacccacccagtccactgccaggctcacaggtgggcactggggcgctcacctcactacacgtggcgtcgaggggacacacgcagggctgcatgtggccagggcccaggcagagccccccagctgcttccccaggcaggcccgtgcccccgagcgcagcagggaggtcggggccagctccccctgcctgcactgtgcctaaatgacagcgctcttctcctcttggaaggaggtgcgtggggacggccgggccagcagcagctccttctcgtggatcaggctgtccagcaggtcctcctgacggtagttgtggtagaccttcaggaaggccagcgtggtgatggccagccaggccagccatgaggcccagaggccaaactgcacagagggcagggtcagggtcagaagccgttgggggtccgctgtcagtgcaaccccctcccaccagcccccaggctctgctctgcagggaaaggacaggactcagaggaaggaggaggccggggacatggggcagggccagctcctgaagaccctgcccaagatcaagcttctgagttccttcctgcagccagcatcgttttccagcacctgtggccctcccggaacccactctggtgcaaaagccctgggcactcagaccaaccctcactccaggccggccagaggccccgaggaggggcagtggccagtggcgagtgctttctcctccagcagctccggcctgtcggctctaaggagggcgggtaaacagcggaggctcctccaaccaccggaataaattgacctttagccgctgtttccaaacagttgaaggagaaacaatttaatcagaaccaggcctgagctacattaagctgattctcatttgagcgtatttgccatcagactgcactcacaccttaatccaactggcacaaattaggcctgaggcctcttccactcactaaatttgcatgaaggtgtctttgacaggtccagttcatctcggcaaagagcattcaggcccacccatgtccagcacccttggagggctcctggccaggagaagcgtcctcaggccagccacggccagcaagagccttcagaggccagcctggggtccggaattggacctgaagccagcgggccctgatcagtgctggcaggagccaggtgtctggtctcagccacccccacccggcacccctcatctgcctcatctccgtctggggcacatctgcagatttcaaggggcaaacccaattccagggttccccctccggccctcacgggccactgatgtgtccccacatgcctgcatttcagcaaatagcgtccctcagagtgggggccaccatcgccctccaccaagtctcctagggggcgggggacgcagcttatacaagggcagggtggcaaatctgaattcacaagtgggatcccctgcctccttccttggactctgtatcagcttccccctggctaggggactcctctaagcctccagctctgatctgaacaggcccacccagcgccagcaccaaagtccaaagcccttgtccctacactggacccccaggatctgatgcctggtttcgtttctggcaccacctccccccacacccccacacttcccaccccagaccccagggccttgccacttcctgattctaactcactgtggccatctcctccccaaacccacctacaaaagcccagctctcccccacctcctgcaggaagccttcccgactgctcccactgcctggtcccattgctaactaccttatccacacaggagcctgcctcctcctctggatgggggagagctcagcaaatgtccagcagtaaatggccccctcccagcattgcaagcctcccttcttgcccagagccccctacctgggcaattgcaaactgatcgtagaaggcggagttgtccacgcccagctccaagtcgatgtcctggagctcttcacagctaaaacagcaggacatagggtggagggtgaccaccaggacagccagtgcgggacatggctgagccgctggccagagagccaggagctttgccctacaattgttgggcgagggggtgggcagcagggagtctctggggacatcacggagggttagcctcgatgcctcctccatggagcaggacagcctttggggaaggaaacctccaggcccctccctgtcctggccctggacagccagaagacgccagctctgcctctgccctcctggaccctctgccccccatgccccacactctgaggatcacggggtctcagaggccaggcccctccctgtcctgacccaggacggccggaagacgccagctcagcctctgcttttctggaccctctgccccccatgccccacactctgagggtcacagggtctcagaggcaggagatgcagggctgcctcagccagacagagatggaggtggcatccccaccaacgctgcccagaagctctgcccccatcacggaggcatctgtggaagcagtgggcatcagagggcccaggagtgagccaggcctgggctcccggtaggtgtcctgcacccccaacataaaacgtgaagccaggacacattgacaggagcagggtgccagaaagagggggcccagcggccccaaatccctggaggggctgaagggctggaaacagtgtctgtgaggccaaggaaactttgcgtgtgtaccagaggttgcccacactcttgggaagcaggtggcccgagccagcaggcagagctgggacagtgcacgatgaggcacagggcacagctcagcacaggaggccctgcagggccacacacccaggtgctcctgctttcctctggtttgtgccccagctaccccagggtggaggcacggaacagacaggcagggagccccttcagctctgctgcatctgttgcagatgctggggtttcaggtctgggtttgcttaaaggaagaatgtggaaactctggagggttcctgtcttccagggttttggcctggggcactgcatggtgcccctcagggcggggcatcccactgtggggggcaggcagtcactgtgctccactctggggccccccacaagccagatgatgcccctgctaagatcccagagggaccaccatggctcaaaggcctccatccccaacccgcctgggagctgaccctcaccctgccagaagcttcctctgctcctgttcttcaccatccccgtcccttccaccatcttccaaactcctcaccatgaggaccaaagccctgagcctaatgctccctgggctctcccatgcagccagcacaggacagaagccccacagtctccggctgtgtggccacaccgagcctcccaggacccggggccatgctgcacgggatctgtcatctaagccctggtggcaagaacagggcagccagagtccctgaccacctggagccacccccagctgtatccagccctagggatgatcgctcttgtgtgacgtgtgatgctgccggctcctagggcgggaaggtgtctgacattgcagggtgggtctcagggaaggggctgcacaggtatgcacaggcaggggcacagtgcacagtgggaccagggaccgcagactcaggatgggcttcgtgagggaagatcacccacagcagggcagggtgtcaagggatcttccggggaggtgggcggaggccgaggcgggtggggcgggcgcacctgtggggtacggtgcccttctcggtgatggtgtcgcaccacatggtgaagcccacgctcacgatggtgctggcaatgaagaccaggaagaccacgaaggcgctgaccaggaggttcaggaaggcggagaagaaggagctgcagccagaaacaggaggggcaggctcactggacaccacctcccaggcgacccccgcccccaggctgcagccagaaacaggaggggcaggctcactggacgccatctcctgggcaacccccaccagcagcaccccccggaccctcaggattcctgggttgggccctgtggggcctcaaggagttgttccccctgcctgcggtccctcgggcagctccgtgtgcccaccctgggctgcaggtcacaccttcccaaagacccaggacctggaaccctggtccccaccatttcataaaagaggctgcacccagggtggaagtgaatgacacccttccaaagccgtccagccacagtcaccagcaactctggcccaggtgcttgtgtccccccaaatccatatgttccagtccactgaggggttagaaagtggggcctttgggaagagaggaggtcatgagggtgaagcctcatgaatgaaatgagtgccctcctaggagagaccccaccaagcgagctcccagcagataacgacacagcaagaggaacgggccctcagcaggcatcgaacctggatcccagcctggatcgcagacctctagcctccggaagtgtgagcagtaaatgcctgttgtttacaagaccccagcctgtgatgccgagagcttccattcacccgcaggtcatcagcgcgtggcctggacccctggtaggacttgcttgatgggccagctctgatttatccatttaaacttaaaaggccaggctgtgattgggcccatctgaccagggccagagcatggggagcgcaggaggcagggccatgaggaaggagctcacttagggctgggccacactgccccaggggtctgaggcctctgccagggcgcacacggccatggctttcagaggatgctcgtgtttcctcttctgaggataccgggcaggtggtcgggacacccaccccacccggccctcctgcctggcctgcaaacgtccatcatctctgaattgctccatcaagattcaaagtccctcgaatgggcctggggtgggctcagcctggaatgcacacggaggctccggggggtagggagagggggtagggatagggactgtccctccagtgggagccctgagggggacttcctcacgggcggacaccagcactagcagcatggctgagaaggggctgctcccgcctctcacctgccagcaggctcgatgttagcctgcatgctgtcagcacactggatctaagggaggtgacccacagaaacagcttcacagcgatcatttaataaacaaggtctccctggaatctcagccaagaaaacatcaacgctaccgtcatccgaactcggcagctgctgatgaggcaaagtggaggccagcgcattgtctgttcattcattcagcaggcactttctgagcacctgctcgccctgtgctggacacagagggcagagtgatacaaaagacgaagtcctggccccgggaggtgccccagccaacgtgctgaggataaacccaggccacagcgcccaactcagagcaggcgacaccaggctgctttgtaacatctggtgcctccaaggagcccgtccactggccccagtcccggacacactgttttggtgactgctgggctgacagcagaaccaccccccaggaacgggagggtttgagccaccccagggagtcccagacaaggggagaggacacagggacactcttaaagccatgggctgtgatccaacaaccacaccaacgagggcaggaccagcaggactcacacacgtacgcgtggggggtgaccgagcctctgcccaggcctcatggctgaagatggctggagagtgggtaccgtgtgccagtagacaagccacaacccccatcacagcgccacatccaaagctctctgaagacagaaagagcagcggcaaaagttcgccaggatgggtgtggggccattctcggtccctctccagcccagtgtgctgtgagtctcagagctgtcacacatgggactggctccatccgccctgcccaagcctgaatcaccatgtgccagtgtctcccgcctgctcttcagagtgcgtctccttctccattctctgtctggaggctgaaaggtgtggaccatggcaatggccccgtgccctctggcttccggctgggtttgggcaatggggtgggagggcgggagagcaaggtgggaatttgctaccaggtccctccactgaaagtcactgctcctctccaggtgacccacccatccaggtcccgttagccagggatggggacagcaccacctccactgaccccatgaaccccaccacttcatctcttgtcaaccagccctccttcaatgacctttccttgggtgagccatctgctgctgctgggaccctgaggacacagttctgaaccccaaaatccatctggcctgggggtgcaaatgaggggctaggggcctatagtcacagagcggaacgcagtaagcccgccccacctctgcagtcttggaccagctgctccgccccagccaaggagaaggtggtggcgaggcacggccagggtcagctccacagccagaggcaaggaaggggccactgccatggtccacacctttcagcctccagagagagaatggagaaggagacgcactctgaagagcagggtctttcagaccctgaaagaccctggtgcctgcaaatacctggcccagtgcacctgagatacggcagaggctctgggcccaggcgacccactgtccccttcccaccactgagcatgggccacaacacaacctccaacagacagaaaagccaattatctggagacttcaaacatccagcctcacccctatgaaatggcccgattttggagtcttctcccatgaccagatcgaggagttccccatgagatagggaagggaccccaggctggggccgctgccagctgacagcctcggtctgttcctctcattcctttctggtcggtttccagggatcctgcccaggctgtccaggtcgttgaagaattggatgtgtccagagcatccccggatccagctccccagaggtcacagggccacccagcccctccctcaccaaggccaggccaggacagtggtcaggaacaggagcccggcacatgcagggttaaccctgtctctcttcactgccgctcagggtgccctgccaggatgtgccatctccatggtgaccgctgtcctggaaagcccagcaatgtgaaggctcagcgccggcacgggcaggcagatgagtttaacgcagcatccctccggcccgccaaccacaaactgctgccagcccacgtgctcaatcctccctcagcacagctgccccaggcccacggctgcctcagcaaacccttctgccccgaaatggcaagcctctctgaagcacaggtgccattccattcattcatccattcattcattcattcattcattcatttactcattcattcattcattcattcattcactcattcactcagcagccaataatggagcatcaagatgacactcctctgcaaaaagctacccccagactaattttcacacttctgggcacgagctctcagggcccagactctgcatgaaagacacccccataggaagaggaagctggcacctgagacatggcctctgctccacaagctctggacgtgccatgtgcccctcaaacagacctcacacaggccttgccctcacactggcaggagggcagccgggtggcccctggaggtggagtcccctttagagggttagagcatgtgctgtcctaaacaggcccagacctctagcagccagagtctgatggggtcagtgggctcctccctgggctggacgtccagtggccgtcgatggccctgagagcccttgtccaccacatgagctccctgtaaaggcccgtctcagctccgtggctggtcctgagtcccctttacctacctggcacttgctcacctagtctatgcagctggaccaacaattgagttggaattggctgctctgtcgctggaccctgcagaccccatcttcccaggggtccagaacttcctgacatggcaagtctgaagggtggacctgttggccagataactgagtctgcacaggtatcggggccaggtgagtgaccacaaggcagcaggcctcaggacccaggcatctttctgtcagtcattcaacaaacattatctggggactcctacgcaccatcccctgtgctcagccctaaggacacagagatgaataaggtgcatgtctgccttggcttcacccagctgtgggtcccctagggtggggtcccctggggggggacccatggcctgagatggctcttgagagcgttaaccttcgcctacaaccagaactcaatggagtgctgacacgtttgacagatgtcaccccacaagccgtctgccaatggactgtgcagtgcatgaggtgggggacaggtggccacatgaccacgtgaactgagccactaattcctgatggtcaagaaggacacaggcaccagatgtccctggaaaagagcaggctgggcggaggtcagtggtgggaggattggtgaacccctgaactgaagcaaaggagctgaacctgaaatgctccgccacaggccccttcctgacagcaggagctgcccggacctgacctccagtggggtcaaggccatggtgagcctccacaatgtagcccccctcgacaaccctaaccctcaccctaacccccacaggcctgagcataccaggccgtctaaggcttcctaaatcccatatgggccggtcagcagggctgcagcagaggccacacagctggcctgcatcccagccggctccaccccttgggaggatggaacaccacaaagagtgctgggaaggcctgcagactccccaggaatctgttttctgcctttggaaggagatggtgctggcagtttgccacggctgacagacagtcaccttccgtgagatggcaagaggcagagctgctgttacggcatccctgggcctgccgcccagtgtgtgcgaaatagaccataccctgtgcgacctggactcctgtcttgcaagctctggggctcttttctcccctctccctgtcccccagcttctggtggaaccccctataaaatctcccatcactctgaccacatagctgggtcctatctagagagccaccctctgtcagccccagctggaccacaggcaccctgagggacacccaggaggtgaagaagtgcgtgagcgatgaaccaactgtggccccacctggcctgcaccctccaccctcagcttcccagactaaagggacctcaagcgttgggaggctgaccctactcgctggctgtcccactccctcttcacacctgtctcattcagggaggcttccacctgcctgccctgcatgcacagcatggactgggcaactcttgggtttggcaacatgggtgcagatgacgtctcaagcctcttcttgggacaccagccctggagtgggctgagggaaggaggacggctgcaaatgggcaggacaccaccctgcgcccggcctgaccccaccttgagcagggctccagccacacaatttgggcccatggccccacagtacctgggtcctcccaggctgacagccagctttctactgacccccatccagaaccttagtgtcgtgggttgaatggtgtcccccgaaagatatgcccaagtcccacccctggtacccgtgactgtgactttgtttggaaatagcatctttgcaggtgtaattaagctctggatctcaggatatctccctgagtttagagtgggccctgaatccagtgactggtgtccctgtaaaaagagggaggacagagcagagcaaaggcgccctgtgaggacagcggcagagggtggtgggacaagtgggtttcagtccagttggtgcaactgtgctgcagcagccccagggcgctcctacccacaggcgctgggattctcattcctcctccagagtttgcagccccactcagcatagccctggctccctcccttctccctgaagcccctcttcttcccctctctggcccctctctcagccaaaaccaagcggtgggctcacagcgggggcaacaggagggcttccccactcctgccgcccacacccctctgagcccttctcatctcccacctgcgtgcaggaagtgaaaacctacaacaaaggatgggggtgagggcagagtttgggaggagcctgggtttcatgagtgctctcccggaacctctacaggatctcgggctgctcctgggcacagcaggcctcagccaggggagtgggagggcccacagagggcacccacagagggagtgggtgggttcacagagggagtgggtgggctcacagagggggtgggtgggctcacagagggggtgggtgggttcacagagggggtgggtggattcacagaggtggtagatgggctcacagagggcacccacagagggagagggtgggttcacagagggagtgggtgggctcacagagggagtgggagggttcacagagagcacctgcagagggagtgggtgggcccccagagggcccccagggtgccactggctaagggtgtcaccgcaccccaggtgaaccaggttgtatgggctccagtatctagccggagcaggaaagagaaagaggaaaatgcaggccaggaggaggaaggcgctgagcccacaaggcacagccctcgccctgcagtctctctccagctccccatccaaggcctgagctcgaggtgggcctgggtggctcccctccagacagccatctgccgtccctttcccggggcgatggtgccgggtggggctccccagttcgccttgtcactgggacctggagagctcagtgcaagccctagaccgggctgggagttgtcgccggtcctggcgagtgtggcccggctgagcccgcccaggaaggtccaggcctgctgggtgatgacagtgcaacatctgcaacccaagggagcagatgcccggaagcgggaggtgatgcgcagctggggaggggaggcactggccttgtacgcaggaccggtggtcgtcatggtccctggatgtgtgtgtagacaaagggcggtctgagtggagggggtgagggcggattgttgacatttgcgggcctcggagctgcctgagagacggagggactcgcgcgcctccccggggaggtgggtctgggggcgctgggggcatggaaggggcgccgcgccgggagcggcccccacttacccctcgtgtcccttgcagaggaagaagagcgtgcgccaggcgtgcgcggcggccagcagcagagacaggaggctggcgagcaggctgaagcggcaggcggccggcgggccccactcctgcaccgtgaagcgctcgcgctcctgcaccgtgaggttggcgctcagccacatgccctcggtgaagagcaggcagcggccgcggaagtcgtggccgttctcggacagcgggaccaccaccacgaagctgaacaggaaggccaagaagtagcaggcgcactgagcgaaaaggaaattgttgagcgccatggccggcccgggcgagagcggcggcgggaaggccgcgggaggctgcgccgggcggggaggccgcgggaggctgcgcagtggcggcgccggcaggtcccgcgcgcccctcccgggacgcgtgcgcatcggccgagcgcgggaagcgcctgcggtcagcaccgcggacagctcctggtgcgcgcgggccaggagcccggggtccaggggccagagaagggcggcctgcgggagatgcgggaattttaccaggtcggcctggagggaccgaccctgtgccgctaaagacttcgggagccacctgtacgggcctcacacaggccgactctgggtcgtcagttcctcatcagctcgaacgaaaggagaccaggagagagagggcggggcggggggtgttggaggacacccccaaggtgctcatagtgaggtgtaggagtgcggtttgcagtccaggctgaagtgattcctttgcgggggtcccgaaatgcaatgtatgaggggaggggccagatcgtggaggagtcggggtccaagggactgggacagaggtcatcctcgaagagatggggagggtgaggccaggtgtgggcaggagggggtggaccgggagcttctgcagcgccagccctccgcggggacgtgtgttacactgcctgacatgggcaggaccctggagctgcatttgtaagataaataatgggtgtcccgagcgcctcattaagacatctttgctgagatggaaatcgctgaggcattaattaatagaattaatgccttttctagttgcctttaagactaagtcacctttagtccaattcccagagtgaggaagccttaacattgctcctcctggtttaaaattccatcagcatttttgttgcaagcattaaaaaatatttttgttttattgactaagtaatatatgctcatttcttaagtcaagtaatagagatatgtatacaataaaatagaaagccttctcctcatccccctcccctaccccatcacactaccaggggtgaccacttcaatagcctggcatctatttttctagacattttgctaagcacataagcacacacacagaattaacaaaaatgcttcataccatacatagttttctgaaggctgattcttttattcaacaaaatgtcaaggagattattccctgcctacacatacacctattttgttctttttaataactgcataagactccattataatgatgattccacaatctgcataactattcctcttaaggtggatgttttgtgtctccagtttttgctgtctcaaatgctgtcatgtgaacattcttgtacacatatgtttgcgttcttgcacaggcatttttataagagaaattcttagaagaggaattgctgggtcatggggtatgcacatttaaaatgttgacagaaattgccaaaccggctttaaaaatgttgttcagccgggcgcggtggctcacgcctgtaatctcagcactttgggagggcgaggcgggtggatcacgaggtcaggagatcgagaccatcctggctaacatggtgaaaccccgtctctactaaaaatacaaaaaaatcagccgggtgtggtggcgggtgcctgtagtcccagctactcgggagggcgagacatgagaatcgcttgaacctgggaggcagaggttgcagtgagccgagatcacgccactacactccagcttgggcgacagagcgagacttggtctcaaaaaaaataaaaataaaaataaaaaaattaaaatgttgttcaaatttaccctcacatctgggttgtagacccctcccctcgctggctgagaaacagcagttgtaggcaaatcctgccagtttccacagaatgcgctcattgctgtgtgaacttggacttgctttggcatcatgaggctgagcatatcttcttacgcttgccaccatttgcaacttcttctcttctgtggattgcatttcattttgcagtcactttaaagtcgggccttgaaggccagccacgaggtcagcaacggccactcttctcttggagaatccactcagggtttttaccactcttggagtatccccaattctccccaaagggagctcactcaggaaattcaccccctcccctaacttgggcaagagtggaagttccatccactcattatccagcagttggaccaatttgaacacatctgggggtgttacacttccagactctggccaacatgaaggagaccatgacaactgacagggaaccgccagcactggaaaccgcagactaggctggaaagatgattaaatatctgccattttcaaaggtcaaaggtgcgagactctggcatgtctgtgattagttccacttaccttcaaaaatcaaagacttatcttgtttgtattagtcagggttctccagagaaacagaaccaataagatggagaaagagagaaagagagagatttattttaaagaactggctcatgtgattttggagactggtaagtctcgaatctgcagggtgggccagcaggctggagacccaggaaaagtcaatgttgtggttcaatgtcgtggctgcagaactccctcttactggtggggggagggggattgggaggtggggtcagtctttggttctattcaggccttcaactggttggatgaggtcactgctatagtttgaatgtttgtctcttctgaaattcatgtagaaacttaatccccaatgtgacagtggggcctttagtaggtgatttggtcctgtccttatgaatagatgaattcttttcatggattagtggtctcatggattaatgggttgccccaggactgggactgatggctttataacaagaggaagagagatgagccggcacactcagcctccccaccatggatgccctgcaccaccttgggactctgcagggagtttccaccagcaagaaggccctcaccagatgcagcacctcaaccttggacttcccagcctcgagcaccatgagaaataaacgtctttcctttatagattacccagtctctagtattcagttttagcaacagaaaaccgactaagacactcatccacattatggaggatctgctttactcaaagttcaccatttaaatgttaaccttgtccaaaaatacccccacagaaacatccagaataatgtttgaccacatacctggcaccttggcccagccaagttgacacataaaattaaccatctctttattgaagaaattccaatctacggaaaatgtggaaaactccaaaattcacttttaaaagccaacattacattaataccaaaatcttaccaaaattgcgggagaaagaaagaaataggaaattacatatacaaatatggatgcagaacactttcaaataaaatattggcacactgaacacaacccaatgtattaagaaagtaagaaaacatgaatgggtagactttagtctacaaatgagagaatagctttgctttaggaaatctatcaatgatatgctacatcaacaaataaaggaggcaaactcaccttttcgtatcaaggaatatcaaaatgcacttcctatcattgaatatccactcctgataaaaaaaaaaaaaacctctatgtaaaataaaactacctaaatgtggtcaagactaccttaaaccacattataaatccgcacccgttcaaatcaggaacaacacaggaatgctcactgttgcaactattattgaccattttgggggcaattctacctaatgaaccaagacaagaagataaaagaagcagtataactatggaaacaaagaggcaaaactatctttattggaggataatatgattctatacctagaaatctcaagatactctataaaaatatgataatttgcaaattaattttgttctggatctaaaacctggcttaggtccagaaactgggccgggtgtcatgacgtctcctgtcaggctgcccttgggatggttccccttcatgccctatgatggtgtcaagtgcaccagagtgagagatgcctctgcctttcctccagggatgcccagtcctgttgtccatctcctccactttctgttggtcaggacacgctggctccttctttgactttgctgctcgttaggacctgagctcaccttgctcccgacgattagctggcaccacctggtctgtcttatctggggatcccaccagccgcattgttctcagggcacccagtcctgtgacagcagctccaaccatcatcccgctgagcttctcagtgattctgccccctccccagtgcaactttcttgctctggtaaatggagactcttctgcagccaccctttctccacccaggaatgcaacctcggtgggtgctgcagcctttgtagcacggacactcgagcacgcccctgtccctgagtccttgccccctctcccaccatctgtcctggctgttctattttacagggttgagtatccactttccaaacttcttagagccacttagacgagttttctgtcactgctgcaacaaaatgccacaacggcacaaatggattgtcagacagttctgggaggtgagaacatcccagggtcagaagtctaaaatcaaggcatctgcagggctttgttctctctggagtcttcaggggagaatctgtttcctcgccttttcagtttctagagggttctgcgttccttggctactggcctccttgctccatcttcaaagccagtaacaccagtccagcccttctcatgctccactcctctggtctctgcagctagaagactctctatgttgacattagacccatctggaaaatccaggatgccccgcaacctgaggtcctcaaccttaatcacatgcacggagtctctttttccataaaaggtaacatactcatgggttgcaggaattgggatgtggacatctttggggcattattctgtctgctccaccatcctaggaacaagttaaccctgcctcccagggctcttgcctggtgttaaacctttgtattccaggacacctctaccttttggataaattctttcttacccaacatttatgttctactcccctgccccaatccagcacactgtggtccaggcgcacacatatccctgccgcctgttggtacgtggtcttcagatcctgcagagccatcggggcacgctggcctccctctctcagcagaactcattctttgacgttggtcaccagcaggagagatggagtagcccctccttagaggccatgcattctccttgcaaagcaaacctgtgaatcatcttccaacaggtgttatgggttgactgtgaccgcagcaaagacatgttgaagtccagaccctcagcaggttagaatgtggtcttatttggagatggggtctttacagaggtaatcaagttaaaagaaggtcattagggtgggccctcagccaatgtaattgatgtccttgtaaaaaatttggtgatagatatgcatagaagtagaacaccatgagaagatgcaggcagagattgggatgatgcttccagctagggttttaatgtgtcccccaaaattcatatgttggaaattcaatccccagtgtgacagtgctgagaggtggggccctcaagaggtgactaggtcaggagggctcatgaatggattattgccattactgggaaagtgggttatttaccttggaaatggattccttataaagaaagaattgaacccctctttctcttgcatgtgtgggctctcctgcccttctgcctccaccatgagatgacatagcaagaaggccctcagcagatgctggcacctggatattggactcccagcctccagaactgtgagaaaataaatgttgtttaagctgccccatctatggtacttagactcagccgtcccagaaaactcatacacaaggaagtgcctgtctctgacaggaaggagcaagccccttctgtaggcccagaggcttccagaaggcatgggagagccccaacctctgagcatgtcatcacaggtggggttccctagaaagcaggctctaaggtggagaagtacccagtgaggtttgttggaaggattctgtgagcacagatggggaagaaaagaaaaacaggagagggcagaggggctcctggccgagacacagtctcagtggtggctcagctgaccccagggtcaagggcctgggcctttgtaagcacatgttgatcagtcactggaagcagctggcctgggacagggagtgacctgggatgaggcagcatcagaagaggctggcagccaggagccatcgagggcagctcatatggcagtttggggaataagttctatcctaaaggggcccaccatggaggcctgaggccagcatggcagccttgccaaggctgagggtcccatcacctcaggagctatgttgctcttagaatttaagccctggactggacccccacctgtccctgcctccaaccgtaggggatgagactctctggacaggctgccaagcaggcccactgcccccacacccagccttgagtggagatgagtcaagctcggctcccatcatctttctccaggaatttgtagcacccagcaacagccatctgatccatggctctgtgattcctacattgcctctgcctctcgtgcttctgagataaggcaccaaccagtgcagttcctcccctacccaatacagcacctggggcaccacggtgagagggtccctgacacggcagggctatcacttctgcaccagccacagcaacagggaccgcagccagtgactggcagtggttagtctagccccaaatcccatgtgtgtctgcctcctaggaccacccctagtttaggagaactgacgctggacctcgaggtttgtagacaggaggactgagtgtgcgggttcctctcaggagcaacacctgtgagccaccaagagcagcaggactgggccaagggagaaatgctcggtgacacagaagcaatcccctgggaacagccccttcagagcgaccccacagaggagcaggagctggacctttgtacctccacactgacccatcactggacgcaggctgcctccaaaattaaatcccaaagctttaaaaggctgataatgcccactcctggcctgccaaagctggggaccccagggaggagggagccccgtggtcttctggcgggaactggcacagtcagtagaagctaagatcgccgcacatgctttgacccagatccaccacttctgaaacacgggggctcaacagaaaagcctcatttcataaggacatgtgtacatgaatgtttattacaacggtttgtaccagccaaaaatggaaaacaaccagaatgtttataaaccagggagcaatttaatacattctggcacctccttataatggaaagttttgagctgttaaacgggagtcgtttctgtgagtattggcttgaaggattatctgtctagtgctatatttaaaaaagcaaattgtcaagtcatgtgtttgtattaccccattttattttttatagtctttaaaaatttaatacttttgctatttacaaaatctcttttaaagcttaaataactttcaattcaatgttttggatattgtgaaaggtgatcaaccttttccccttatatgggtggcaattgtatattgaacttcttttactttttaaaaattttaactttaaaatattttaaattcacatataagtggatttgcttctggaactgctcttccttttgtctttggtgtattatacaaatagcacattttttcatatggacattggcgatttatttcatcttttttgatataattatttttattattttactttcagttctgggatacatgtgcagaatgtgctggtttgttgcataggtatacatgtgccatggtagtttgctgcacctatcaacctgtcatctaggctttaagcccctcatgcattaggtatttgtcctaatgctctccctccccttaccccccacccctcaacaggccccagtgtgtgatgttcccctccctgtgtccatgtgttctcactgttcaactcccacttatgagtgagaacagctggtgttcggttttggacatgaactcattcttctttatggctgcatggtattccatggtgtatatgtgccacattttcttaatccagtctatcactgatgggcatttgagttggttccaagtctttgctattgtaaatagtgttgcaataaacatacgtgtgcatgtgtctttatagtagaatgatttacaatcctttgggtatacacccagtaatgggattgctgggtccaatggtatttctggttctagatccctgaggaatcaccacactgtcttcccaatggttgaactaatttacactcccaccaacagtgtaaaagtgttcctatttctccacagcctcaccagcttgtgactaccatctgcacacatgagtgaggggagagagaccctgtgctccagccgctgtcactggggctaggggaggacactcccagctccctctgtggaggagatgtccacctggaacttcaggggtggtatggctccccccactgacccccaggctgcagagctccctcctatccttgtcctctgctgcagtaccgcccctacctcagggatgctttgcttttctccttcctgccagctcccagtcagggcctgtctgtcctgttgcctgaggcctggaaggatccaggacagctggctttggccaggtgtgggaaagagtccagaaatacatagtacagggcccaggtgcacctggaacttctctaaagcaggaggttataaatagaacactccagaaagagtctcctcagcaggcacttcctcacccccaccacatcccatgtgagggaagctgtggattgtgtagaagagccaggccagcaggcagtgccctaggactcgaggcagggcccatggatggcgctgcaaggcctctggtcgaaggggaagaagggcatggctggaggaagaagcaaggctgaaaaagatcggggctgggaaggggtcagtggagattgagatagcaaaccacaaaagatctaatgtcttcatgtttcaccccattttcttggctcctactgagggcaaacataagatcatataaagaagactgctctccatctgaaagatgactgaggggcactgttcaccatctcacttgctgcactccacctgagcatgacacaacggagtcctccgtgcatgggagagaaatgagtggtgccaaccactccagaagaactgccaaatgaaggcccctgcagaggggtgaatggatggagggtggttgggtgcatgggggataagaggatgaataaatgaattcatacatcagtaggagagtgataaatggatgagagggtggataggtgactggttggatgaatggatgaatggatgggtggatggacgagtgggtgggtagatggatgcatggatggatgtatggatgaataagtgggtgggtggatggaggggtggatagatagatgggtggatggatggatagatggatggatgcatgcatggatggatacatggatggatggatgtttgggtgggtggatgaatggatggatggatgttcgggtggatggatgggtggttggatgtttgggtggatggagagatggatgggtggatggatggatggttgtgtggatgaacatttgggtggataaatggatgagttgatgggtagatggatgtgtagttagatgaatggatgaatgagtgagtgggtggatgaaggggtgggtggatggacggatggatagatggatggatggatggatggatggatggttgggtggatggatggatgtgtgggtgggtagatggatgggtaggtggatgaacggatgaatgagtgagtgagtgggtgggtggatggatgaatggatgggtgggtgggtggatgtttgagtggatggatggatggatggatgggagggtggcagggaggaaggaggaggaaggataaataaatgtattgattactcacacattgatgactgtgtgagtgggtgggtaggtggattgatcagtggagagatgaggggtgaagaatgattaacaaatccttacagccatattttggagaataccagcagcctgattttggcaaggtgatcactgatatgggaaatcagaatgttgatgtgctgatttaccctgagaagttaccatttacaagactaggacactaacatccctactcaaactgcatttgctgtcagcagtgttatctgggaaggcaccattagaagtcatcttggagagcatggaatcagatggggaataagattatttcatgataacaagctcaagctaagaggagctgccttgcatctcccaataacatacacctgtccaggtgactacaagcacttgatgtctaaaacagtggctccctctccctggacagtgctgggaagggcatggtcaacagtgtctccctttttctgtgatcccatggctgtctttatgattatcatgctcctttatgattaacacattatttctctgagtttattctgttgcttttccagcttcttcagtttaaaatcttaacctattcatattctattttaatgaatcaatttaagtctatacattttcctcttgataacactttggccatatcccataggttttgacatgaaatgttcttatagccatttggctacagatagttaacagtttctatttttactttaacacctgctaaaataattagcagtgtatttccagctatactcattttgatggactttctttttgccattgatttctaattttattgctttgtggttactgaagttagccttagatgttaatttttaaattgtcaaaattctcttagtcatctagtacactttttttaatgttcttgctgtgctaaaaaaaagtttattatttgttgaatatgtatttctatgtgtctattagattaagctttaattgcttatatttatttatagtctattaaattcttcagtttctggggtaggtctcccaccatgactatggattcataattttctttttttacttaatgtattttttcattatatatttcagtttatgactcttatggagtcttcttcttttcttttttttttttttatttgagacagagtctcactgtgtcacccaggctagtatgcaagtggcacgatcttggctcactgcagcctccgcttcccaggttcaagcaattctcctgcctcagcctcccacgtagctggtactacaggtgtgtaccaccatgctggctaatttttgtatttttagtagagacagtgtttcaccatgttggccaagctggtctcgaactcctgacctcaggggatctgcccgccttgccctcccaaagtgctgggattacaggcatgagccactgcatctggcctcatgtattctttatgagttgttccatttgtcaacatgaaatatccccttttgtctcttttaaacattttgccttaaattttatcttctattatataaatattgctaggactgcttgcattttttggcatttttgatagacttttttatgcctttaatttttaactttctaggcaactttaagtatgtcttttgtaagcaacatttcagctagaatttgttatttgtttctgttcaatctgagcgtctctgtctttcaacacgtgtgtttagcccactgacatttattatgatttctgatcaaataaaatcttactttgtatttcctggggtttgtttcccccctttctcatcttattttagaaattaggtttattttattccatttttcctcacctgtctttgaaatagttacattctatttccaattccttttgattacctatagatttagaaaatacacacttaagcatctgtttttccgacagtgtcaagaatttgtcagagtcgagatactctccgaacaagatgagacccatcacataatgtcgcttttgtccactctccacatctccctcaaatcccccatgttgatcccacatggaattttagtgctagattgttatcatttttagcaatcaatacctatttgaacttaacaatacgctaacattattgtacttctacttcctcgcctgtgaaatgtgactggcagcaccaggctcgtggcatcatgaggattcagtgagataattcccgtgcagcacttagcacctgagcaacagcaggaatgagaaccgtcagtcagcatcagctcccgggcgcccttttcctcttgctacagcacatcttctggcacttctttcagaaagtcgggggactacgggagctaaatggttgtttgtttgtttgttttttgaatcagagtctcgctctgtcacccaggctggagtgcagtggtatgaacttggctcacagcaacttccacctgctgggttcaagcgattctcctgcctcagcctccctagtagctaggattacaggcgtgcaacaccacgcccatctgatttttgtatttttagtagagacagggtttcaccatgtcagccaggctggtctggaattgctgatctcgaactcctgacctgatctcgggtgatccacccgcctcagcctccccaagtgctgggattacaggcttgggcctccctgcccggctggttttattttctatctgcatataaatagtggattgtccaaggatttcacctcacaactggggagattttgcagtcttaacctgttcccccaatgctgcggatgagaaggcaggtgtcaatctgatccttgttcctcttagataattggggtttcccctccccctacccacccagctttagctttatcactgacgatccacattgcactttgatgtagcaaggaatgaatttgggggttttggttatttgtgtttatcctgctaggcacttggtgggctctttcagtgaggccagcacctgcctttagctctgaaaaggtagagatgaaaacatgccctggctgttgtcccacccccagcacctcccctttattctctccccctgaaatcctaggagagggatgctatggcctctagatcgtcctccacatctcagcttgcctattgtgcttcccaactccatccctttgtgtcacattccagtaaactccctcagcatcctcgcccagctccctgcttctcccacagatgcccactctgcctcccatcactggagccattcttgcttttgttcttgatgactttttttcattgcaagacctctcatgggttctctgcaatacccactggtctcattcctctctgaggacaccagttatacttgctctaggtcctctctggtggctgtatttgttctgcttctctttctccttgtacatgttcacacctgtacaagtgtacatggtatgggctttcctcggaagttgagcaagacttgactgcgaggtcaccattgcggtgaagcctccgcacaggtcctctgctggatttgtctgccacagcccttgcaggaaaggctgaagcttcagctgagacgtgaacagcactgacatcagtgagagtgcgggccggaccaggcctagctggggtcacttggtaggggctgggcacggatgctcccactcctcccaggaccaccagataccagaccatgatcctgtctctttgaactgagacccatagtcactgatcctgcccaaggcagagccttcttcactgcagcttgacccaaggtaggggaggagggcagtgcgtgctggtgtggccaatcattgcccaactgagaaagcttcacttaaaggtacgtaaaggtacttcacttaaagtaggaggccaagaaaatggtctgcacaggtactcagggagatgcagaagcttggacacagtcagaaaaggcgtaagtgttcaccaggaatgctagcttggagaactttcgcccttaatgtggcactctctttttttaaaggaaaaattccatacctcaggaaagcaagataggaaccaaacatgaaaaattgtaaacccttactatcacaggccaattgcaaagcatcaaatatgtgcacgttggcaaagaaattgttcctgaaaaaagtgcaaattgctacttcactgcatgtaaatgaaccactaattgcttcttgcaaacaatatttatgcaaatggccccgcactctgcaaagctgcacagattatccatttgcatgtacattcgtctctgcccttcctttcatctctcagcgagcggaagaactgcagacaccagctagctggcgagcccccaccacacacacacacacacacacacacacacacacacacacacacacacgctgcctttctctgtgttcctgcaggtccctctctgctacctccttccctgctctttccccatcatctctgccccacagctccacaggaagagagttaagtgtcccccagtcctgccttgcatatataatggtcctgttctcaaagcctctctgcctgcacatgaacgtaaaggcctaagccctccgccatgctgccggagctaacagcatcaggctccttcagcaaagcccacagacaacctaggaacttagagaaaccttttgcaaggcacaacaccattgttctaatatgtaaagactttctagaaatcaataagagcagggcctacatgttaatagaagaatataatcaagtaagataaacaggtgcagaaaataaaatcaactaattcttaaacatgtgaagagtcttaaaatcattcacaatcaataaatgcactctaacactctctaagaggacttctgagcaaccaaagagaatggaacctgcctaggtctgcatcacccccaaaatcctccagaatcagtgcaggtcaacaggaaggtcaagtgaaaccacacaaagacaggaatgccccaacttcaagtcaaccgcaggggaaaaaagggaaaaagaaaaacatcccagcaagcgatttctcacattctttgcagtaggtaggagcagtccaagaataagacaggaaagagagaagaggaaagctagagaggggtgtaggagtgctctaaaaccggcagaaatagcaccgttccgcacgtgtgaaaacacggaacaagtgccctttaggtccgcctgctaactgcagagatgggcccgaaaagcacacacaacctgaagtggcacctgtgaaatgcagaacttcaggagaagcaaacgaggaaaagaagggagatgtgctctttaggcatccagcagccaagccaaaaaggaggaaaggggagaagtcccaggtcctgtaggaaaaggtgaaccagaaaatgcagagggcacacatcccccactcccagcacacactcacacacagattcatgcgagaaactagacttcgccacgccgacagaacagactgtgctgaagcaggaaccttgtaaaccacccaaactcacaaaatgatcagaagagtattgtctatttaaagctactacaaaaatcaacacacctcatttgataaaaatccccactcctggaaaaaaagaagtaggaaaaaaacagcaaggccacactctaaagtgaatgaaatatactcacagaagcacctggggaataggaaaacccaccctgagtcagaaattcaaactcttggaatataagtagacaaaagcagaaagaaataaaaagggttggctgaaaccagaaaagaaaggaaagaaacggacaaaattgtctcagaaatgaaggctgaattatgagatgcccaagaaataatagacttaaataaagaaaggcaataaagtagaaaagtaactaagagaatgaaaatgagaccataaaagaaataaaaagggccacagagaagtggggaacatgggaaacaagcaaagaaggaatcatacatgcataactggagccccagaagatgcgaaacaaagcaacgggacaggcatcatacgtaagaccttagtccaagaagatgcctcaaaattaaaagacgagtgtatgtattgaaaggcccacccccatagatgccgagataattaatcagacatgaccaactctgagaaaatatctaatgaaattattatgtttcaaaaacaaattaaaaatagcttacaagagcaaaggagcccgcctggcatcagatttctcaaaagtaatagcaaagcagggcaaagtggagcaacattttccaaacattggtgaaagaaactctgcaccaaggattttttattatagagaaaatatgttggtatttctgcaaggtcatggctttctgagaaaaaattactggtaacctgggttaacggatgcctggaagggaaaccagcctagaaagactcagataatgaaacacccaggggaaggcccagtggctcccacctgtagtctcagcactttgggcggaggtgggaggatcacttgaccccagaagtttgaggctgcagtgagctatgatgcaccactgcactccagtcaaggcaacagtgtgacatatcaactcaaaagagagagagagaaaagaaagaaagagagagggaaggaaggaaggaacgaagggaaacagagaggaaggagggaaggaaggaagggaaacagagaggaaagagagaaggaaggaaggaaaagagaggaaggaaggagggacggaaggaaggaagggagggagggagggagggaaggagtgaggggaggggagaggaagggaagggaaggagaaagagagcaagaaagcaagaaagcaagaggccaggcgcggtggctcacacctgtaatcccagcactttgggaggctgggagcaggtggatcatgaggtcaagagatctagaccagccagggcaacatggtgaaacccgatctctactaaaaataaaaaaattagctgggtgtggtggcaggcgcctgtagtctcagctactcgggaggctgaagcaggagaatctcttgaacccgggtggctgaggttgcagtgagccgagatcgcaccattgcactctagcctggagacagggtgagactctgtctcaaaaaaaaaaaaaagagaaagaaaaaagaaaggagagagagaaaggaagagaaagaagggagggagggaaagagagagaggaaggaagggagggagggagggaaagagagagagagggagggagggagggagggagggaaagagagagagagggagggacgggggagaaagaaagaaagaaagaacccagggaaaaggttgacaggtttatctcccttttggtatgtgtttagatttccaagccagatgaaaatcaggaccgttactttacatcccaaagaactgtaaatctgggacctttcccttctcttctcagagaggatctgttgacattagaaaataaggtttatcttacactctcccatgggtgtaacagttcctacatcagctctaagactcataatcttcaggtttccctcctgtagagcaaaacccccttttgcacaggcagcctcctctcgctatcaccacattgtcccaggtgggcagcagtcacgaggaaccaatgccaatatgttctgtaaataaaaagtgggtctccctctaatccagaaatgttatgctcactcgtaggattgtcagtggtgttggaagcagagcgactccatcttgagtgagggctggaaaatgatgtgctcgcccgtaggattgtcagaggcgttcgaaccagagcgacttcatcttcagtgagggctggaaaatgagacggggatttgctgagctgcatcctcagaaagtgaggcattccaagcctctagatgtttacagttaagggaacaaatgaataatgtttactaaacagacccagacttgggagtgttcggctatcccaatatctagagaacaacggcattcctaattttgctttaaaggtaataatatcaatccttgcaaaatatagcaattaagaaaattaattctttatcacaaacccttgtagcagagcgcatctccccatatataccagcattgtacctagggtggacgcgttcctcctcttactttcgggaacgctctactctgtctacgaagtagctgtccttttaccactttacttccttaataagctcgcttttactttgcactgtgggctcgccctgaattctttcttgtgtgagatccacgaaccctctcttcgagtctggatcaggaccccttgtcctataacaggatgaaatagataagcatagatatacaaatatatcaatatctagtgaagcttcccttcaaatatcaaaactatggaaaacagttttaacaatacaagaacttagaacattctgaaccaggagcccttgtcttatttttttatttatttattttttttttgagatagagtctctcactgggacgcccaggctggagtgcagcaggagtgcaatggggcaatcttgactcactgcaacttctgcctcctgggtccaagtgattctcctgccccagcctccctagtacctgggattacaggtgtgcgtcaccacacttggctaatttttgtatttttagtagtgatggggtttcactatgttggcctggctggtctcaaactcctgacctcaagtgatccgcccacctcagcctcccaaagtgctgggattacaggtgtgagccaccgcacccggcccaagagcccttcttgaagaatctactagaatattaacttcatccaacccaaaagatgactgtgctccttcagcacaaggagcatcataagggcagagggtgaaaggttcataactaatgttgtgtgcagtgacaaggtaggaatatcgcaactttgaaacgctggagaagagagagggaaggaggaaaatagcatcagctcacttacggtgacacaggcaatcagggggacagttagttactgcccaaaactaacaaacccacggtgaaagtttaggtgagaaaacaggaaactaagggcacttaaaaaggataagcaatccttagaataaaaatacaaacccctgagaaaaataacaggaaagaaagagcaaagcttacacatcacatggcgaatgtcacgatatacacatattagaaaatattataacagctgacgctgaatgcatgaatctgtcttggtcctgttaggctgctctaacaaatacctacaactgggaagttcacaggcaacacagttcttggggctgagaactccaaggtcaatgtgccagcagattcgatgcctgtgagggtgctttccacgtgtcctcacaaggcgaagcggcaagcggttccctcgggccttaacaagggccttaacagggcactaatcctgttccaaatgggcagcccttctcacatcctagtacaacaccttgggagctgggtttcaacataggaattttggggggacgtgaacacttagaccatcacaaagtcatgggcttgattcacttaccacaggaaaaaaaatcactttggctcacaagtgacatccaactacatgctgtattcaagacacagctgaagtaaagtgatccaaaatgctggaattgaagggatgaacgaaggtacatgagtcatataaatgcagcaagaaaagaaatggggaccacgctagcaggcaaggtaaaattcaagacaaaaaagccttaggcagcacgaagaaggactttttaatgcaaaaagacaagattcacgcaaagatcagttatgcaacaagtaactcagggccagatgtggtggctcatgcctgtaaccccagcactttgggaagctgaggcaggcagattgcttgagcctcaggagttcaagaccagcctgggcaacatggcgaaacccagtctctacgaaaattagctgggcatggtgggcatgccttggtcccagctactaggaaggctgaggtgggaggattgcttgagtccaggaggttgaggctacagtgagccgagatcatgccactgcactccagcctgggtgacagagcgagaccctgtctcaaaagtaaataaataaaaataactcagcaaccaccttcaaggagcaaaaacacagaaactgtaaggagtcatagcagcaaactagcaataggaaacgttagcatatcactcccggagcaaggcggctcaagggaacaaaaaaataagtaaagtgggtcggcttgtgtccgccaggaagcaggcaggcgctgaagtcaggatgtaagaggtgcattaggggcagcacctacggaaggtgaaggtgaagcaggcacaggattggacaggcagagccgggggctgagacgtatgtctcacaaagtctcaacaaccctgggggaggtttaaggcaaagactgcatgaaaggcccaggtgaacaaaactggccaggtcctcatcccatgcctgcccctgccattgcctgaggctgcccaggaagaacaaggcctgctgcaagcattgtggcagccccggaaggggctacagctgcaggccattggctaactgctcctctccagcagagagacaaatgcttctggaaaggagatctgagcagctcacctccctggctgccacatagaacacagaagatctaaacaacacagcggctccagtagagccagtgggtgcattttatattcacacacacacacacacacagacacacacacacacacaatttacagttttagcctggagatggatggtggtgatggttgctgagcgatatgaatgtagttaacgccactgaactgttcacttacaatggttaaaatggtaagctttatgttattatatttcacacttaaaaacctacactaagataccttctcatatggatagaaattacaaagcatgacaatatactctgttggcaaggctgtgggaaacagtaactcttatacattactagtgggagtgtaaactgctacaagcctttaggaggtgaatttggagttgttttttttttttttttttgagacagagtctcgctctgtcgcccaggctggagggcaatggcgccatctcagctcactgcaacctccgcctcccaggttgaagcgattctcctgcctcagcctcccgaatagctgggattataggtgcgtaccactgcacctagctaatttttttttttatttttagtagagaggggtctcaccatgttggccaggttggtctcaaactcctggcctcaggtgatcctccggcctcggcctcccaaaatgctggaattacagacgtgagccaccaggcccagccggaatttggagtatcttaccaaactgtggcctgtagtcacatttccacccggctatcccacctctggggagccacacggaaactgcgtaagcccagagttattcattgcagcctatatggggaaaccctgtatatcaggcaactggagagtagtggataaaccataatacattcatgcaatgaagttctatgcagctttgaaaaagagtgataaagactcctaagaactcaactctgtgagtggcttccagatgaactttttacattataaaagcaaagagcagaacagcatctatagaatgctctctttgtgtaagaagtaaatggaaacaggaaattaaacatgcagctactcttttgtgcaaaaagaaacacagtgatatggtttggctctgtgtccccacccagatctcatgttgaattgtaattcccagtgttgaaggtggggtcctgggggcaggtgacaggatcatgggggtgatttctaaaggtttagcaacacctcactagtgccatctcctatagagttctcaccagatctgatgtttgaaaagtgtgtagcacctcccactttgttctctctctctcctacagccatgtgaagatgtgcttgcttctccttcaccttccaccatgattgtaagtttcctgaggcctcccagccatgcttcctgtatagcctacagaactgtcagtcaattaaacctcttttctttatattaacaaattacccattctcagatagttccttatagcagtgtacgaatggactaatacaagaataataaacgagaaacatataaggttgtttggctatagaggcttggataaaccaaaggagtggaaaagatgggggaatgggaacagggtagcaagtgggggagagacactgtgggcacttttattttctattgttctgacttttagaaccatgttaatgcttcacatgctcaaacataaataagtaactaaaatttattaaaagaaccagagctgcttggagaaataactggagaagggaaaaatcataatcttgaactacagaagtaatcaaaaaaatgagagggatgtgtcaaaagaacacaggggtggccaaaagtagctcccaatggcatcggctgggaaatctgtacaacaacataaataataatcacattgaactaaaatagctaaaatcagaattcatgggtctatactgctataaataattgaaggaataatgaataaatatataaattataaaaacattcaaaagaaaactatggtcattagaatttttaaaatcagtgaatagattcatagaagttaagacacagctgtagagaaaattactatctgtaaaggtctgaagaaatcatccagcaggcagagcaaagaaatgaaaagagggaagatatgaaagagcgtcaagaaggaaagaatgaagtttaccttatctctaattggagctccaagagagaatagaactgagaccatgtttgagagaccgtgtgccggtccccaaaaccacccccaaacatgagatttgctaaaaggattcacaagacccagcacattgtcatactcatggctaagatttatcacggcaaaagaatccacagaaaaatcagcaaagggaaaagtctcatggggtgaaatctggaggaaacaaggcacaagtttccaggagccctgatatggtttagatctgtgtccccacccaaatctcatgtcaaattgtgatccccaatgttggaggtgcggcctggcaggaggtgctggaatcatgggggtggatttcctatgaatggttgagcaccatcccccttggcactgtcctcatgatgatgagtgagttcttatgagatagagctgcttaaaagtatgtagcccctccccactcagtctcttcctcctgttctccatgtgacgcacctactcccccttctccttccaccatgattggaagcttcctgaggccacctcagaagctgagcagatgccaacatcatgctttctgtacagcctgcagatccataagccaagtgaccctctttcctttataaattacccagtctcaggtatttttatagcaatgcaaaaatgaactaatataactcctttcctaataatagtcacataagatgaacttaattcccccagcaacaaattgtgatgacacaggtgagttattgtctaccaaagcagctcatcagagttgcagtacccagggattccagctggtcacacaggcaccccctgcctagcacataccaaaactccaggctcccagaagaaaagcaggtgtttagcataaactaactttactatttgcacaaactgtttagagacaatgagccactcactcttgtcagttctagaaatgacaagcaccctcctgaaatccatgtttggccaaggccatccttgtgagtagcctttctaagggtgagcagtctcaggcttgccacagtcattcttttcttcacagatacaatggctgagaggtttccagaattgatgaaagacagggattctcagattcacaattcctaataagttctaggcagaataaataaaattaatcacattcctaattatatctcagtgtataactgcagaacatcatgacaaggagaatatattaagagtaaacagcaggccgggcacggtggctcatgcctgtaatcccagcactttgggagcccgaggcgggtggatcacgaggtcaggagatcgagaccaccctggctaacatggtgaaaccccgtctctactaaaaatacaaaaaaaattagccaggcgtggtagcaggcatctgtagtcccagctactcgggaggctgaggcaggacaatggcgtgaactcgggaggtggaggtggaggtggcagtgagccgagattgcaccactgcactccagcctgggcaacagagtgagactctgtctaaagaaaaaaaaaaaaaaaaaaaaaaaacagagtaaacagcaaaaaccagaagtattggtttgctaggcctgccataacaaaataccacagactgggaggcttaaacaacagaaattccttttctcagtcctggaggctggaagtccaagctcaagctgtcggtgttggcaggtttggtttgtgctgaggcctctctccttgcctggcggatagccaccttcccagtatgctcttccatggcctttcctccgtgtgtctctacctcttcttataaggacaccagtcagattggattaggatccccctcagtggcctcgtttttaacttaattaccttttatagaccttatccaaacacgattacattctgaggtactggggattgggatgtcatcctggggagtggggcacaatttagcccatattggcagataacctacaagggaactataattcagctgacttcttaacaacaacaatagaagccagaacagagtgaggaaatgtcttcaccatgctgagagaaagtatgtgtcaacctggaattttatacccaacaacattgccagtcagggtggcaactatattttttaaaacactttcaacaaacaaaaattaaaaattgaacaatcacattccttcactgaaagaattcctaaaggatatttttcagagagaaacaaattaaatccaaaggaaggagtgagagtcaagaagtagtggtggggtgctaggcatggtggctcacacctgcaatcccagcactttgggaggccaaggccagtggatcacctgaagtcaaaagttcaagaccggcctgggcaccatggtgaaaccatgtctctactaaaaatacaaaaattatccaggcatggtggtgggagcctgtaatcccatctactcaagaggctgaggcacgagaatcgcttgaacccaggaggcggaggttgaaatgagctgagatcgtgccattgcacttcagcctgggtgacagagtgagactctgcctcaaaaaagaaaaaaaaagtagtggtgaggagaaaatataaaatatgtaagtaaatccaaatgagattaatcgttattaaatgatgataaggacaaattttgtgatatgaaaacaagaaataagatgaaactaaaataacagttcagaaaaacacatacagaatagtataattaccattcaaatattccaacgtccttttaatattctagaggattgtatagattttgattgcgtttagactttaagccaagtatgcatgtatctactaaaaataaaaacagaatttggaaagaaaaaggaagaaggaaaaaaatgcctcagccccacagaaaacagaaaacgagggagaaagaagccaaggaaaatcacaagaaataaaaatcacaaaataaaattgcagaagtgaatccaaatgtgtcaataaatatgaataaactgaacttgcaagttaaaatagagcttcgacaaaaccaaatccagctatacgctttcctaagagatgcaaaatacagaaacaccaacaatttaggtttcaagaagaaattttaaaaattagcaaatactttattctctttaagtttatgaagttatattaataccaaacaaaataaatgtcaagtaaaaaagcattagtaaagattcagagattaccgtagaatgacaaacatagctcaaatatataaataaaaaaggttcagattacaatgaaaaattgacaagttgacatcagagtggaagattttccacttcacaactgaaaatcataaaaactaataaggatcagaaagaagagaaaagcacagtgaagcagcacagtctaaggagatgcagctgaagtaatgctgggaagggaaatatgtaacctaaaactgcacatattgtaatataatagatagttaaaattcttgagttaagaatctaaatcaagaaacacgaaaccagccacaccacaaacccaagaaaggaatggaaccataaatgtatgtgcagaaatgaatggaacagagaacaaaaatcgctaagaatgactggccaaaactagatttttttttcttttttttcgaggcagagtctcactctgttgcccaggctggagtgcagtggcatgatctcggctcactgcaacctccacctcccgggttcaagcaattctcccacctcagcctcccgagtagccgagactacaggtgcgcgccactacgcctggctgatttttgtatttttagtagagacggggtttcaccacgttgcccaggctggtcttgaactcctgacctcaggtgatccactggcctcggcctcccaaagtgctgggattacaggtgtgagccaccgagcccagccaaatctagatttttgagaagcaaaatggtaaaatagactaacctgtctgtaagtactgttttagctgaaccccacaagttttgataagtagttattatgcaaatctaaacattttctaatttcttttatgattttgtctttgaaaatgaattatttatacgtgtgtttttcatttgacaactatggattttgttactaccttttgttactgatttccaagtttaccacagtttgatcacagaatatggccccaacaaaccactttttggtatttttgaaatgtggccaacttttgaaaatgccccatgggtgcctagaaagcatgtgtggcctgggattgagtgcagttaccccaggtgtctattcaaacaaacttaattgtgcttttcacatcttccctatccctgttcatttttatagttgtcagttatttgtgactgccgagcacttgaaatgtgactggtacaactggcgtgagaagctgaattttaaatgttattcagtgttagttcatggaatttatttatttttttattttttttgagacagagtcttgctctgtcgcatcggctgagtgcagtggtgccatctcggctcactgtcacctccacctgccggcttcaagcgattctccttcctcagtctcccgagtggctgggattacaggcgccaaccaccatgcccggctaatttttatatttttagtacatgttggtcaggctggtctcgaactcctgacctcaggtgatccacccacctcggcctcccaagtgctgagattccaggtgtgagccactgcaccctgccagttcatgggatttaaatagttccacgtgcctagtggctacagggctgcacagtgcacagggcaggcatcaaagctgctgttgaacaagcggcatggggaactttggctttccgcacaggatgcattaaattcaattcctgcggggcgtggtggcttgcgcctgtaatcccagatacttaagaggctgagacacgagaatcacttgaatccaggaggcggaggtggcagtgagacaaggctgtgccactgcactccatcctggtgacagagcaagagagtgagactctgtctcaattaaataaataaattaattaaattcctattctataccacatacacattaaattccacacggatcaaagactaacaggtgaaaagcaaaactataaaacttttcaaagaaagcttgggagaatatgcttgtgatattgacgagcaggatgatttcctaaacaagtcacagtgttaacaaacaataatggaacatactgataaatttgtctggattaaaatgtaaaatgtctgaaagtcaaaaacagactacaaagcgaaaggcaaacacagacttggagaaaatctgcaatgcacgtgactaataaagaattggaatccaggatacagaaagaactcctatgaaagtcaattttaacaaaaaagacatccaacccagctgaaaagtgagcagagggtatggtcaaggtcattgtgtccccagctcttcacacaaggcacactgggcccctgccaccctccagccctgcctgactcctcccgggagaggactgagccaccagacaggcaggtggcaggcatgggtctccacctctgtgtcatggaagaaatctcttcaaaggccatgcgctcaggacctgggctcttttctcctctctctgccctcaacctttgcaaagcagcaaccctggagaggctgccggctgtgcctcccgacgcgcctccaggtagaaggccccgccacacaccctgtgcataacttggtcccctcctccgcccttgctttgcagtgtagagggtgatttcccaacacctgtagactctgatgctcaggcttccccatcctactcagatgagggacgccagagggtctttgctgatttcctgaaacctcagcaggaaggcgcaggttagtctcaaggagaagaaccaggaccggccaacgcacccgtacagcactgctccaggtgcacgaaatgccaactggaaaacagagaagctacttcccagccaccggcctgggagcacccatggagcacgggggtcagaaactcctacttcctccacgggtggggcaatgggatgcagctgtcatgcttgatttattccagagggagctgtcaacaacaaatagcgcacaatgtcggcctgcgctcttgcgttattttctgcacttctgtggaggccagtcgtgtcgcaccactgaataacgtttccagtggaatataccacaaacggccacagagctcctcttggtcttgtttatatgcctgttttctgaatgtgcttctgtgctttgtacagaaaaagagtaagatatttggctgccaccagggccaatgtttgccccatgggagtgacattgccactggtgagaacaaagagccccttgcaacacagtcacgtctggatggcctccgccattgcgctggggccaggcaggcacagaaatggcagcagaccagggccttcaggcccagctgcccctgacttagcctgaggccctgcagtgccaacagcagaggcccccacggtgcgaggcagccgtgctgccagggcgggctccagggagctgagcccatgaccaccagccccaatctactgtcctgctgcctcccacagctacgcagggttcccccaggagcccaccccttgctgccgtgaccaccatcgcttcctagctgagagcccacccttgctggcctctgcctggttcttgatgaattcagccccatccatccttccctcctggcagcctgttagtggctctggggaagctggcactgattaatgacagcaacagacgacacccatctgcccatcaggtgaaaactcgccgctgtcatctgtcctgtcagaatctacgagcagcatgggagcccgcctggctgggaccccgcgtccctggccgccccctggcctgaggttccaagcagggcctcagactgatgtggggacagatgagaccggtggggccagaagggctagctctgagcctgccgggggctgaccaggagccctgtccccacagggcagctgcctttctcagaccactctgaggtgagcagtggaccccgaaggtgggctgggtcccctgccttcacctcctcccctgtcaggccccccgaatccgactgacctgggtcagctctgccacctgccctgttctctccagcgcacccagggcctcgactgagccactgcccagggtcctgctgtgagtggaccggaaccagcacgggctcccggctaccacctgcccaccccgccaagctgtcccactgggacctgacagggaggagcccacactggcacgcctgacaacagccataacctttcctgtgctgcagagagggaaactgaggctcagcaaggccagacaatctgaccgagcactggcctggcctcctgaccccaaaatctgtgcccctggggaaagagaagaaagaggtaaacgcattctacagcgcaatccccacgccaaggggtgtgttcccctgcggcagggccctggggtggacatgaacacccaggtaccccatggcctgctgacctcaaaggggagagggcccagctccagcagccctgccccgcaccaccccagagggagcccagagatgggttgtcacggccaggacactacagggagggccaacgggaccaggggcttcaagccgacagcttagggggtgttttctctgcagaaaacccctctgctccccagcggagaagctgtgcctgcacctgggatctgctttgcatgtagagggggcagtagccccacacaggaggggctgacagggccagagcacagccgagacgccgcggcaacccacagaagattccaggacacaagcccacagcccacggtggactgggcaggggagcagtcgtgggctccacacgtcccagaacgccaagctgcctgaatcggggaggggctgggggtcggcacacacaggaggcaaagggcatggaggggcatccccaatcccatcaaccccgaaagcccccgggggccggcctaggcgccccatggacctgcagttgatggggcctggtgcacgcccggaggatgggccctcaatagcagcatgaacaagtagcccggagccaggagatgcacctgccgccccagggaagtccccgccctgggagggttggggtgtggcagccagtgggggtagcttcagcttcatccacagttgaaggatgtctggaaggtggggaaggaagggcctcgcccgcaggactggccgggcctgccaggaggttggttcagtctcgccctgctgggggatgcatcctgagtggagggggctttccagcctgcaagggtcacacaggaagcctagggtcactggtgatgagaggacagggctccaaggggctgggccatgtgaccctggccccacatcccctctgaggggctgggccgtgtgatcctggccccacatcccctcaaggggctgggctgtgatcctggcccccacatcccctcaaggggctgggctgtttgattctggccccacatcccctcaaggggctgggctgtgtgatcctggccccacatcccctctgaggttgaggtgcgaggattccacgcgtgtcccctctcctgccccgcatcctcacccgtgctctaccagcatcccagccccggctcttgcacccatccctccatcctttcttccctcccgcctccttccattccaactgtgtgagctagcttgggcaccgtgagtgcgtaccacccaccgggggtttaaaccacagacacctcaccgtcctgggggtggagatcaggcgcagtgctgcactggggccccgggaagcagaagacggctcctggcacatctcctgggtgcatctgtggattgctggggcccccagcagctctcccaatccccagaaacccctcctggatctgctgtatccacctggagcctcttggtgcacagcggcacacacaatacctccactctccaccccgaaggatgcccactgcagcggggtcctcatccacccagcctccagccaccccatcctagggccaccggggtccccagccagcttctaattgtcacccacggccagtgctcttggctctggaggaaggagatggaggcttcgcttgacgttcattcctcatgggtgtggagaggccccctccagggccccttcccctcaccccacccggcaaccagaaccgcgaatacttcacacggtactttgaatttaatggttcacatgggctcctctctgagctactgccttttattttatgactaaattaatattatacatacaagagcacatttaagacacccgccagaggagcaggaacggtggtcgtgtgggaaaggatacatttttacgcacacgcgtctccgggccattaacgggccgcgcgtccatctgtgtccacagctgaccttaatcctgtcccagcgcctggggcctgaagctcgtggaatcacccgcctcacgtgtctttgcggcccactaatttgtgcgtgttcaggatatattgggtttcataatttttatatgcaaatcaataaaaagccctttgctatctcatttaaatcagcgaataattaaccaggctgtccagcccacctccattctcctcaaatccctggaagtgagaggggccagcactgaccaggagagcagggtcccagggccccctctggacagactgcccacacagtgggcgctgggtctgctggacccaggaggcctggggggctgaccacctcctccgggacatggtcagagcaatggcctgagccagccctgcgaagaccctggctccgagagagcggggacagtgacagtgcttcagacagtcacccactgaggaacgggcaccacccgtcgcccgagacctgtgtcgccacccactgaggaacgggcaccacccgtcgcccgagacctgtgtcgccacccactgaggaacgggcaccacccgtcgcccgagacctgtgtcgccacccactgaggaacgggcaccacccgtcgtccgagacctgtgtcgccacccactgaggaacgggcaccacccgtcgtccgagacctgtgtcgccacccactgaggaacgggtacgacctgtcatccgagacgtgtgtcaccacccacgcactctgcactccaaggctccacacagagaaacaagggcgtcggggatgctaagtccaaatgcgattcaggggagcccagctctgggagtggggcatcttagggcaccttcattctgtgattttgctttttttccctgtttatggatgcgtaagagtgagctatgataaaatcctatgagtaagtctgatagctctcccatgcatgtgaagtggagcttctatgtgataaagcactgtgtcatagttttacaggcagcattttttctttcttagaggtacataaaacaacagcgcaccttataatcagcggcattcaacaaaatggttaaaaaataataccccgcagtccagcagggtctatgcaagaggaggaagaatggctcacattagatcagaccctcaggtgactcaccagtctgctacaaggactaagggccaaaaaaaccgcatgaattatctcaatagacacagaagacccatataaagttcaacacctatttataatttctaaaaactctcacaaggctacaaataaaagagaacatctttaacctgaaaaaacctactttccagaaacccccaggaaacatcagacttcacagagaaatctaagacacaatctcttccagactagaaatcaagggcgacccttatcaccactcagtttaacataatctcgaaagtcccaggaaacactgcaaacaaaaaaaaaaaaataagaaatgaagaggtgtaaggactggaaaggaagagataaaactgtcacgactggtggataacgtggccatctatgtagaaaatgtcactgaatcaacaaactactgggacgaacagttacaagataaacctacaaaaatcaataatgtgactctatggcaacaataatcagccagaaaataagataccattcagcaactgaagcaattaagtggataggaattaaattaccaagggacgggctggccgttcgctaagaaaattctggaactcagtgaaaggacccagccaagccactgaaaggagaaggcagcatggtcagctcgggagtgaccagcagcacagcccacgacgtcgccaaattagcttctagattagtgcaacgcaaagcaaagttccagcaggcattttaaagacacccgaccacagccctattctcggcacgtgatggaagaaggggcgtccctgaatgacaggctgattgaaaagccaagagaaagggctcactccaccagaatgaagataaactatgaagccatggaaatgaaagataaaaataaaagccagcacgctgccggtgacggagcaagcccaccctgaacagactcagggacgtgtgggaactccttaggtaaaaggtgactcctacaaatcaaggagaacacagcgtaggggaaagtggctcgttatacggagacaaaaagtcacgccggccgcagatggactaaaggggaaactgacaaacacagcagggaggctaggcagggctcggggaggaggcgcaccctcaggaccgtgttcacgcaaccctagcaccaaagaccaccagtaaccaccctccatgtccgcaccaaagtcaacaaaagaaagatgccccctgaccacagatggagagtgggctgaagggagcctggggaccccgctgggctgtcccctgaaagtggcaccaagcctgctggaaggcatcatctgctgggcccgaggcccaccccagacaacgccagcactctggacccctcctgccagcactcagccaccccctgcccactcagtcttaccgaggtgtgcatggccgacagagttcaggcactgactttgcagctggagacagggccttgacctcagggactttggaggtgttgggaccggtcagtggggacccattctgtgggacttgggcatggagagcaggtgcgggccaggatgtagctggggccacgggctgcacggggggggcctcaggggcaagtccagggattgttccagcccccactcccaggtccccctggagaccccacttccctgatggccaaccgcagtcccagcttcaaacaggttctttgagggggaggagaagcaatctccttcatataaatgtttaattgggaattaatatggatgaggctctggagtgatgaggctgtgggtttaataaatattaacaaggaataggcctccccttcctgtgctctgtgctaatccctctgtgtagcatccattattcaccgtgtttctcaacgccaaccccggggatgggggtggggtccttcctcctggggctccttccatggaggtactttgaatccctggcctcgggggctgagggttctactacaggatggatggatcggctttctgtgggtgtggaactctgaccacaaggacactcactggcccatcttccattggcacagacacacactcactgaccaggaaatctatattccagccttaccttcagccccactgggctcctgccactgatgccacctccaccaggaagcccacctggtctgcccacagggagcagcacccgtccctcagggcagccacaatcctctctcctgacctggcaggggctcggagacccagcgaccccgcccagcccgctgcaggtgggctgctgtgaggggacccagttctctgattggactccaccaaggggtccagaccctgtccacactgctgcctggccgggccgcaggtggagctccggcgccctcgtgtggcccgtgtgtgcaggacctcagccgtgctgccccatgggaggatccagggagccgagcacaagatcagcgattacccaggtcacagtcccaggatgcacagagcccgcgtgtggcactaggagcgagccccaccctcggcttgggtttgcacggtcccggcagtgcactcgcttcataacctgagaacgtccctgtccacacagaggaacagccctcctgcctgagcttccacccctacactggtcaggccccctctgctgcagctgcccccggaattccttgcagggattgaggggtggagcccgggacctctgctgcccaggcccactgaatattgggcagcccaaagccctgaccctacctcccccttggctcctacacacccctgggcacgtgtgcctaggggcagcacagcccctcccatccatgggatgccaaccccctctagtgatgcccaccacgtgcggggtctcaaaggcccagtcctgtgccctgcccaccctcctcatccctagtgaggatggccccccatccctggtgcgcacggccccccatccccagcatggatggctttgtggccttaacgggaccctccatgaatctccatgggaagtacaagacccatcccctagtgcctgctccaccctcggaggggcaggaccgatgggtttctgtgcccactccacccctttatctgttcctcctcccctggggccccaccaaagccacgaggaggggaggcaggggaaacagcccccattggctcctgagttgaccccagcaaagcacccacacagaggcagaagcggggggtcctaagaggccagctgtatccaggggcttcaagatgccccctgcactcactcagcaccaccctcaccccacccagccgggccggacagataagggcctgggccacgggtcaggagcagagggtgctgggggcacagacctgtgagggtcgtgggggtgaaggacctcaggctggaaagaccccaatgagtgagaaagccagatccccatccttcccagcccccaccgtccccactgcccccactcaccccccgcccaggtatcccctgagaaggcaggctggggagacagggagaggacagttagggtgaaggggaccagggctgtgctggggctgggccgctctcactccatcccttaagccccttcctctctccagcctgccccctccacacccagcctgcccactcccgccacccctccctggcatcccacagctgtgaccacagctgggacaccacggagcactcaccacagcactcggagcagccaaaccctccccttggccacaaggaccttcccagtggccctctccagtctcacctgcaagcacccctctgcttacgctcacagaggagtgaatgcgtgaaggccccacggggtgaatgaatgcgtgaaggccccacggggtgaatgaaggagtgaaggccccatcaggtgaatgaagtagtgaaggccccacggggtgaatgaatgagtgaaggtcccacggcgtgaatgaaggattgaaggccccatcaggtgaaggaatgaatgaaggccccacagggtgaatgaatgagtgaaggccccacggcgtgaatgaaggattgaaggccccatcaggtgaaggaatgagtgaaggccccacagggtgaaggaatgagtgaaggccccacagcgtgaatgaaggagtgaaggccccatcaggtgaaggaacgcgtgaaagcctcatcaggtgaatgaatgagtgaaggccccatcagggtgaatgaatgagtgcaggccccacagggtgagtgaggagtgaaggtggctctgcagcctgcccggggcctggtgagtctcacaagccccgcattcgcgcggcctggtctttgtccagcagagtctgagcagagtcccctccgtctgccctggccctgggaccccctctctcctcgacccaggggaggagtccatgctcagcccagggctgctgggagatgaacccgactgcctgtggctgcacccctgtgtcagccaccactgcgggtttcaaggctgaagctccacttccttcctcccagaaagtctcagcacaggactccatccgggatccctcaaggtcggaacggccccgggcccacagggtgggccttgtggagacatttctgccaagatggaactgagagccgtctcggtggtgggagaggacagcctgcctggggctcggggggaggaagctgttctcggggccttttctgaccagctctgagcactctctgggaccaaggcctctggagcacggaggcctgggggctgtgctggtcacccacacacaggacagcccctgagccagagacagccatgctcagaacccagagaccagaggccccaaggggaatggcaccctcccccacacccaacctggtcaagtcagtggagccaccgcctggcctggggctgggcagcccacggtggtcccagaggaggagagttgccatgtagtgacagccccacagaggggcacatggaagcacccggaccggtccgaccccagaaaggctcaggcacttgggtgctggaagaggtgggagaggcaggactgggctgcatggaggacgccatccacggccgcccctgggcagtcaccatggtcctgggcagttacacctaccacaggggaccactggctcagcttcctccccacagcgttcactcctcaaaatccagctctggcgaccgctggtgcttccgcagacttaaggggaattgtgttatgaaccggaagggaatttctctgctttggaggctgggtgtggtggctcacgcctataatcccaacactttgggaggccaatgcgggcggatcacaagttcaggagttcaagaccagcctggccaacatagtgaaaccccatctctactaaaaatacaaaaaaaattagctgggcatggtgacgggtgcctgtaattccagctactcgggaggctgaggcaggagaatcacttgaacctgggaggctggggttgcagtgagctgagatcacaccattgcagcactgcagcctgggagacaagagtgaaactccatctcaaaaaataaaagaaagaaaggaaagcctaaaggaagcacaggaggccgtccgtcagtccggaagcccaccccagagcccccttctgggatcttgcattgtgcagagaggtggcaaggccccgtgcccctcccccacctgctacccacccgccccccagcctcgtgtcctgacaagctggcctggagggtcagggaagggtcttgtgtcaggttgctttgggtgctggtgcccctccccaggacagggaagggcaacgaacaaaaatgtgggtgggaccggcatcctgatgctatcagggtgacacggcccagaacatattcccctttatggcctccctagagagccaggccccatcccttcccctccaccagctcctcacgctctggagggatcacagacctaaggagagccaggtccccaccccagggggctctaccaggggagttcaaaaagaaagagaagaaggaggtggcattgtgggaatattaccatcgtacttcgccttgaaggtagatttcagggcaaaagtattaatggaacaaagagaatattctatttaggtcagaagtgtaattcaccctgtcggcaagcccagggttgtgtgtttcacccagacattggtctccaaggagagaaaccctctgcgatccttctaattgcacttgtgcaaatgctacacgcacgtctccctgagctgactccaacactcattcattcctcctgtgcctgcaggaaagccagcccgggcatctcagaatatgaagttaatgtaggagaggccagtggtccagaatgtgtaccaggattctccagagaaacagagccaattggatgtgtgaacgcctatcttcgtatgcatatgagagagactgattgcaaggattggctcatgcgattacagcactgagaagcccccagatctgcagtcagcctgcgggagacaaaggggtcagtggtgtcagttgtaatccaaggccaggagaagacccacgtcccagctcagtcaagccagaaaagctcactcctactcagcctctttgttctatttgggtcttcaattgattggatgtggcacccacactgggaagggcaatctgctttgctcagatggcaaatactgcccagtctgtgaggctccccgaggcccagccgaaagcagacctctccccgggctgcccccacagccaccctgtgcaattgggcacctgcaacctggacttggcagcagtcagcattggagccatcgactcaaaagtctcagcacgtggattaggaactgagcactagaaatccacgctgattatttcatgagacttgagcccttctctcgctaccagccaagcagcacccaggcaggcccagaggacagcaaatcttggagctagagaacgcccagcttgagcatgacacaggcggtcatcacggtgctctattggttcctggtcttcagggttcattttactggcgtaagaggccaggatggttgcttttgttttctaaaacccttaaggagcaaaatcccacacaatcttggaggaaattaaatttagaaattagatgctaggcttggcagagaccttgacagggccccccacagggccagactgacacatccattgagaccacatcacagttattaaccttttgctccaaaacatatggaaaaaagctgctagaaacacagggagaatcttcctaaaccacagtcacagtgggagacttcaacacacctctctcggtaattgtcagatcaaagaatgagtaaaggaaaaaagaatattaatagaacaattaaccaccataaattaccagatctacaggacttcacactcaacaaagaaaggaagtgcattcctttcgaataacaaacaagtgaaaaaaacagcatgttcaagatccccaaggaaatcccagtaggtccctgaaggggaaattgtgaaactctgatcacagtgcaataaaacagggaactaacaacagatcaccttctttaaagtcctcacctcttgtcagcttagacgtgggatagacactacgtctgacacgttttctacttacaggctagatgactctgcttcctcatcggcggaatgaggaccaggctgttacacgtctctgtattctgcaagttaaaggcagtgaaacacttaatatccacagcacacagagcgtgacacacacagacagcactcagcgaatgttagctgccaatgctagcgtaagacgagatacacactcttctgaatgactctgagttagaggaaatgaaacatcaaattagaggctcaactaatttgataacaagagcaccacacatcaaaaaccctgggacgcagccaaagtggctctcaaaggacaaagtatagccttaagtaattcttttctttttttgagacagaatctcgttctgtcacccaggctggagtgcaatggcgcgatctctgctcactgcaagctccgcctcccgggttcacgccattctcctgcctcagcctcccgagtggctgggactacaggtgcctgccaccatgcccggctaatttttttttttttttttgtatttttagtagagacagggtttcaccgtgttagccaggatggtctcgatctcctgacctcatgatctgcctgcctcggcctctcaaagtgctgggattacaggtgtgagacactgtgcccagcctagccttaagtaattctaataaaaggtaagaaaggatgaaagtgtgctttcatttaagaaactagaagaagaaagaaaatatgactcaaaagaaatttaggagagcctggaatttaggagagcctggaatcacaccctgattcctccctctctatctcctccccagctgtagtgatgtcacttgttattgtattgttgggctgtattattgtattgttcctcacaaatagggaacacatgttacttccaaactctaacagaaacaggctttacatgccaggagtcaaccccaggcctccacagcacaggtattcacactcttcatgcccactcacatgcagggcctccaggagctcagccagcaacttctcaagatcagggacattggaggggcagccagcttggaccaggcggagggaccaccacgccaactccgcaacccaagccttcttccgcagggctcttcaaacatcttccctactattttattctgaacctttgtaaacacacagccaagttgaaagaattgtacagcagacaccatctacctccttctagagtctcccattaacgcatatatggtccaagctctgccctggttgctccctctccccaccagctatgcgtccctcggccgtctttttaaatatgtttcattttattttgttttattttttgagacagggtctcactctgtcacccaggctggagtgcagtggcgtgatctcagctcactcctgggctcaagggagcctcccacctcagcctcccgagtagctgggcttgtgtttacaggcgccaacaccaacacaccagctaatttttgtattttttgtagagacggggttttgccatgttgtccaggctggtatcaaactcctgagctcaagtgatctgcctaccttggcctcccaaagtgctgggattacaggcatgagccactgtgcccggcctcctatttttttttttctttttttgagacacagtctcactctgtcgcccaggctggagtgcagtggcataatctcagctcactggaacctctgcttcctgagttcaagcaattctcatgtctcaaccttcctagtagctggaattacaggcacccgccgccacgcccagctaattttttttatttttagtggagacagggtttccccatgttggccaggctggtcttgaactcctgaccgcaggtgatccatccatcttggcctcccaaagtgctgggattacagccatcagtcactgtgcccggcccttagtacattttaaagtaaattgcagtctactccctctgagcccttcagcaggcagattatagggtgttatatgtaaaaatgtttgtttagaaatagaatgctcgttccccagtgctgcaaagaaacagcacttgaacataaatttaattctctcagtaaggccatttttactttctgcagaaagggtgcccatcgcaaatgcaacaatggcgagagcacatctgaacaaaggagggaagcaatttttatcctgtacacagtttgtccctggtactgtgtcctgtctccattggctggagccaggcctcacaatctaaactaaaacccaactggctaaaagtttaaaacttttccaaataggtaaaagtaatggaaagacaaaggaaaagaagaagttgcttttgccaaatagggaaggggcataggctgtgagctgggatatgcctgcgagcacgtccggtacagatattttggttaaagtacaaagacatggaatgtattacgtgcctgtgagcatgtttaacagctacataggatagggcttcacaaagagttactagcacaaagcaaggagtcttgaaggaagttagtctctaaaagaaactattttttttaacacgatttattctttaacaagaagggaaactttgaagaggaagttttacttcctacatagggaactgaagttcaatattcatttatgatttactggggtcttaccctgtcacccaggctggatggagtgcagtgtggtgcaatcgtgggtcactgcagcctcaacctcccaggctcaagtgatcctccctcctcagcctcccaagtagctgagactacagtcatgcaccaccacaactcggctaattttttttttattttttgtagagctggtgtctccctatgttgcccaggctggtcttgaactcctgcgctcaagtgatcctcctgcctcagcctcccagagggttgggattataggcatgagccacagcacctggccccttttctctatttttttttttttctttgagatggagtctcactctgtcgcccaggctggagtgcaatggcgcaatctcagctcactgcaacctccgcctactgggttcaagcaattctcctgcctcagcctcctgtgtagctgggactacaggcgcccacgaccacagccggctaagttttttatttcattttattttttaggagagatggggttttgctgtattggccaggctagtcctgaactcctgacctcaagtgatctgcccaccttggcctcccaaagtgctgggattacaggtgtgagccactgggcctggcctcctttttttctttaaagtaaaatttacatgtagtaaatagtatttggccataaagggaatgaattactgatacatgctacaatgtggatgaactttgaaaacagtaagctaagggaaaagaggtagacataaagggccacccactacacaactccatccacatgaaagtccagaagagagaaatccatagagacagaaagtaaaggctgggcacggtggctcacgcctgtaatcccagcactttgggaggccaaggcggtggaagccctgaggtgaggagttcaagaccatcctggccaacatagtgaaaccccatctctactaaaaatacaaaaattagttaggtgtgggggtgcacgcctgtaatctcagctactcggctgctgaggcaggagaattgcttgaacctgggaggtggagggtgcagtgaccactgcactccagcctgggtgacagagcaagactccatatcaaaaaaaataataataatagattagtggttgcctagatgacttctaacaaacgcatacacctacgaagagggagaacaccaccaccaatccagaatgttccctcatgccctctcctggcaaagccccacccccaccctaccccaaaagacatcccctggtacgatttcttgcctgttctagaacaccacataaaaggaatcacagcaggtcctgttctgtggaaggtctcttttgctcagcatcatgtttataaagtcatccatattgctgcacggatcgctggttcatattgatattcattagataacggttggaccagtcctcccaccctccctcccgccatctctctctctctctctctctctgtctccctctctctttctttctttcttgagatggagtctcgctctgtggcccaggctggagtgcaatggtgtgatctcggctcactgcaacctccgcttcccaggttcaagcaattctgcctcggcctcccgagcagctgggattacaggtgcccaccaccacgcccggctaattttggtatttttagtagagacaggttttcaccatgttggccagtcttttaaatgaatccaacgaaatctaaatatcatggtgatttaatcatcaatttttaagagacaattttttaacagacttaaatgttttctcctttgccttgtattttccctccactttgcccacagaattttatgccaacatgacatatcttctgctccaagtcctccgctggcctcactgtgcttttccgtaatggaaatatgtgtataaattgaaatgccacttttcattctttacttcataagtctcttatctttaaatgtttctactggattcattatttttcaattattagcccacagttcctcaaaaccactgattgggatataaataatctatattatacattttgattaaaaattgttacacagaaaaaggaagttttcattggggatgcatctcccgatgaaggggacgggcttttttccgtgtagcccctgtttccatgggtgacgacgacttgttgaaaagactcactatcccgcgtggaatgtcctcctgctttttgggttttaggggctagcactgagcgtctttgttcacacgaacaagtctacgggacaaaggaggattggggcagcacttccgcaaacctgagacgggccaccgggaatcgctgctgcggtcgggggctgcgacgccaccagccccagggtggagagcggctttctgggcgtccgggcaagtccatgctccgggtggggaggccgaggggccgaggaagtcgagggtctggacattcgctgccccggagccgcgtgagcccgccccgccctggaacgtcctcccaggcgttctcgcctttgcagcccccgcctgactgcggaccctccactccccactctctccttccatccccgcttccctctccctgcccctcctcctcccccgtcgtcagccttgacaaaggagggcgatgccaccgcttaccgccagagggcgcgccgcgccccccaaacggacactgaagcgggcgccccctggccgagcggggcgcaggggaagagggggcggagggggagaggaggtgcagggacagagggggcccagggggcttccagcctcctgcctgggtcctggtttggttgcccccgcaccacccagcgcttgcccaccctgcctcagtctccccatctcccagcctcggggctcctctggctggctggggcccaccctggggcagagccgctgggtctggggatgggtagcatcaagatgcctcgaagtcctggcctggtcttcaggctccctataattaggactccacccccacccctacaggagcctgtccagaaggtcctgggcgtggctggggtgtcgtggacacctgccatctttcctgaacgctgcagacacctgcgtcccactccagtgcaggtggcctgggccccttcaaggaatggctgggagtgggagggtgggcctggggtttcacggcccacacctgaggccagtcacaccccgactgggccaggcagaagctgcacaaacttcacactggaaaggtggggccaagggcagccccagcccacctgccagcacctccccatccccagcatctgccgggcacagtgggggcacacctaacctccccacccctacccactcttgacatataaggcctcagccaggaagtccagaaggagggcgtggacggggatctgcactggaggcctctaccacctgtgaagccatcgggcctgtgggccgcagggcaggactcccaggtctggagggccctcaggctggcctccatgaggtgccgcgaggctggggtacagagctgagtccccacagccctcacctccctggcccctgcccatcacagcctagctcctcctggagccacctcacctccctgggcctctgtttccccctccgtagagcagaggtgttgacggctttcgcttggaaggctaagccagtctgtctttgcggagtccacgtgctgccagcacacagtccatgctccggagtcagcatcccaccacatggtggaggggatgttctgaaacccctctttgaaactcacagaacctggggacaaagcggggcagcgttttgtcagtgagaagtggccgcaggaggggcccagtgaccagcaccaggtacaggagcagacccacggcccggcccacaggcaccagacaccctgggcacaaccgggcctgggttccctctgacatggggcacctggacagatacttgagcacagccaggccttcagatgacagccatccccgcaagcatctgaccacgtgcaagaccccgcacctgagcttcccaaatgagcccctcctaaatgccaactccagaaaccatgaaataattgtccactgtttacgcatcggagccgctggccatgcagcaaagggaccaagctgctggcgcgcacaggttcatctcccagtggctcctgctgtcgagggctgcccccctgctcccctcctgcagggcttgttcccagcaggtgcatcctctagctgggcctggagacccggcgccacgtggcacagcggtgactctacagcgccctcgtgtgcggctctaggtgctcccacccgcctctctcccggctcagcctgggcacctttctcctggtcgctgtgtcccagcactctccccttaggaggcttgggctggcggttgtgaacgtttccgaccgggctgtcctggctccccaccaagtgtgtgtccacccctcccaccatggctgctccccacgttggctcagggagcccctgaggaggtccatggcgtcccaagcccaccaatgcccaccactgctttcagcttcctcgtgctcgccagccaccaggttggtggtctcttcctgcccactcttattttgtgttccaggggaacatgctgccaccaggctttactgtggacagtgtcctctgtgtctccggttgtgcaatctcggtggctcatgttttacaggggggttggggagagccaagcccgtgatcacttctcccgcatccttctccatatggagaggttacgatatctagcctcagaaccacagtcgtctcatgctcaaggcctgtgggccaggaatcccgagctggtggtattgagccaggaatcccgaactggtgatatgcactgttgcttttccaaacagaaaaagaacaaaaacttgtagtccaacccagttgactccttaaactacctcttcgaaactcacagaacctgaggacaaagcagggcagtgtgtttatatgaagttgataaacttaaaagacagctgtgaagccatgaaaatccatggaagaaccctaaatgcatattactgagtgaaagaagccagtctgaagaggccacatactatatgattccaactctaggacatcccagagaaggggaaattacggagacagtaaaaggacccgtagttgccagggttagcgggggggaagggatgaatcgcagagcatggagggtgtttacggtagagagggcaaaccggtgcagccactgtggagaccagaatggcgatatttcaaacagtatttcaaaaacttatattagaattgccacatcatccggacatttcacttctgggtattcgcccaagaactgagtgcaaggacttgaacagatatctgcacacccgtgtccacagcagcatcattcaccaacacacgaaggtagaagcagcccaggtgctcacggatggatgaacctggtgtatccaggcctggcgcggcggctgggcgaacctggtgtatccaggcctggcgcggcggctgggcgaacatggtgtaaccaggccgggcgaggcggctgggcgaacctggtgtatccaggcctggcgaggcggctgggcgaacctggtgtatccaggcctggcgaggcggctgggcgaacctggtgtatccaggccgggcgaggcggctgggcgaacctggtgtatccaggccgggcgaggcggctgggcgaacctggtgtatccaggcctggcgaggcggctgggcgaacctggtgtatccaggccgggcgaggcggctgggcgaacctggtgtatccaggcctggcgaggcggctgggcgaacctggtgtatccaggccgggcgaggcggctgggcgaacctggtgtatccaggccgagcgaggtggctcacgcctgtaatcccatcacatggaaggccaagacgggtggaccgcttgaactcaggagtgcaagaccaacctggccaacaggtgaaaatccatcaatacaaaaaatacgaaaattagctaaacatgctggtgtgcgcctgtagtcccagctactcaggaggctgaagtgggaggattgcttgagcccagggaggtcgaggctgcagtgagccataatggcgccactgcactccatcctgggcaacagagcgagaccctgtctcaaaaagaaaaaagtggcgtatccatcaaggggaatattatccagcctcaacaacaccaacaacaacaacaaacacaggaggtcctgacacaggctgccacacagctcaggcttgaagacattatgctgagggaaagaaccgacacaaaagggcaagtgctgcctgactccatgtttgtgaggctcccagagcagtcaaaaccgcagagacagaaagcagaatggagggtgccaggctgggggaaggagggtgtggggagtttgtgtttgctgtttcagagtttccgtttgggaaggtcaaaaagttctggagattggttgcacaacaatgcgaatgtacttactgccactgaacttgaactgtacctggaaacatgggaagacggtgtggaaacaagcccccagtcagctggtctggcagctgatttgatgcagatcaagagggaagtgaggaatcgatagggaagactgtgatcacccctaatcggcacagacagataggaggtgttaagggggttcagaagaggttaagacataggagagatggataagaaggttttccgtacttccgatcgaaattccagaggggctgggcacagtggcttatgcctgtaatcccagcactttgggaagccacggcaggtggatcacttgaggccaggagttcgaacccagcctggccaacatggtgaaaacatatctctactaaaaatacaaaaattagccaggcatgatgacgggtgcctgtaatcccagctactcgggaggctgaggcaggagaatcccggagaacctgggaggcagaggttgcagtgcagccaagattgcgccacttcactccagcctgggcaggaaagcgagactctgaagaaagaaaagaaaagaagccgggcgcggtggctcacacctgtaatcccagcactttgggaggctgaggcgggcggatcatgaggtcaggagattgagaccatcctggctaacatagtgaaaccctgtctttactaaaaatacaaaaacttagccagacgtggtggtgggtgcctgtagtcccagctactcgggaggctgaggcaggagaatggcgtgaacccaggaggcggagcttgcagtgagcagagatcatgccactgcactccagcctgggtgacagagcgagacttgcctcaaaaagaaaagagaagggaaggggagggaaggggaaggaaggggagggaagagggaggaaaggagggaaggagggaaggaaggaagggagggagggaggaagggagggagggagggaagggaaggaaggatggaaggaaggaaggaaggagggaaggagggaaggagggaaggtgggaaggcgggaaggaaggaaggaattccaagaggtggaaataaataaaacggggagagcccaccagctccctgacaatatggctgagaattttccagaactgataaaatatggaaacttcagcctcaagagtgcagcactctcaagcaggaagaataaaagcagcccatacctagctgtcccgtggtacactcagaatgctgaaggagaacttgctggaggcagaccccgcgaacggcaagaacaggagcagatgaccgtctctgaagtgccgaggcagaggcagcagccggacccacacgccctgctccactcccacttacgggtgtgggagaagcatcagatcagcaaaatgactgcgccaccacccagctccttagcagagcaacctccacagaatacagctcagaaagaggggacgcctgggctgccagaaagagtggggtgcaaacatgtgcaaacctcaacgagtgctggctgtgtgcaacaaagccctgtggaaagtggagggtgataaaggcaaggcagacctgagtattgggcagtcgtaatgatctgtgagccaggaggggcgtgatcaggaggaggatggaaacactggctatctttgaattctaaatatacttgttaaaattctaagagtgactattttaaaatagaaatagagcatataacttccacttaactctccaaggaaaaaatagaatgtcagactgagccagagccatggaagagtgctcaggcagcgggagctacacgtgcaaaggccctggggaaggagggaagaggcgcatgcctggcactgatgtcagtgcggctggaggcagacgggcgcagaaaggggtctgagacgtggctgaaggcagcaggaccagacaggatggggcctcagggccgtggttctgagcttcattccaacagcaggaaaagggaggcatgtttgtaacctgcagggaggcgggagccatggacaggattgcatctgtgacttgccagcatcccgccggctcccatgggagcagactgccctcaggccccagcggagggagggagaacagacagaacaattttggcccctggacatggtggcggcaggggaggtggtgagcaatgcaggaagggagacttaggaagcagtgcctagctcctcggtgtggaggcagtgaggggagggaagaacacggagagaggctggctcggggcttgacaaagtggtggggtgtcccacgggaggcaaaagcagatggtgggggcgggcgagagagtcacggttctttcagcctcatcaagtgtgtgtttctgaggacgtggagggcggtgggaggctgacggtgcacagacagcgcgggagcgggggcggggggcagtcttcatagatgagatggggcacggcccctccggagaggaggcctctcctcggggagaggaggggatgacagaggcagaggtggggcagccagggaggtaggagggtgctatggactgaagtgtggcccccccaaatccttatgtcaagccgcaacccccaatgtgactgatttggaaatagggtctttagaaggtaactacgacctttacgaagtcataagggtgggccctaatccaacagggctgtggccttccaagaagaggaggagacaccagaggtgggcgcagcaaggccgggagaaggtttcatgagaaaccagctctgacactggtggcaccttgatcttggacttccaggctccagagctgtgagaaaataaaggtctatcgtctaagctgcccaggctgaggtcttctgttacggtaacttgggctcactcatccagaggggaaccaaaagcatgtggggtcctggcacccacaggcaagcgctgtcaagaaagaggaagcagaaagcatgtgcatggctgctccttcagagcctgcagaaaactgtgcagacagggcacgggcacaaacccatgtgagcagagaagcatctctccgggtgcacacccgcactgctgagatgcacctgcccccgcagggctcagatgttccctgtgagagcagtgccatcccccacgcctcctgaggctgcctgggtcccataatggccaccgtgccatctcctatcccacaagccctcctaaccctgcctctccctcgtcaagaggcaggggctgtgtcccctccccttgagcctggccaggcctttgggtctctgctgacagaggatagcagaagtgagctgggttagcttggtgcattacagttgctcacgcctgtaatcccagcactttgggaggccgaggcaagacggtcacttgagcggaggagttcaagaccagcctgggcaacatagtgagacccccctctctacaaaaaaaaaaaaaattgttttaattagccaggcatggtgacacacatctgtagtcccagctactcacaaggctgaagcaggaggatcgcttgagcctaggaggtcaaggctgtagtgagccatgattgcaccactgcactccaacctgggcaacagagcaagaccctctctcaaaaaaaaaaaagggactgggtgacttgcaaggctatgttctgtcaactgacaaaaaatagaccaacactgtagatcaggaaacaaaagagaaggagggcctcaggaactgcggttcaggagacacagatctagcaaggagctcaaacgtgtctgtgcgggggaggccgggcaggggcttacaaaggtttgctgtgagtctacacatccggaagctgttggcatggtccatgaccgacggtgggggcttaacagcttaggacagctctggctgatgatcaatctagtcaggtgtgcctgtctccaggagaccagtgatcaggcccggtgtgaatggttcaaatcaaatgcagctggttcacgatccggcccaggtcaacagatcaattctatctggcgagttggacggggtccagctcctcttgccctcccagttcctttttagatagccctgacataaccatctccattacggattttcttttcacagctctggagtccacgcacctccatcttgttctcctgggaggctgacttgggctccagccaccatgccgagtgaaccatgacagaggtggccctccagcccccactcgggcaccccggctgatgccacgtggacagagatgagacagtcctgctgagccctgcccaaattgcagatttgggagcaaaatgcatggtctctgggatttacgtctgagggtcatttgtgacgcagcaacaaacagatgcattttgccggtggcgcatccgcccacgacggagcctggctcagctctgcaggtgcgctgcaccacccctggtgtcctggcgtcactggtacctgtttctctctcaaagctgtcctggtttggaagatgagtggtacagccatcccatcaatgcgaaaccaaaggccccctgaggcagcccccacaattgaagagcaggctgccctcagaaggggcccaaacccctgccattggaccaaactggctgatttagtttcctgccctctaaagtggaaattaagaaactgacaatgaaaatgtcccctttaggctgggagcggtggctcatgcagataatcccagcactttgggaggctgaggcaggagaatcacttgagcccaggagatggaggttgcagtgagctgagatcgcaccaccgcactccagcctgggtggcaaagcgagaccctgtctcaaaaaaagtcatagcttgacttccagagtcttcctgtctgcccggtgctggtcggtggtctctggaagccctccagctgccaccttcctttctgtccctccccgggagggatatgcaggcccagaggaggtgactccaggcgggtggtcccagaggaagggggctccacccttcccctgagtagtggggaatgtggcttcacccttcccctgcatagtggggaatgtttgggatctgctgggaggggtctgccatgggggcagtgtgggaaggtactcagaaaccaccagcaccccccaccctggtggccctggattctggtggggccactggaagcccggacccatgcaggtctcagcaacatcaccccctccacagtgagatccgtgtcagagtgacccgccccaaccagtcccagggctccctgcttctcagaccctccctccttcccagcccagagcccctccctccgaagcttcccttctcctactccacccctgctgtggggagaaaagacctgcagagtaccccaacaagccctctgcactgggggaggggtgcacgtccactcacccagaaggggattgggaaccagaagccaggtgagcctccctgagatcacagggcctgattccgggaccccagtgtccaacacctgcccccccagggtgctccacagcccctgcctacacctcaacccccctccacctccacatctgttcaggtgatgtccaacaccacccgaatcttactgaccactggtgagaaagggaggggcgaggttggcctctgcatggtaaagctgggtaaactgaggcagcacgttctgggcagcccaggacgcccaggttcccgccagcccacggcctctcccgccttgcacgggcttcacagtttgccagcgagggcacaaacgggggctccgcgggccggcgactcaccgcgccttccctaccccgccccagtttctcccatggagctggtctgcaggcccggcatccacaagccccaccgcactgcaccgctctgcaggtcgctggcgcctgttctggcctcgctgggacccccacccagacgcaccccacagccaactccaccggacccacgctgcccgagtatttttagcagagggtcagatgcctcttaaacctcagctgagacgtgaatttcctccctgacagctgcggccaggagccgcacgtcctgcctggcgggcgtgggcggttctgacctcggaggcacagctgcagggtctgcagtcctctgggaacttcctcctcccaggtgccccgatttgggctccctgggtgcctccgccccaggccgcccaccaggcgctcacttgcccggtcctccgtctggagcccctcccgatggccgtcgccacccactctccttctctgtctggaagcttggagagcaagagcagaggcctgggttcagattctcagggatctgggttcaagtcctgcccccacccccctgcacttgggaaagctgctacctctcagaacccgtttcctccactgtgaagtggaaggaaaattgcccacctgggggctgttgcgactataaccagccagcggtgcctgcagcacccacagacccccaggcgtcttcagggctccctgtgccccagccagcgccaggagcctgcaggaccgagaggggccctggcagggctgcacagatattcagatgttcagacctgaggcccaagacctgcctgccaggacagggacgctcctgcctggggatgctggggtcccagaaagtgagaagcagtggcccagcgccctctgctctcacttcctccccaccaagcacaagtactaattacgcacacctcagctccccgggggggccaggaggaaatgcccggcagagccctccgtcctaccccgtgcagcctgggtctccctccacgggcccagcctcttccactgctgctttcagttacccggctttgtaggcgcaaacaccctgtctgttttcttctttctcaagccatcttagctgcttttgatctgtattcttccatgtaaaatgtagactacatttatttatttctttaaaaaaaaattgaagcccaaatgagactccaattagaattgcattgaatttattatgtccccataattctctggggagaattatgtgtttataacattacgttttcctgtccgttctgttaggcttgctaagtaagctgacatgtgatctgcaaatgatggcagatgactgtgtgaggtggccttgggaatgtcatggctcctctccacagcactctccttcacattccagaaaattctctccaccaggcatgcctttggccagccctgggacatgtactgccccttgaggtttccagtactctgccctacctttataaagagcccctttgttaaacactgctgcaagtaacctgctctaaatgtgggtctctttcctgctgggaccctgatagatctaagggtttctcccaggaattcaaggaaggtttaatatcagaatctgatccgtgcaaataccatctgaatagatgacagggcaaaaagtgtcccaatgtctcaagtgatgccatcggtgactttttaaaaatttctgggcaaattagaaattgaaacaaatgaaatatttctaatttgataaaattgttcaccaaaaacccaccagaaaaatacatttatggaaacagttgttgccaggagttcgggaaagaggaaatggttggatcggtggagcacaggggggtttttagggctgtgaaactaacgtgaacgacattgtaatggcagagacacgacactgtgcatctgtcaaaacccacagaacttcacagcaagagtgagccttaatgtatgcaaattttaaagctcagtcaagaggctgggggtctaggacggaaggcgggccgtgtgtggcgagagcctctggctgtatcacagacccagggagcagctgtattacagacgtagggaggggctgggggatggggctgacctgggtaccctcacaaacgacgaagtctgtgaagccaaaagcaaatggacccgcacatgagccctgtaccctggcagacacacgcttctgccgcggggtacaggtgagcagtccctacactgctccccctgcacactgcagcttagcgattaggtccatggatggtgggtggtggggcaggttcctcactgtggggtgggagctacagacaagcaggggcaagggccagaacgacccacacggcccagggtcagggtcgagacagcagcaccagctccttcctgtgggctccctctccatgcgggcggagtgacggttaactttatgtgtcagctcccctggccgtggggtgccgggttgaacgttatttctggggatgtccgagggtgttctggatgagattagcatttgaatcagtgggctctgtaaagcaggccgccctccccagggtgggtggtgtcacccaatccgctgaggacccgaatagcgcggaaggcagagaaaggtgaatttgcccccctcttcctgccacgctgcttgagctgggacactcacctcaccttctctggccctgacactgagattaacgccattagccctccggctctcagggcttcggactcagaccgcactgcaccaccagcttccctgggtcttcgcgggcgtgggacctctcggcctgcgtggtcacctgcgcccaggcttcagctggcatttcccctgcttgaacttctttctcgtgccgccttgtgagaaggcacctgcttcccttccaccatgattgtaagtttcctgaggcctccccagccatgcagaactgtgagtcaattaaacctcctttgtgggctgggcgaggtggctcacacctgtgataccagcactttgggaggctgaggtgggtggatcacttgaggtcaggagttcgagaccagcctggccaacgtggtgaaaccccgtcctactaaaaatacaaaaattagccgggcatggtggcacgcacctgtaatcccagttacttgggaggctgaggcaggagactcacttgaaaccaggaggcggaggttgcagtgagctgagattgcaccactgcactccagcctgggggacaaaacaagactctgtctcagtaaataaataaaacctcctttgattataaattacccagtctcttgtagtatctttatagcagtgtgagaaccaactcatacacccactatattgaaatacggttaccaaaataataaagtaattgttattggatttcttgttaatctactgattcaggccaggcatggtggctcacgcctgtaatctcagcactttgggaggccgaggcgggtggatcacctgaggtcaggggttcaagaccaggctggccaacatggtgagacccctccccccccgccaccatctctactaaaaatacaaaaatcagctgggtgtggtggcgtgcacctgtactcccagctacttgggaggctgaggcaggagaatcacttgaacctgggaggcggaggttgcagtgaaccgagattgcaccactgcactacagcctgggcaacagattaaaaaaaacctactgatccagatctagcagcagctctcatgaccaacagtgttgaagcaggaacaaaaatgaggcttcaagacgccgaagcaactgaaacacgatgggaaaatacacaggactttgctgacggtggagtcccaggttctgtggagaccgctaggtcctttggccacattcactattgaggaacactcactttagcctagaggctggtgaaagtaaagatgcaacgtttttccatccaagttcagggacacctgaatcccatgatcagtaggttctagtttagaacccggctgcagagtttacacctgagtgtggtgattacatcttcaccgtttcctgatttttatcccatgatcagtagcttctagtttagaaatccggctgcagagtttacacctgagtgtggttattacatcttcaccgtttcctgatttttatcccacgatcagtaggttctagtttagaaacccggctacagagtttacacctgagtgtggtcattacatctttgccgtttcctgatttttagaaaaaaaaaaaaaaaaaacctgtgatctgaaccaaggtaattgatctccctcccttcctacaggtgtccacgcccttggggaaggttataggggttggatgtgcttttgaccccaagggctccctacgtagcccaggccagcctggggcttggaggagggcgggtgagctgatgagaacctcctccatgctcagcttccacctgctggcatctgtgtgcccagcacacaaagcctgggcaacgggcgactcctgtgagcagagcttcaccctcttcccctctcactaccccccaccccacctgcagcccctctcctccctccccttggttcgagatgaccccaactcccccggagatttctactgggatctggtttggtttttgctttttatgatcccctaaacccatcttcacctccctgctagggctccccaggttgactggggaggaccccacattccccatgattccacgcagcaaaaggcacttctggcaggaacccgcatcccagggcaggccctggggcaccttgggctggggaagactgcggccccaaaatctccactccctgcgctgccatctgaaacaccaccatgatggataatgtcttacctagggagaaggcacctgtgctggaaaaggagacccaagagacccgcctggaccgtgtgggtgagaccatcgcaccctcctgccgagggagaaggcacctgtgctggctaaaaggggtcccaagagaactgcctggacagtgtgggtgaggccattgcaccctcctgccgagacggtgggccctgctacagagcctgatgcccctgaggagctgggaccactgtcctcccaatacacatacacacacaaacacacacagagacacacaccgacacaaacacacagacacacagaaacacacacaaacacagacacacacacagacacacacaaacacacagacacacacaaacccacacacacacaaacacacagatgcaaacacacacacacagacacacacacacagacacacagaaacacacagacacacacaaacccacacacacacacagatgcaaacacacacagacacacaaacacacacagacacacaaacacaaacacacacacacacagacacacaaacacacagatgcaaacacacacacaaacacacagacacacaaacacacagacacacacacaaacacacagacacaagacacacacacagacacacagacacacagacacacagacacacagacacagacaacacacacaaacacagacacacacatacacacacacaaacacacagacacacacaaacacacacagacacacacagcacacagacacacacacaaacacacacacacccttcacaaccttcctgggctcttagcattttctgtggggctgtcaaggcaggaagatccaggagggaccccagggcggggagagacaaactctcccagctcaggaaggcagtgtgctttcgcctaaataactgagtgagctcacactaacaggaagtgttttgattttgcagtctgagagttaatcccgtcgctggccagacatgtttgcttttaggttctctggtggcccacaggtcccagttctgaatggaaacatcccgaggcggcccctcccctcctcaaactgcaccctccccgggcatggcgctgcctgcaggctgtagagagggcctgggctttttcacaccttggggaggtgtagaccagggaaaggaagaggagaaggatgtgggcaaccctccaccaccagggagctccaccaccactccgcaggccctggcgtggcaccgtccccgagggctggcaccgggctggtggcaggcctcagcatcagagggtggctgagtcgcacacaccgcccctacccctcttcccgagactgagcccctctctctagccccagagcaggagtcacccccagccccaccagccactgcccatgaagctggttggaattgccctcagcggccacagaggccccagcggggtccccagccaggccgacatgcactagcagctcagaaagaaaggccttgtgtccagtgacctcccccaacctcggaatgtggccgttctctcctcccatccctacagtagggctgaggctgtcccgagtacaaaggccttttgtccccacaaccagcccccacccgccgaggtgacactggagctgggagagtggcagcctccatggcggccacagtggctcccagctcccctgcagcagggcctccctcctcccccagggccgggcagagggcacctgcagggcatcttccccggcaccccctggctgcagagcaccctggtgagaacgatctaatcggagagcccaggcttatacacagcttctctctgccagctgagaatttacgtttctgattaacttgtgttacccacaatacactgtagactacagaaggccaggaccctctgaggtggtgcagtgcccccagtcttgttctgggtgagggctccacggacctctttatttgtcaaaactcatacactttagttctatgcattttactctgggtaaactgtatctcaggccaggcgcggtgactcatgcctgtaatcccagcactttgggaggccaaggtgggtggatcatttgaggtcaggagttcgagaccagcctggccaaaatggtgaaacccgtctctactaaaaatacaaaaattagccgggtgtggtggcaggcacctgtagtcccagctactcaggaggttgaggcaggagaatcgcttgaacccgggaggtggaggttgcagtgagtcaagattgtaccactgcattccagcctgggcgacagagcaagactctgtctcaaaaaaaaaaaaaaaaaaaaaaaactgtatctcaaaaatacatggccacaaaaaaatacatagtcattgttttaagacaccagaaaatacaggcaagccgaaagaattctgaacaaccaacggccgctgcccgaggccagttgctgtgattgcaggtactttccacctgtccagacgcctccacgcgtgtgacacacacgcaatgccaaccacacaacgcaggccgccgtgaatgccacttacatctgtcagtgacaaaacctgaccgtgtttccactaactctgacacaatattttaaatgactgcacattatgctgtgtgcataagccaatttgtgttcaacaaatccatgtattgttggaaattaaccacttctggggttattctttcagaattctaaacagtagggccacaaatatcctgatagcttggtctttgagcacctttaaggtgctatcttgaggtaaagacccaggattggtgttgctggggcaaaagacactcacctgcattttaaagggttcttttttgtttttgtttttttctgagatggagtctcgctctgtcacccaggctggagtgcagtggtatgatctcagcttactgcaacctccgcttccggggttcaagcgattctcctatctcagcctcccaagtagttaggatgacaggcgcctgctaccacacctggcaaatttttgtatttttagtagagacagggtttcaccatgttggtgaggctggtctcgaactcccaacctcaggtgatccacctgcctcggcctcccacagtgctgggattacaggcttgagccactgtgcccagccttaaagggtatttttaatgccttatggaaagcaggggttccaataggctttccagtccagtctcttccttgatctttataactccaaagagcctggcagacactgagcctgcgggggaacacgagaaccattctgccttggaaataagactaacctactggatgcagaccagaatgcaatacaccttgacagtgtaaaactaatccctggacttccggccgggtgccgtgactcaggcctgtaatcccagcactttgggaggccgaggcaggtggagcgcttgaggtcaggagttcgagaccagcctggccaacatggcgaaaccccatctctactaaaatacaaaaaaaaaaaaaaatagctgggcttggtggcacgtgcctgtagtcccggttactcgggaggctgagacaggagaatcacttgaacctgggaggcggaggttgcagtgagccaggattgtgccactgcactccagcctgggcgacagagcaaaaataataataataataatacctggacttttactttcacgtaggcaaggtggatcccacagggaaggtcaccacaactactcacaataactgaggaggccagacacattgtgaaaaccttactgcgaaggcatcagagagctgcagaggctgcgaggacttaacgaactaaaattccagagaatggagaactgtcagataagcaggtgacccacagccatctttttacctggggacatttgcctatttgggacactgggctaaggattgggcttggcccaggcagagagctacagccggggaagaagaaaccagcaaagattctcactgtcacagggaggaaagtggcaaaatcggagtgtccagggccacaaccaggcagcggggccctcagccccaccccaagacacctgtaggatctcaatgctgctgcaggaggaggctcaggagcaagttgagcagctctgtgaggctggactgcacttcccacagcctttcaaagtggggagatcaagacccgccaggctctcagctgaaatctggagagaccaatcccccaaaccagggcaaaccagaggaagcctgaaccccatcaaactacacaccagtccacccgggcccatccctcactgggttgagggacctgcccctctgtccatcctaactgcctgaggtttttgctcccaatacaagccaggtggctccaattagaacaactaatgtgcaaataacaactataattgccaggccgggcacagtggctcacacctgtaatcccagcactttcggaggccgaggcgggcggatcacgaggtcaggagatcgagaccatcctggctaacatggcaaaaccctgtctctactaaaaatacaaaaaaaaaaaaaattagccgggcgtggtggcgggtgcccgtagtccaaactactcaggaggctgaggcaggagaatggcatgaacctgggaggcagagcttacagtgagccaagatagcgccactgcactccagcctgggcgagagagcaagactccatctcaaaaaaaaaaaaaaaaaaactataattgccagacaaaatataaacaccaaaatgtaaactcactaggccaggcacggtggctcacgcctgtaatctcagcactttgggaagccaaggcaggcagatcacctgaggtcaggagttcaagaccagcctggccaacatggtgaaaccccatctctattaaaaatacaaaaattagccgggcatggtggggtgcccctgtaatctcagctactcggaaggctgaggcaggagaatcacttgaacccgggaggcagaggttgcagtgagctgagatcgcgccactgcactccagcctgggcaatagagcaagactccatctctctttccatatatatatatatatattttatgtatgttatatatattatatatatatataaactcactgcattctgagtgaccaaaaccagacagaggttgtagggagttgactacaggaaatggaatgacccgaagaaccagaggacagagtttggggtgaccatggcagctggactgtgagggggaaatcccagaaaggagagcgccatagagagggattccccaaagactgcatgaaaaactcagctcagatctctggcagaaccctgagctatgtgcacacaggacagatcccagcaattcacatagctgaagagagatttacctgccagccacacagaggaggcagcgtttaccatttgagttcagtcaggttaactgcttgatgacacaaaaccaaaacagttaataatctggagagaaagatacggaatcgcacatccctacagtgtagtgttcacaatgcacagggtcaaccccaaatcgacagacacaccaagaagcaggcaaatgtgaccgagaatcaagaacgtgaattgatgggagccagaagacaaaggaatatatccttaaagtgctcaaagaaaaaacatggccaacctacaattctacacccagaaaaaatatccttctgagatgaaaatgaaataaagacttttcagacaaacaaaagccaggataattcatctttgatggagctgcaaacggaatattaaaggaaatatatctaggcatgaggaaaatgatcgcagatgtaaacatgaacatgtagacaaaaatgaagaataccagaaaaagtaaaatatgtgggtaaattcaattgaatatagactgctcagaacaatacttgtagtatcttatagagtttagaatacaagtaggctgggcgcagtggctcacacctgtaatcctagcactttgggaggccaaagcgggcagattgcctgagctcagaaattcgagacccgcctgggcaacgtggcgaaaccccatctctactaaaaatacaaaaaattagttgggcatggtggtgcatgcctgtaatctcagctacttgggaggctgaggcacaagaatcacttgaacccaggagacggaggttgcagtgagccgagattgtgccattgcactccagcctaggcaaaagagtgagaccctgtctcaaaaaattaattaattcattaatttaatacaagtaaaaccacgtgtataacgaccacaacaaaggaggtcggggatatttgcaatacaagtgtacggccacgtacaaaagacttacgtccaaaacatatgtaaagagctcctacaaatcaacaagaaaaggatagacgactccctaggaagtgagcaaaaagatttgaagacactttaccaaagaggatagtccagcggtcagcaaatatgtaagaagataccccaatttccttggttatcacgaaaatgcaaatcaaatcacaaagtaatatcacaacccacagactggtcaatatgaacaaggtgaacacttccagttatcagcaaggctgtggagtaaccagaaccctcacacattgctcatcacgtgaaggttgatacaaccactatacaaaagtgctggatggtaactattaaagctgaacacaggtagacccactgccaagtttcacccgacagaaatgcttgcacctgttcaccaaagacaggtactgtgtgagcacgttcatggccacacaaaagccaggcgccagaagccactcaaacgcccattcgttgtagaagggatagatgagtgggggggctgctcaccccatggaatggcgctcagcagtgacaatgactgatgtagaatctcgtgcaacaagggcgaccttgcagactgtacgctgagtggaggaaaccagacactgtgcgatccccttttaggaagggggcaaataagatgcagttatctggccaggcacggtggttcacacctgtaatcctggcactttgggaggccgaggcgggtggatcacctgaagtcaggagttggagagcagcctggccaacatagcgaagccccgtctctactaaaaatacaaaacttagccgggcatggtggcacatgactgtaatcccagctactcaagaggctgagtcaggagaatcacttgagcctgggaggcggaggttgcagtgagctgagattgcgccattgcactccagcctgggcaacaagagtgaaactccatctgaaaaaaaaaaaaaaaaaaagatacagttatcctggggatgctgacggggagatctgggggtagacacagttatcctggggatgctgacggggagatctggaggtagatacagttatcctggggatgctgacggggagatctgggggtagacacagttatcctggggatgctgacggggagatctgggggtagatacagttatcctggggatgctgacggggagatctgggggtagatacagttatcctggggatgctgatggggagatctgggggtagatacagttatcctggggatgctgatggggagatctgggggtagatacagttatcctggggatgctgacggggagacctgggggtacaggggctggggatggtctaattccgtctggatgtcggttagaggagtgtgttgagtttgtgaagacgtccaggcggggctggctgcatctttccatatctccgttatatgtcagtgaaaagtcagctaaacacaatcatgtatttaaccagcacatttgggaagcagaggaaggagggaacgtgggaggaggcctgagtggtgcttctcattgccctgcagaatcagcagaccttgataattgtaaaatatgtggttacataaacataatgacccaggcacttaatgttttccatggtcatttttttaaatctaaggagatcattaaggaaccagtatcttttgttgtggtaaaatatttatctgaaatgcagcaactctttccatttaaatccgaatgaaataaagtttgatattctattttgaaataaagcctatcatcgtcttatcccactccacttctcagctactcttctcttcttcagccctcttctctgtctctctacataagtaccaagcaagacatctggaataaggtttagcaatttaatgatggttatttcttagtggttggatttatttatttttttctttcttttttttttttttttttttttgagacggagtctcgctctgtcgcccaggctggagtgcagtggtgcgatctcagctcactgcaagctccgcctcctgggttcacaccattctcctacctcagcctcccgagtagctgggactacaggcgcccaccaccatgcctggctaattttttgtatttttagtagagacggggtttcatcttgttagccaggatgatctcgatctcctgacctcgtgatccgcccgcctcggcctcccaaagtgctgggattacagacgtgagccaccgcgcccggccagtggttggatttaaagtgacttttagagactcttttttgtacatgtttgcattcattcgcgttttaataacaagcatttttcaagttaataaagctattctgttgtgctccatcactagctgggtgacctggagcaagtttctcaccctcgctgagccttggtttttgcagctgtaaaatgcagatacgaatattaccaaatgcatagggtttttttagaaagattaaattagattatttttcaaagtgcgtatagagtacaggaggcccttaatacacaatagctgctattattattgccaaacataaatagaggagaaaacaacaaagagactcagccctcccttcaggaggtgatagtctggcagaaagaggcgagagctaacacccagatggagcctcatgagcagcctactgccctgggcggccacaggcatgtcgggagggtaagcaggagcccgacggctgaagccttgggggaactgaggggtgggtcagaagtgggggaccgctgcacatgccctgcagactcagagggtctgagtcagcatcctgtcctgagggtgttgccggactggggagttggggagaccctggcctgctgggccagcggaggacctcctgtgggggctgtctgcaggagcgtgatgggttggaaagccctgctgtccacagagactccaatatgaggaatgggtgccttggacctggtgctgtagacagtgacagggtttggctctgtgtccccacccaaatctcacctcgaattgtaatccccatgtgtggagggagggacctggtgggaggtgactggatcaggaagtggtttcccccaggctgttctcctgacagtcagggagttctcttgagatctgatggtttaaaagtggcagtttcccctgcgctctctctctcctgccaccttatgaagaaggtacttgcttccccttcaccttcccccacgattgtaagtttcctgaggcctccccagccatgcggaactgtgagtcaattaaacctctttcctttataaaatacccagtctcaggcagttctttatagcagtgtgaaaacagactaatacagacagtatcaggagaggcttgagttcatccagtgctattggaagactctgttggatggaagatattgaaggcacagccaaggtgtggaggctcttgagaagacaaaaggtgctcagcacacacgtggagctctctccagagaggtttgctcaactcctgcagacaggaagagctgccctgtcctacagccctctgcatgcgtgatgtccaggcatctcccacctgcatcatttcaccccctgacagcaagcaccttggggtggggttgtcagataaaatacagaactcccaggtcaatctgaatttcaggtaaacaacaaatacatttcagtacaagtgtgtcccatgcaatatttgagacatgctggtgccaaatattgcataggacattatattagcccattctcacattgctataaagaactacctgaggctgggcccagtggctcgcacctgtaatctcagcactttgggaggccaaggtgggcggaccaattgaggtcaggagttcgagaccagcctgaccgatatgatgaaaccccatctctactaaaaatacaaaaattagccaggcatggtggcagatgcctataatcccagctactcaagaggctgtgacaggagaatcgcttgaacccgggaggcggaggttgcagtgaatgaagatcatgccattgcactccagcctgatcaacaagagctaaactccgtctcaaaaaaaaaaagaactacctgagactgggtaatttataaagaaaagaggtttaactggctcatggttctgcaggctgtacaagaagcatagctggggaggactcaggaaacttacagtcatgggggaacaggaggaagagagcaaaggggagatgccatacacttttaaacaaccagatctcctgagaacttactatcaggagaatagcaagggggaaatcacgcccatgatccagtcacctcccaccaggcccttcctccaagactgcagattacaatttgacatgaaatttgagcaaggacacaaatccaaaccatatcagacatacttatcctaaaactgtattcattgtttatctgaaattcaaatttacctctgtgccctgtatctttatttagtaaagctgcaacccacttgggtgatgctgtgcccttgcttacctggtaccaccactgccaatcctgtgcccagaacatagcagactttcaattaatgttgaatggatgtgggacaggtggatgggggatagatggatggtgggtgaatgggtggatggatggatggtgggtagatgggtggatggatgaatggatggatggatggggtggatggatgggtggataggtggttagatggatggatggtggtaggtgaagggatgaatagatggatggatggacagatggataatgggggtgggtggattggtgggtgaatggatgatggatgggtggatcggtggatgggtgagtggatggatgggtggatggatggtgggtgaatgggtgaatagatggatggatggacgtagggggttgggtgtgtgggtggaagagtagacagattggtggatagatgggtggatgcctagatgggtaggcgaatgaatgggatttggattcagtaagaggttttaacactaagctgtcttaaatgcccaaatgacagggccaaggtgggagtaaatgaagtgccagctgatgggaaaactcccagctctgacacctctcaccacccctgcgactctcctgctcagattctgaatctgtaaaatgggaatgcttagtggtgctccagcaagaggaagctccatgtgctgcaacacaagttatatgtcctgacatggatgccttgctgggggtggtggggggtgattcgcctgcagacgtcaaagccctgcctgccaagatccttgacttcccagccccaaccaggcatcactcaaaggtgacctctccactcccagcaccaaggagttgcctttggaccctgaccaccctgatggccaaggctaggctggccagcacctccccagcagcccttcagaggcctccacagccctgtgtccagtctgacacaagtgtgtcaggtggtcatgagcaccgttcccttccagcaaggccacctcttcctgtggggaagggcctcaggtaggcaggccggaagcacctgcagaccccgcactcagaaactgccaccccgcttgttgaaccttgtgttttagaaagggtcttcctttcacagcatctccctctccccagtcctcctcccagaggctgtttaagggtgggcgtgggacccccagtgtttccagggttattcctagggatggacttcttataaacaatattgcccctcttcccagggccccagggcaaggagcagcgagcctggacctgcagccactgtagccccagcctgggggaggggacagcacaatcagggtgaagtggagtcagaggtgggtgttgtggaggggggagcggcgcggggacagctgtcctggcccggctaccttccctgccccctgtgacatcagcccatcaattccctccctcttttgccctcactaggtcgggtctctggccctcgcagccacaaggttcctgactcctgtgtccttgtgaaagagccacacacagcagcagggggactgcccccgccaggaccagcccaggattcctgctggattccgtgtgtcaggaccacccattctagcagaggagcaggaagcccagagaggcaaatcacgcgtctaggaagcagagagggatccccgccccagggccgcctgaggagtgagagagctgaggctgaggtctgctgttactagagctgaaacctacggacctacccagctcccgttttcgccgctggggagacccacggggagatcaaggggcctgggggggggggggccctcccaccttggacgttggttgccacatctgcacgtgacggggagaaacgtgtcattccaggaggacaggagggcggggcagctgaggggggatccccagatataggggcatccccaggacccacccccgtcctgtggaggcaggaggaggggccgcacccctgggtttgaaaggcagcagccgccttccagagggagcgctggcgggaccttaccgcacccccttcagagtagccccctccccccattgctgccctggactctgcggccagcaagctggaggttcctagggctatgggggacaggaggctgtggctggctgaggactttgtgtcaatgttcccactgcctctggggactggggacagccaggccacacgcgggggcagtgggacttagcacctgagcctgctgagctcctgaaagccctggaggttctcggttccccgaggtggggcagggaggagggagcccctggtgtggcctggttctgctgggcggaacactcaacactcccttccctgacgaagaggcgagagctgcttcgggaagaaccacctgccctcaccccactcggtctgggacaggcagggcactggcctgccgggagcccccgcccctgtgcctgcagcgctgctctgcgccctgctcccttactccacctccttccacctcctccccttcctcctcctcccaaggaggaggcagatggtggtggaaactctgcttcctccattttccggagcgtgactcagcaccgcagctgccgcctcggcccccacgcagcagcgcgaagcctgccctcccctacagcggagcccggggactccccagaacacccctcccgcaactcatctggagaacgcagggctgcgggctgccgagcccaccttcccggagcccccagcccagcggacccctcctaggcagctaatttcccgcccacccggcgacggcagaggacgtgtgccggggcggagtgcgggcaggtgggcggggctgcagccccagatctcagggacacacagaggcgaccacggggcttcttagcttctgggtggccgccccgcccaggagactgggctgagcgaaggggaggggaaggcctaggaggcaccccaagaaaggacccatcagaaaacacagggaagtaggaaaataagagaaatttccagaagcaagaggcttggctcatgcggaatgccgcagagccaggcctcaacccaccggagaatctctgagaacactgactgcagcccaccacggtggccccgggtcctgctctgagctcctgtcggccctcgtcctccctacatcagagcctcccctgggagccccagagatcctctcaactccttctcgggacaaaggaaccctccctgctgagagcccctggtggctcctcccactcccccactcggctccctctctcctcctcactccctttgtggtgggcttggcccaggagagtcccggcacccccagctgctctctgtaagcccctgggggtggccagctggggtgggctccccactcctgcctggccgtaatcagggagccgtgcctcgggatgtgggcacacactcgtgcacacgcacaccgtctcagcaactgggctctcctgagagtccccttcccaacccacaaaacaagacctgccagcgcccccaccccttcctcccacttctgtccccctccccatagccctaggtacagctgcagaaactgaggctcaaaggggtcaagtcccttcactccatgtggcagagctggggtggtcaagagaccccagaccccagctgaagcctcccgccctgacatgggaagccgctcctgtggggcctgagcaggtgcccaggaccaacgggccagcccaggtgagaggcttcctgccaggaggccctgagggtgacctggccagggacaccagtgctcaaaggtccgggtgggtcccagccccagctcaccctccgtttgctggcagtggcccctctactctcccccaggactcccgacagctctgcagagaggcctcatccccacccagctgggcagactccgaccttgccaccgggtgccttcccattctcctggctgccagccactcccctcttgcagcctcagtttctgcatctgtaggttgggagtaatgagattccccagccggcccgctgggaaggctgggcatcctgggggagggagggggaagggaatgccaggagctggctggagccaggtcagggaggcatgggcccagccccagccgcagcagccactctgtgggcccaagcaagccccgggccctgggcctgtccatctgtaagcagggtgatggcactgccgggcgaagtggctgagggtgggcccagcccagctgccctccctaggcattcatcaggcccagcgctggggcagggcacccagcccacaccacatggatggggatgaacctccagctgggctgcccgacagggacagaggcaaacagggctcccaggattccggggccagcacaactctgtggctgccgtagtgtcagctccaggccccagaaaggactgcaggggaccaggctgctcctgggtgaccccagatgtcctggctcttctctaggggatcttgggctgaacaggggactgaggccccagaggaaggcaacacagggtcaagacggatccctgagggtccccagtcatttgtaaattacctctgccctctgcaaagtgtgaatgctgattcctcggcctctgcccaaacatatgcactctctcaggttcacgctcacacatccccttaccattcggcagaccccaccggctctgccccagctcaccccctccacctggccctaccatcctctgcccctcaccaagggggaccctccaatccaatcccataaatcagggtccccgagctgcactcaaagcctccgtcacctttccgtgcttgtggaacaaaccccccctccgtcttctgactctcacccctcccacctcagtgtgtgcagaggagccttccctgcacacagctgaagtggccctgtgtcccctaccctggactttggccaggccattgaccaggctgctgcctccacccatgccttggcatctgggtcattttttattgatggtagcttggcccgacttgggggcttcacacacacctcccgtccagcagccctaggaggtgggactgttatcaccacccctatctcagcaggcagcagagccaggacccagaccggcccagccacagcaccctcccactgtaccacgggactgcgctgttcacagggccactcctgacctctggggagtccctccaggtaggccaggccaggcctgtgctctgtaatgcagtccacgcagggctccctgctgcccggggcagggcggtggtccgacagctcccacccctcagggcccgtgcacccgcaatgcccaacctgcccagcccacccagcccagccaccgtcagagggaggttggcgatgactcaggccttgagtcagcagcatcggataaggatgcagccaaccctctgccagcataagggatccccagacagccccgagctctgctagctgggcttgtggggacccctggctggaaccgaaccaggctcatcagcgctcaggagcccgggagccacctccccgggaaaattcacatgcacacacacacgcacacgcgtgcacacagaggaggcctgccatcagggtgggtggggctggactaacaccagcccagggaagagaagccagagatggtggggcgcggtgggcagtgaggcggggtctcagctggaggggctcactctgactgtggagcacccatgtgcctcctaaacagaaactccacacaggccaaggaaacagagctaccagctgactcactctcccagcaaacaccagctcctccccgagccaggccctggaagagaagtcaacatcacgagctgccatctggggggtggcaccaggctgtgaaggatccacagactggcatatgcaggaggaaatggggcgggcgaggagtaaggaccccaaaaagcaggggtagggaagggccctcccagcgccccactgtaataggggcctcatcaatgccccatgctcactgaataaagcactgccagcgaaaggtgaaaagaggaacaaagaacattctcctggacgccacccacagaaagccacgtgcaggcttggccctcaccttggggaccttggacacggagctggttatgtcacatctggctctcagagctggggcagcgtctaggaggcctgatgtagaaagcactcagctaagccctagttaccggcacacgggcaccagcgccccctctcagcaaactccacgtcttatgaaattagcactggatttccacttcaattggaaaatatggccaaggtaagagatcaggaacgacaaggccaagctggggtagccgagaaagcagagcagacacgggggcggagaggtggctgcaagcatctgagtgcaggaggcacaggcccctgaggtcccggagggcagcacgctggtgcagagccgggacagcctggggttcactcactggagaggcagggtgggcggggcaggtgaggatgggggctggagcccatgacatccccttggttgctgagcatggctgacccctggccacacccggcctggacgttgaagtctaactggggagccaggcagggagccaggcaggaaaccggatgcaagtggagattccaggctgaggcgctgtgggaaggaggggagctgtcactctcccaaggcgggaagtgggaggggctgggagtctccagggaggggaggagggcctggaggagttccctggggtgggggtcccagaagagccagcagcctgtgcggcggcatgggaaagaccccagtgcctggcgaggaattggcacagccagtgtatgtggagtcagataggggtttggggtttggggttatttttaacccgtaagtctccctgctattctacaggagaaagggaacgctgtgccgggcgctcaggaagatgcaggcaggaggcagcagtgtggggagggacagggagggcctaggggctgggtcagagccttgcccaaggggctttagcggggaagtgctggccttcccacccctcctctggaatctgtcacctcccaccctggaagagctcaggagcaaatggattcctttccatgaaaaaagcatagtgcctggggctaagcaaagccaagactggcagataaggtgccccagatgagcaggcagctgcctgcagtggggcgcggggcagggccaggaggcgggagggcggcagggagcagggacagccatccggcctttgggatgggcagcacccctggaggcgtggggaaggcagagcgggctgcctggcctgcaggccaggtgaggggagaacgcaggccagaatccagccataacctggctgcaggtcccatccaggtgggaagaaagagtctgatatacttccaagctagcagtgaaactaggaggttctgtaagaactggggaattatttaccctaactcaggaatgctcaccgtgaaaccaagccctcacctaggggaagggccaccccagcagtggccactcctaaaatcctcacgtcccccccggacaagtctagcctccaggatggaagaaagtcagccaaccctaggattatcacgtctgggttgaactgaggggtcttctgtgcatgcagcctgcgctagtggctggggcctccgcaatgttgggtgtgcctgggatagctcagagtaacacggctatacggcactcagggttggaaggggagccaggctcctctggctctgagctcaagcggtccaccctcccgagcctcccaaagtgctgggattacaggcgtgagccactgctaccttaataaactaagtgttaatgttgaaaacccaaggagcagcaaaggtcctcaaagacacagagacctgggggaggggtctgcgggtggctgcaatgggggaggggaggggtggaggggaggaggggccctggggaggcagcacagactggtttgtagagtgacccctccgtggcttcctggtgacccttccagaataaatcccaagcatgcatcctcctacgtgcctcagcctggggctgccactccctgcctcccaccgtccactccaagagcctagctcccctgggtgcctgggtcccccaccaggggtgtcaaagcagaaggctggcatcagtgaccagcacacctgaaggccctggagccgtggggcagggagggaggtgttcagggaaagatgggagggtagaggggagagtgaaggagaagggagaaggcccgcaggggagggcagacagtcgcagtggtgtcctcattccagtcaccattccattcataaatacttctgaaacccgcccccctccccaccacacacacacagacacacacacacacacacaaattacctccggagactttggagacctacaaagtcttggcactacatctcttcaaaacacagtccagtggccaaaaatcacctgcaagacattctagactttatttccttccctccaagatcatcaggcaagatccaattcatcagcctacagggcctgccctgagccctctccccctctccccttctctgccgccccacccctgcctcttctgagtctgcagggttcaaggccagaagcagagcaagtcagaacacagctacacgcaggcagactatgggttggggtgcgggtgggtctcaggcacttccctgctctcaaaggagcacctccagggagcccatctggtgctccctccagctcctcaaattcccaacaccagggttgcaaggcccagtgtcttctcacctcgttaggtggagaaccccttctttaagcaaaagatggcacggacccccgacataagacagttcaaagctgagcggctctccccatcatgcaagtaacctgcgtgccgccacgggaaacagcacgcatcccatctggactcccaccagacaactgaggcaaccgagaaggaggctggggagggacagctcgagggctcactggaggtcagcagggaggtggactgcgtctcccgagggccagcactggcttagcctgctcagtgaggtgcccgaaggaggcccaccagctctgccagcacccggcctctgcacctcagctttcagcggataggtttgtgcaacgaaatatttcatagaaatcaagaaacatgagtgaacgatgcacaccaccgcgtggatgagtctcagagactgtggagcgaaagaagccagacacaaaggttgacatttacacgcaatcctagaatgacggctctatggtggcagagaggagaaaagcagttagctttggcaggtgcccacggagggggctatgcaatggaactttctgggccctggaggtgttgcagagtttgctatgggtggtggtagttacgtgggtttctatgaatgtaaaaactcttggtgtggtagacccaagctctgggcacctcacgcatgccatgcagcagctcgatctgtgacagcgagtcctgtgttccatgatatggctgcaaacacttgacagagtgaatgccgaacctctgctcctaagggaaatagagggccaggttcctacgagcctctgctccagccttttcagcaaccaatcagtacacaatagagttatttatgtgtttctgttaatatatgtcactaaactcccggccaagagcactacaactcatgcctgtacagagcctgtccaacacatgtattttctccataggacacatcatctcaaaagcaagtattgatcttattttatctcattttcaagagatgcagactgttcttaagcaagtactggttttaggtttacaaatacattttagcgagtaggcaaatttgcaagtacagaatctgtaaataatgagattctactgtatgtgtgtgcaatattcaaatgaagaggacagagcttcctgcctgacacaagcccctgactgactgccccacccaccgtcccttctaagagcagcagcctggtcccagctcttgccttccctcctcagaccagggataagccctgaccaatgtctacctcctgcagccagacacagacaggctgactcaggtgctcttggagtttgaactgagaaatgcaagagaagcttgcaaaatgctgagaggctccacaaggggctgctgaagccccagcaggcaaagctgccagctacagagcaaaaagccaagggaggggcagggatgttggaggaaggacctggctggaggtgactgggggcggtcgtgtccttgtcagcaagcatagagcagaacagctgcccaaggtgccacagctggaagggtgagtgggtggatgggtggatgaaagggtgggtgggtgggtggatgggtggatgaatgggtgggtaggtggggggatgggtggatgagtggatgatggctgggtaggtggatgggtggatgagtaggtggatggatgtgttggtggataggtgggtgggtggatggatgaatggatgggcagatggatggataagggtgggtgcatgggtggatgaatgggtgagtaggtgggtggatgggtggatgagtggatgatgggtgggtaggccgatgggtaagtggatggtgggtggatggatggatgggtgggtggatggatgaatgaatgggcagatgaatggatgagggtgggtgggtgagtggcaaatgggtgggtaagtggggggatgggtgcatgagtggatgatgggtgggtaggtggatggatggatgggtaggtgggtggataggtgggtgggtaggtgggtgggtggatggacaaatagatgggcagatggatggatgagggtgggtggatcagtcggtgggtaggtggttagatgggtggatgagtggatgatgggtaggtggatgggtagatggatgaagggatgggcagatggatggatgagtagatgataggtgggtaggtggatgggtggatgggtaggtggatggatgtgtgagtggataggtgggtgggtggatagatgaatggatgggcagatggatggataagggtaggtggatgaatgggtgggtaggtgggtggatgggtggatgagtggattaagggtgaataggtggatgggtaggtgtatggataagtggatggacagatgggtgggtggatggatgaatggataggcagatggatggatgagggtgggtgggtgaatgggtgggtaggtgggtgaacagacggatgaagtgtgggtgtgtgtgggaatggatggatgaatgggtgaatgggtacataggtgggcaaggtgggtggacatgggtgagcaggcatgttttcacttacttcattctgtaacaatgtcagagatcatctcagggcaccacagtaggatgcaaaataaaatctcaaaaggggaaaaaagataaaaagcattctgggtgctgaactgatgaaggaaatgaacccatggccaggctgctgctcaggtggaccccaggaagcccttctgggcctgcaagtggccgcctgctgcatgcagggctgtcctgactgcacggcggcgccaacatcaggctgggaggatttctctcagaacgcccacacctgcctgcctgtttctagcagaactcaagctgtcggtgccaaggcctgctctcccctcatcccaatcttccagcaagaggcagaggcaagctctccacaggcctacagtggcagggccactcttgcactctgtgccagtggccaggaacatgtggctccgcctgggtgtgtcacagtaccagcctgtacctgcacgaccctgttctcaggcatctgggtacctgcagctgggggccggcacttgtgtacccggctccgaggaaggaccgacacccaggaggggaggctccaggcaggccatggcttccaggaagcagctccggaagccgcaggcagtggctgcaggtggtgtgtttctgaggccaaatcggtcctctcttcaaccccagggccaggaagcaagctcagaatagggccaggatggagtctgggagcgctggaggtacagagggttgagggtgagccactgaaggagaagaggagggggcctctgtatgtctcagaaaatcagtgctcaagccgggttgaaccctgctgccccgggcatggtgggttcaagcctgacggaaaaccccctttcagtgtccacatttccaccctcccagacctctgacctcggcctccactccacacacacacacacacatacacacacacacacacagacacacactcttaatcagggcccaaagccctcctctgcactccctgccgaccccagggacttctccaacctctctccaactaaatcacattcaccccaccttcttcaccctgctccggcctgtgctggcctctctggaccaggtgtgcagctcggaagcacgactgggtgcaagggagacagccccaggcaggagcggccctgggggcgctgggcctccctcccccatcagggcaggaaaggtggacccctcgcccacacctgacctcctactccagcctctgagtaaggctcaggactctgactttcccccaggcaggtggacaggggagggggctgcaggtcaaagctcactccccaccaacctcctcacattcctccattcactggatcaacaaacacacccactgcccagcaccgctgccaggcatcagctcccaacgcagatgagtcagccccgcccgtgccctccagggtggggtggtaccagggcaggcaccaatgttcgggtccaggagtgcaccaggagacccaaagcccagcttgagggagggcaggaaggccttctgctctggaaggggccctggagcccggtgtggagggccggaggccggccttccaggtgcattccaagaattgcagagtgcctgtctaggagcagcggccgcccaggttggagggtgtccagtgagcgcctgccttggctggctcctcaggcacacccggggctgtggcctgcagctgctcctgcactggggctgagccagcaaacttccggggctggggctgctgggcagggcaaggtccgcacagggagcagacagacgcagcctgcaattcggcgcttatccccaccggagcggaggcacaccaaagccaaaggacacgcagctggcctcaaagcagaagctgcatcggggctgggaagccattcaggagcccttttctctcccctcgccctcaccctgagccctggccgccacggcccacacagcaggccctccggagagagatgtcaggactccgagtggagacactttatccgcatgttcttgaccctcatacagcccttacgggtacttattctattttacagatggggaaactgaggctccacagagtcatatccgagcctgaggccgcacagggagtgctggcgccggttctcagggcaggggttgtgtctgctctgtcacatgtcacacgggggctcccccaggcctgccttcctctgccctccctctagctgccagtggcccccaaaccccaggcctggtgcgctgcttcctgcagctctgactgagggtcagacgtcagaagggacttccagagctggggtctggctctcatccaaccaggctggctttcagagccgactatgggcacgccccatgctggtcaatgtcggcggtggggggatgggtgcccccctcaatctaggagacagatgaggccggacagcagaggggtggcagagaaaacccaccccattgcgacacctccgcggccctcatgcagctgtctccaccaaccggcgaagtgcggctgcccaagaccgccgagaccccatcaagggtggaagggggtcaggcagggctgcggagaggaggccacatgggtggcctggttgatgggtaggctctctctccccaaagcctgggaagagccatctctgctgagggatccccgaacgcggggactccggatccggctggctggaacgggagtcccgggccggggcagagagaggtgagcggcgcctgggaggccagtcccaccggaggataggggtgtaggtggacgggaggcggtggagggcagggacggggcggacagtgggggctgaggcgggagacggccccgatctgcgcgtcccacccccatctccgcccaccaggagccaggccagcagggaccgcgagggggcggccaggttattcacgggagtggggagaccccttaaagcgccctcagggaccggccacagtgggcggggccacccccagccacccacctccccccccaggccccgcccccggcccgcgctcgctccccacgtggccgctgacgggcggggcggcacctcctcttcctcccgcccgccccgcccgccccgcgcccgccaggagccaccgtccgagccttgcggagcgcggcagtgggcgccggctgcccgcagcccctgacccggccccggacggagcgccggccgcaccaccgccctctggccgttgcctcaccgggtaagtccttggcctcggggtccgcttggagcttcaggggaaactgagtccgggaggaggcaggggcgtgcttgggtccaggagcgaggttccgggctgcggcgtgtgtgcccaggtggcggcgggcggtccggcggcgcagggtacagttcccgggcggggaccccagggcgcccctggcccccccggctccgcgcgccccgctcgggactatggtcctccgcgccgaggcaccgcccgagcgcgcactggccgcagagtggtgggcccagggtcggccgggcctactcccagggcaggcgggatttccgcgcctcgcggctgccacatcctgaccatgaatcagccacagttgggaaaataaacttcaacttcgggtccgccgcccgggtggcaccccgaggtgcgcgccggcctgcggccccaccctgactgcttggcttccagctgcccacgcgcaggtgggcgcacagggagcccttcccaccccgcaaccgctggcaggcttaggggaatcagcctccatcacagctctctgttccttttgggtggggtaggatccaatccctgtacgcccccagacccacccgtcaaccctctaactggggagtcgccccaggagtgaccatgactaaggaggggaaggcggggtgaccagctgtgtccctgaccgtccccaatgccccctggggagcacaggcgtggggggtggtctgtctgtctgggccttctggggctcaagctccccacccagggctcccgcagctcagctgtgaccacagcattactgcccactccagctggacacaccaggaggcagagaggcagagaccctgcccaggcagggaaccaggaacccaggaaccgggccagaggtcaggcacacccagaaggcgctggacgtaggaaattcccttactgccagccctgcccctccgtctggcactggaatggagcaggatactcgccctcttccggcctcagtttccacatctgcactctgaagggtgggacagcagctcaggctgggacctgctccctgccgccctgcactgggaaggtggggtcccagagcagtgcctcagaccccgagggtgccacccagccaggggcttttggggtgtcggtgctcagcccccagtgcagcaaatagtagcattgggttccaggcctggggtctgagacctcacactgctcccacccctaccagggcagcagcaattttctgttctaaaagccaggttggtgcagtgggccctgcccaggccctgccctcccatccctggactgtcatgggccctgcagcccggcaaaggggatgtcgctagtggggacggaccaagtggccaggtgcgactgtagcctccacagccagggctcctgagttaaccttcaggtgagcgcccactttgtggaggagctgacggctgtcaagcgaatgacacacaccgcacatgtggggacgtggaagctcctacctgaaatagactctgcgccttccatcaaagtgcagttacttcctgggttggaaaagttatgcggttcatgcaggctgcgggaggggtgggtggtgactggaaagtgatgcggtgctgcctgtgggtgtggggcaggacgcagctggcccagctctggacggggacagtgaagtaagctcaagcccctggctttttgctggtgcctggaggtcaaatttccctgtagtcaggaatgagacctgactccctgctgccagcccctcccctacctccatcttgcaaacagcaggtgtctgataggtgtgtggttcatggcccagtggacacattacattggagaaggcacacccacctctgttttcaggatggtggacgggaaggccgggaggtggaggccacataggagccagtctctggagggtggtccccaggggccacagcagacccaggcctagtggacacctaaagtcaaagactaagttctaccaacggtgggaaggagagagggcaggggcacgggctccccgtcgctggaggggtgagcagggtccaaccacctggccccctgttagagaggcttccactcctgccagcctcaccctaggagggagagtcctgcctggtctgcctctgagcacccagacagcctgggtcctgagctggggtgaggtctgctcacacagctgccccccagcccagtgccggtataccctggcaaccaccaggccaggagagcagggcagaccggtggtgcctgtcctctcctgaggggccgtcctctctcacagccctttctaagctgtaattaaataaggaaccacaggggttgcttagggtcgcccctctgagggctcatgtcagtccccgagggccagcctcaggccgggtctgtccactcaccattcacgccagcctgggcagggtctgtgtgctgggtgagtgggtgaggaggaaaggaatgagccagcctgcggggtccctccgcacggtctcccaccctcatccctcccagtgcgacgtgggtcctgcaggagcgttcatttcacaggtgaggcgcgggacagtcggtgccattttacactcagtgccatccattctgccaggaggtgctgataaagcccctactgtgtgcatctgcccttgtgcccagagcctggagcccagccccgctcagcacggtgccaggcaggtgcagggcacttactgggggtcagggtgcaaatgggctggccccacagagtagctggaggccgaggccccccagcccttgttgctaccactggggtaggctcagggtgctggcactgccactctgggaataggacaggcctgtcctggtcaagtagccattaccgggcctccaaactcgggggttggtggggcaggaataggcccgccctccaggcaaccacctgtgtcactccagagcagcccatgcagacagacaactgcccaagggccagcctggaccccggagccctcccagccagtcggcctgggtcacagcctgggtggaatgaccagtgtggtcacagcccagatgggatgactagcgtgaaggccctgaggaccttgccacgccaatggccaagggcaagggccaaggctgctttcctctttcgcctgcagcttttcccagaggcagcagggagggagagagaggtaccaggagagtcctgagagaagggccagcctgggctgccccgagcctctgtgccctcagttcactcctgttctcaccccagaagggtgactggccgtggctggggcaccctccatctccctcagccccaacctctgtctgttggaaatggcatggagacccagaaggagcagatgggcaccactggaggcctggccaggctcctggccgccgatcaaggcctttgcagggtcagagggacatgggaagatgctgccaaggcccctggccctggtgccctgggcagggaccctgtgctcccgtgctgtgacagcgttataccaccccacctgcttcctgtgacctggacacagtctgagcaccccaaggtccaaagtgggagaggtggggtgggggagagggagtggggtggattggagggctgtcctactgttacagggctctgccccgggcccacctcacagtgaaggcagaggcccccaggcagcccttggtgggccagaactcaaccaggagccacactgggggcggagggcaggctgtctgcttcccattttgcagacgagggctagtgtcaaagcctagctttgaggctaacccagggcacagttgaggagggagggagagggaagcagtggccgctgagcacaccagccccgggtagtggcttttctgtatcatctccaagcccccattcagctgctgtgggcagaggccagccccagcccctcgctctgcccagcgagtggccagctgcccaacacgcatggagtcccagtgggcatggccagtggtgcaggggtttgttcgtgcctgagctgtcctggccctcgccgggtcgggggtggacgtggccagctgtgcgaggagggccagcatcccactggcctccatctccccatctgtacctgggtccttgcaggccctgggacatggcctcggtgtacagcctgcctgccccaccctctgtgcccccgggtccctgttcctgctccaggcacagctcagactgtcgcctgcacccagcctacgctgggaggaggacacagggtgggggtgagggagtagccacctgtccccacctgcctctgcttccaccttgtgcacagacatgagtggcctgagaacgggagccccttggggacacccagggcccctgcctatgcttccatgtgcagagggcccccccggctgccccttccctgggccaggccaggctgtggaggtgcaggcccaacagtgaggggctgcctgcaggagctggcagagccatgggccggacccaggaggggccacacgggcggtgctggcacagccaacccaggtcagagctacggggccctggagaacatcctggccattttacagatgagaaaactgagtccagaatgggcctggctgtcccaggcccctggcaccctcgtgtcccagcaagcattgccaagcggcatgttgcacccacgctgaggatcttgtttgcccagttgggcctgacgggctccctggcactggctgcctggagcagaggtcaagagacgctgagcaggggctgggaagattcatgcaacgtcctagctccgtcccagccgccaaacaggaggtgggctgagtgggaaggcgggcggtcagtgcgtggttatgcactggcattacaggtggcatctcgtcaatctgtcagtaagctgtgggggtggcattgacacactcatccgcatttgaggacaggaaccaggagatcctatgggtcacaggccggtcagcggaagagcccagtctcaccctgaatcagagccgtcccccaccctgggccctggtagcagcccctggccgtgctgggtgcgcaggctcagcctctcccccactctcaatctgtctttgttctccctgctcctgggaaggcagctgctagcggggatgtaggctgggggcagggaccatggagcctggctcgtgggcaggcagcgggcagccgtcttgtcttggcacaggcagggtgggggctggacaccctggggcccagctaggcacacagcaatcaggacctgaaccctgaagccggggcctggctccaatgagctgctgcccttccccctcccaggttgagagaggctttttctgaggacagaggagggacctggggcctcggaggaggcatctctgagtatgtctggtccggggggaggaaacccaggtgggaggattctggtgacgagctcctggccacctgccctcattgcccagcagaccccctgcagggtacgtctggggcctgcgataggccagccctgggctcatgccacctgcagggcctgatcaggccctgtgcccttcccagtccctaaccacagatctgtacacgtcactcccagccacagccatggtaggtgctggcaggccctcaggcccaggaagtacttccatgtagccgctcgtccccccatgcctctccctgggcccccagactccagcccagacccctgagaacgccagaggtgaccaggccctcagggagcaccccgttggccctgctgtttgtgcagtggagacactgtggcctgtagaaggcccattcggtgactggcgagccgcccacccacccaggccctgcacaccctcagtgcaggtggaagcgagagctgggcttcctggcgtggggcctccgcccttcctgtcctcccttgcctgggctgcgcttgccgactctcctcccagtgacccctcctcccagtgagccggggcatttcctgtttgctgcatccccctaccccccctacagagtcaccctcctccctgtggcttccacagggctctgttcctaacccaggaagatgtaccttccccaggcccattgtctgccccagatcctggggacacagagagcccagctgtagcctggctcccgggccagtggtgtcccctggcgttcagtgctggccagcccggaccccccagccacctccaccgacacttgccagagtgccatgaaggacccctggcccccagctctgctctctgggtgacccaagcaggggctaccaccgctctgagcccagcttccctctgtgagatgttgctgtcttttgatcattttgcttgctttcttcctcagtatgaaacgaccatattcatccgagatgcagcttcagttagtgattgggcaggtgtcccggtggtatcgcacccaccatgtgattgaaatccgtcaccatgcggcctgcttcccatctttgtcttctgatcatgatgctgctgagagcgcctttctgcccacctgctcccagggggcccttctgtcctgctgtgggtcctcacagtggcccgggggccctctttgcacaacaagcggagttcaagatcttggagggctttggaggcaggagccttgcactccatccagatcttggggactgcaggtggcatgagggctggagtgcttcttgggtgtgagacgggccaggtgacagtgaggacacagccagccctcaccaaggcccagtgcgccccatgcccctggacacgtggcagtgggtggacccccatcctcacctgccttgaggccccctgtgcacagaccctccctgggccttgccggcagttggtgagccaccaggtcagtagaggtccctcaaggggctgttggcctggtggggaaggtgacacatgctggaggctcaaaggagctgggagtctgagtgtgagggaggggaatgggggtcatggtagggcaggttcagctccaggtgcctccaccgccctgcagggcctgggctgcccagaaccccggggtgctgccaggaacgcgtgcagtcctggagatccatgggttgccaagcagtggaaaaattggggctctcggaggagctaaaaatacagtgtggcagcccctgcctcctagttccggaatcctctcctgccgttctgcccacccaccccgtggaagacaagctccctccctgcacccccaccaccaacgctggctcagggcccagaagcacccagccctgtgccagtgccagaagggcgacaccacagctgcctgcccactcccaggcagcagccccccacaggtgctcatgtgcccagccagtgcctgccctacccccgccactgcttcagggtccccagagccccttggtcccaggcacagtaggcagtacctgccaccccagggctgccaggctcagggcttggcctgttcctcgtggggagcctggacccaggcagacctctcccttccctaccagtggggacttcacaggggagggggctgtcccaggcagactcagaacatgtcacagcgggggcctccaggcccattggtgctggccgagggcataggagctcccacactgtgctgtggaaggccctcctcgcctggctcctgggaggcaagtgagggagccgaggcctgggggcttcagtggctggctcaggtccctcgcgtgctgggattcaagtctgggtaccctaaccctggcctgtgtgccgctcagaaccatgggcccatgcaggagcccccagctactctccacagctcggtgctgggcctgcctcaggagcccacactccctggctctggttttctgtctgcaccgcaggggctaggcacatggctgcaggtctagtgaaggccagcatggccctgtccccacccacaccacacactcagcttgactgttgactgctaggcggggcggtggcccggtggcttcccgagagtcagtgcagctgccctagcatgtaggcattcggatggaggtgctggcatcaccacaccaggctggccaggcccaggcccagagggggaccctgcctgccagagctagagtcaggggagaggcatggccccgtcctctggaagccccaggctattggttgacaaaagcaagtgctgaagaaccatggtgatgtcccactagcatgggtggggtgagcccctcagacctcagagtcttcatctgcaaaagaccctgccctgtgcagttccattggtgctggtggactgccggggggggtggatgggacgccccttcttggtgccctgacccttttgctgtccaaggcatggggtctggcctgagccatgggtactgggccctgcagagcctggatggtcctgccctgcctcagccagagctggtgccggctgtagaaaagattgcgaagaacgcaaattcctgtgcctgtggggaggtggccacgccctacagccggggctggggagctctgaggacacattcctgcgctggtggccccgccaacccactttccagatggagagcagaggggaagggtagcctgcccaggggcacacagctcagcaatgagactcccgcccccttcccttctcagttggcactggcaccttccagcgtattgttccccatagccccgtgcccctgagatcagtaaactgtggattccttctggaatccttgcagaagtggacaccaccccccagtgagaacaggcaaggctgtttttgcagagctcgctgtagcagggagtcggccaccgccacccgcgtttagcagagactcacaggcgggcgggggagtgggaagcctcatggttttctcatatggataattcactctatacatagaaagctttttatagacacagggaaggctcggggatgccctgagagaggctgctggctggaatttgggctcctatgagatgagacaaaaatcacagaagctgtcagttattacccaggtcccagccatttggggccagtggccagattgcgggtcagagtgctgcatatatggtctggccgtggtgtgtttgcaggttcagcctcatgctgaaaagcagttggaacattctccggtgtagagcctgacggggggcctgggtgagatcgggcagccttggcagcaccacagaaggaggagagcagctccggcctcagcctccggggcctcagccggagccctgtctatgccgggccgcagcccagcgagaccctgttacactcactgcccccagacagcacccggtgggacacggccagctggggcagctcagacacagagccaggcacccaggcacgggggtataggaacctgatgggcaggagggccagtttcctcccaccgtggctccaccccactgaccaagggggatcctcttgactggggtctttcaggggcttgcacagggcaaggagcgctgggcagtgccaagaggggcagtactcaggtcagggagcatcttctgtgtccagggacaccctggggcctggggcacggtggctctcggcggcactgcttgtctctaaaaggtcaggattttttgcatggagggacccccggggctcttggctggagaggacactctggatgccaggggccgggcctgggagagttcataactccgtccactcagcctgtgccaaggggacagggactccggccaatggaggcgggggaggaaaggagggtcagttctggggcctctttaggcagcaacagccaaggcgggtgggaatatatgcagaggcccggctgcctggctcttcatggtggtgggagcaaccctactgccaccaggaggggcgttggggacctgaggctgcctgggagggacccggctgtctctggcagctcagcggtcagcagcgatgagaagccaggggagcgtgaggagcagcccaggacagggcccagagtgggtgggcagaggtggccggaaggtcttgcgcatctgggtgagtggacggccactgggtgaccaagagggccgggcctgggagggtggcttaaaaccacagtgcaccgggggctccgggctctccgttctacagtgcccagaccaggaccccctgcagggaggaggggcatcccaaggacagcctctcaggatgctcctggcagcctggtgctggaggtgcagaagaagaaactgaggcccaggcaggatgagtgactgggccaaggtctgctggtgagggcccgggctggggacatgcagatcagaaccctggcttacacctgtcaggctgcctcctggaaggagcccactggccccctggggcagttggacaggtggagggctgaggggcggtgcggggagtaggggctggactgccggaaacaccaggcttggtcgtggaccaggctggggagtgggcctgagacctcaagggcaggtgctccaggacactctcccaaggcaggaggggaggaatagagcctcctggggaggcaggcgcttgggtgctcgaccccgctcagctcccgtgacctcaaatgcccttcagcctggggtcccctgacttaccgggttgggcagcacttgaagcaaagccatgtgggacctccagtcacagcccagccgtgcccaggtgtgggactgtgggcacagacccagcttctctaggacccagccgcctccagttccccacctgttgtgggaggtataaagtgcctgccttggaggtggtgggaagccgagggccagggtggagagtgctgggccggggtggaggctcagagcgtgtccctgccaggcccggccccctagctccctccccgaggctccacgctgctgttctcagacgctaaatataagatctaagccatacatggttgcaggagggcctgggatgcccctgaccttcgaggccagttcccagggtctgtggttggggacagcggctggggggatgtggtggcgtggagctgatgtcagaggtgcaacccgcctgtcctgctgttctgttttggggaaaggcacgtgttggggctcttctgggctgggcctgttacctacccgggtgttcccagggctggagtcagacctgttgcgactgaatcctggtaaaaccctgagtgccaagggtttccgtcttcctgttggtgtgggccccctacccacatgcagacgggcagactgaggcccaggggagacctgggagtcgcccctcctccccagccacgctgctgacgctgtgggcaccccaggcatgcctgaggtttggaatctccctgtccatattgtccactggggcgggggaagtgccctggggtgagataaggcagcctcagatgcgccgttttgtcgcatcattaccgtgggtaatgttccagccaggggagcctcccgctcccccgagtcctccccaagctcatccggtcccgtcactctgcaggggccgtgctggcctcgtgctgcaggtttctgagccggctcctcccctcccagccctgagcctcggggtcctcatgcgcgcagtagggcccttcctgcctgccgcctcggttgctgaaattcggtcagggatgggtacagggaagcctaagatatagtgggggacacagtgctacccctaaccctcagcatggcacgtgagcaggaattgcagcagagaaactgagaccgagggaagtggccccgcctgcgctggtggccaggaggacagcccccatcccctccccgctgacggctccctgccctctgcctgcagctcggcaagatgtcggtgaaggagggcgcacagcgcaagtgggcagcgctgaaggagaagctggggccacaggattcggaccccacggaggccaacctggagagcgcggaccccgagctgtgcatccggctgctccagatgccctctgtggtcaactactccggcctgcgcaagcgcctggagggcagcgacggcggctggatggtgcagttcctggagcagagcggcctggacctgctgctggaggcgctggcgcggctgtcgggccgcggcgttgcacgtatctccgacgccctgctgcagctcacctgcgtcagctgcgtgcgcgccgtcatgaactcgcggcagggcatcgagtacatcctcagcaaccagggctacgtgcgccagctctcccagggtgagccgcagtgtgggagggccgcccaggcggacgctggggacctggtatgaggcttcaggcccaaaaggccccgggaggcctggggaaccaccaggaggaagcgcagccaggcaggcaaggagggcttcctggaggaggactggcttcctgggctcaggaaaaacatccacattcactccgagtctgaggcttccaggtcaccccagtccccgcactgctgcaccagcggtccccctgtgcccctctctgttgtgtggctctgccccacccttcctccccgtcctgtgctggctcccaccctctgggctctctgccctcgtccacacctcggcggcaggagtcactgagtcagagatgcgaatccacccgagtggctccctacatacacctgcctagctccaagcccttcagcctcagcccagacagagcccttgaggtctggcccacacctactgatggtgtcaccctccacctcccagcgccttccctagcgcctccctccccgccctgtcccctactccagcacccaggggactcgttcccggcaggcaggcaggcccttggtctctgcctctgctcgtgttttctgcctttgcgtcctccaaggtcctgcgccgctaagcctttaagccccagctcactttcctgtcctccaggaagtctccccaggctgtgcccaaagttagtcccggtcccttgagagaaacccttgctgtgccactccatggctgctgccaggtcctaccgatgcttggggacgagctagggtgggcagtgatgggcggggctgggcccatgggggcggcagttacctgtgcaggcaagcaagccagaggcgcctcgtttctgtcggacccaggggacagaggcaggtgtaggggccagccattctcagcccgtctccccagcctgggcctggcagggcccctctatggagtcttttgtgaattgttctcagcagggtcagatgagagacacccccagaactttcacagctccagatggggtgggaggcaggggttcataggaatgaggttgtgtctgccataaacacagtaagtgctgcattgggagaaaagctgggcccagagccagtgacaggatggggcagctgcctccaagcccttccctgcagggtctggccctgtggtccaggagcagggccaggacaccgaggagtggggcacctcgttgggtcccagcccactgctgtgggccacagacaagtgcccggcaccccctggcgtctgcctgccaggcccagagccccagccctgagcccagctgcacaggcatgggaaggggtgcattggccctgctgagcctgcccactccaccctggcagccctggacacatccaacgtgatggtgaagaagcaggtgtttgagctactggctgccctgtgcatctactctcccgagggccacgtgctgaccctggacgccctggaccactacaaggtgggcggcagggcctgggcctgggcacatggggctccctgcctgggtgtgccctgaccccgccctccccacagacggtgtgcagccagcagtaccgcttcagcattgtcatgaacgagctctccggcagcgacaacgtgccctacgtggtcaccctgcttagcgtgatcaacgccgtcatcttgggccccgaggacctgcgcgcgcgcacccagctgcggaacgagtttatcggtaagcacctgccctgggccgcatgcccgctcctgcccgcctcttggccagtgcatcccatgctgcatccacctggggaggtgggagcgccacaaaagctgcccccgacccagggccccagaggaaggcgccatctcgggcctgccaccacctgccccttcaatggacacaggcctcagaacgcctgggggtcaaccctggaccgttctcatttgtgagactggccaggcagtggagccggacagggggcctgagacctcgttctagccctgccagttctggcagtgagccctgagtaagcatcactgtgtgtccagcatgatgtctcccctccagagcctcaggtctctggtgtcccatgagtgcagcagggcagggtcaggtgctctgggtggcagaagtgaaatggggaaggcggggagtggcctccgaaccctctgaccctgtccgtcccttcccagggctgcagctgctggacgtcctggctcgcctgcggtgagtccccactgtagcggtcctgccggctccccctcctgctcccaaggccaggcccacctgccctttggctcccagccacctcacctaagcagcacctccagatggcagggaggtggctccctcggagtaaccccaggggtccagccagaagccaggtctcaggctagaatccagctcactgtccctggcagctgcccacagaaactagggttgcagcagccatagaaaggacagaatgagctcatatcctttgcacaccgtggatggagctggaggccgtgatcctaagtgaaccaacccagaaacagaaaatgaaatgccaataagagggaactacagggtggttcacgtggacgcaagatggagacagggacacgggctccagggcgagagttgaaaaactacctacagggtacagtgttcgtcgctacttggtgtcaggcccactagaacaagggtccccaaccgccaggctgcggaccggtacctggcctattggaaccgggccacgcagcaggaagtgagcggtgggcgggcattcctgcctgagctgcacctcatgtcagatcagcactgcattagattctccagcgcacgcacgcgcgcaagggatccaggctgcgcgctcctcatgacaatctaatgcctgatgatcgggggtggaacagttttatccctaaaccattcccgtcaccccagtctatggaaaaattgtcttccacaaaaccagtccctggtgccaaaaaggctggggaccactgccctagaaggcaaatcgcctacgttacacagtgtaccatgtggcaaacacgcacatgtacccccgagtctaaaataaaaattttttaaaaaagaaactagggttgccaggtactgtatgggacatgcagttcattcaggtttcagatacacaacagacgatattttggtgtaagtatatcccagatgttgcatgggatatacttatgccaaaagttattcattgtttgtctgaaattcaaattgaacaggtactctgtagtttcatttgctaaatcttgcagccctgctgggaacccacatagctgagaagctctatccaggcctcagtcaggactgtactcaggggggtgtccttacacccagggaaatcagcttggaggagcccagggctagaatgcctggtgttgaaatggcctcaggggccaggcgcggtggctcacgcctgtaattccagcactttgggaggccaagatgggcagatcacctgaggtcaggagttcgagaccagcttggccaacatggtgaaaccccatctctactaaaagtacaaaaattagctggccgtggtggcatgtgcctgcaatcccaactactcaggaggctgaggcaggacaatcattggatcccaggaggtagaagttgtagtgagctgagatcgtaccactgcactccagcatgggtgacagagcgagactccatctcaaaaaaaaaaaacagaaatggcctcagcaaagtttgcccacatgggtgcctgtgccccaccagtgtgggctgaagggggccggccctgcctgcggagggctgtgctcattgaccagactgagatgactggcaagtcctaggcccagtgaacactaagtttcctcctgctcaggccagagccccgcccctcctgtatccatgcagccctgtggacccacctcaggtgtggtcttcactgtagtcacgcagcgcccaggggagggccttccctcccccaaggtcacggcccggttccattgtgtgccacctccccaggccttggtgcacgttactcgatgggagtgggcatactcgcccttccccttccccaggggcgtgcgggtgcctggtgacccgggggcagcctggcagggcgcaaggcactgacctgggagctgccactcttaggtcgctatccctggctatgtgggtcacatgtcagccacagctggctatggcctggctcagagtcccaggtgggctgagcggggctggtacactggcgctgacccaggctgccccgcctgcgtgttggtggtggcagcagcaggcttagcccacctggcccctcctgcacagagacctggaggatgccgacctgctgatccagctggaggctttcgaggaggctaaggccgaggacgaggaggagctgctgcgagtctctggcggggtcgacatgagcagccaccaggaggtctttgcctccctgttccacaaggtgggctgggggctgcagggcggagggcagccctccagggcaggctgtggccctgaggtccagaggctgggcctggaacggtcctccctgccctggtcagaccctgctgtgacctgggccatggtgccagctttggggtgagactccagggagcagcaaggacccaggggttggaaagggaggtggcgcctagagcgggcagcctgggggccgggctgggccctgggggcaaagccagggccacaggacccagaaggacggggctccaaagaccagtgcggcccacagccggccttactgtcctgggccccagctgcccagtccccatcaggtgggcttcagaggcctcagggcttggtgaggggctaagaggctgaattctcgtcaagctcaggccttcccctcattccctgaaccttgcagctctcatctgggggcagttgtgtccccaggtggcatctggcaacatctgaagacatttttggctgccacggctgggcagggggtgctgttggcattgagtaggtagagaccagtggttctgtttaacatcccataatgcacaggacagtcccacatgtcaccagtaccacagtcgctgaaactctcatctctagggatccgtgggaatagagggggtgatggggctggacaccctggcagacaggccacagtccttagtccaccagggaggggccggctgctgacctgcaccccacactcgcccgtccaggtgagctgctccccggtgtctgcccagctcctgtcggtgctgcagggcctcctgcacctggagcccaccctccgctccagccagctgctctgggaggccctggagagcctcgtgaaccgggccgtgctcctggccagcgatggtgagggggcggggcaggggcgtaggcacagcctggtgggcagacactgaggtcttagaccatgggggggggagcctgcccttggccccaacccatcctctgcccaggggaggtggccgctttttcctgcctcttcctcaagcccccatccctccctctccggctcccttctcccttgaccctggacatcccctactgcagcccaggaatgcaccctggaggaagtggttgagcggctcctgtctgtcaaggggcgacccagaccgagccccctggtcaaggcccataaaagcgtccaggccaacctagaccagagccagaggggcagctccccgcaaaacactacaacccccaagcccagcgtggagggccagcagccagcagcagctgctgcctgcgagcccgtggaccacgcccagagtgagagcatcctgaaagtttcgcagcccagagccctggagcagcaggcgtccaccccacccccacccccacccccacccctgctccctggttccagtgccgagccccctccccctcccccaccaccccccctgcccagtgtgggggctaaggccctcccaacagcacccccgcccccacccctgccaggcctgggggccatggcccccccagcacctcctctaccaccacccctgccaggctcctgtgagttcctgcccccaccacctccaccactcccgggcttgggatgcccgcccccacccccacccctgctgcctggtatgggctggggccctcctccacccccacctccactactgccctgcacctgcagcccccccgtggcgggaggcatggaggaggtcatcgtggcccaggtggaccatggcttgggctcagcatgggtccccagccatcggcgggtgaacccacccacactgcgcatgaagaagctgaactggcagaagctgccatccaacgtggcacgtggtgagggtccccagacccccaagggaagcttcccctaggacgggggctggtctctgctggggagaggggcaggtggcacatggaacttgtgtgcgcgtcctgcccgtgcgtggccagggcagcctggcccttgctctgggctcggcgcctgtggttgaggtggggacgggggaggagcagggcaggggctacctctgaggacccccctccacatgctcccgtgagccagtgcatctggggtgccatggtgccctggggccctgctacaggtgctcaggtagggaggtagggtgcctgctgtacgctggacctggacctactgggccccaggcaggacatcctttagaccctctgggaggctccagcccctgcctgctggatcgccaggccccggggctgcgagagcctcactggccgtgtccccacccgacagagcacaactctatgtgggcgtccctgagcagccccgacgccgaggctgtggagcccgacttctccagcatcgagcgactattctccttccctgcagccaagcccaaggagcccaccatggtggccccccgggccaggaaggagcccaaggaggtggggacggggaggggactcagaccggggccgcctgcctggccaccctccggtaccagcctgttgggtggggggttttctagatcactttcctcgatgccaagaagagcctgaacctcaacatcttcctgaagcaatttaagtggtgagtgagggaggtagcccccatcccaggccacggagcctcgcctccacctgagccttctgacttgggcccagcagtgccctctgcaggccgccatgggaagtgcacactgcatcccctaggcaggattgtaggcgggtaatagccccatgctgccccagctaggggctgtccaggctcccagggacagagcgctgggacctccccccacaaggccacagacaagtagtggctaaaccagtgggccctgactctcagcccccgagtcctttcctgctgcgggtgtccagcactggcccgagggagctggctggacccgacccatcctgcatctcctgagcagggcccatggagggtagcgagggtgggagtcagcctgggtccccttcaccgcgtgaccgtgggcaacaactcgactgttctgtgtcccccctgccctggccaccccatgactacgtggggaaaccctgccaggtggggtcccaaagaggctgggtgggggtgactcatgattcactcacccctgcccggtcctctccctgctccagctccaacgaggaggtcgctgctatgatccgggctggagataccaccaagtttgatgtggaggttctcaaacaactccttaagctccttcccgagaagcacgaggtaagaggaccacccccacaccccacccccagttagtgccaccaaccaagggagaggctgtcccgggggctcccagcagggagacagagaagggaggcatcccagccctacctctgccctgaaccgtgagccacagggagccatgatgggcactggaggggctgagcccggcgggcagtccgggagggcgggaagctggcatggggggatcccacatgccgttctcctcctggcagattgaaaacctgcgggcattcacagaggagcgagccaagctggccagcgccgaccacttctacctcctcctgctggccattccctggtgagcatggccgccctcagaccccagggcctgggccccaggtgggaggagagcaggaatagggagcagggcccagccagggaggagaagaggctgtgccaatggctgccccgggctccaggagcagcattgcagcggttgggcttctaaacatcactcgagccccacccccagtccttcccctcaaagtgtggggctggaggcctctggaggaattggatcctgctctgcgcaggcccgggagggtgcctgttggatggggcaggcggtggaaaccccctccctttgcccaccacccaagccagagccctgtgctgagtgcccctctggcagggacaggtggggggtgcaggccactgatccctgtctgtgccatccccagctaccagctgcgaatcgagtgcatgctgctgtgtgagggcgcggccgccgtgctggacatggtgcggcccaaggcccagctggtgctggctgcctgcgaaagtgagtggggccaagcggggcacgtgtgcaggagggacaggcctccgaaccggggcgggagggctgctcggggcccctgctactgccagtatcataatggctgctaagagcacctaagggtgccagccttcaccaccactccggaaaccaccctgctgccaccacctcggtgcacacacctactggacgcacagacacacgcatgcccaccgccactcgggcacgtgcacacacacaagcacactgccactctccggcacgcgcacacacaagcacaccgccactcaggcacgtgcacacacgcatgcacaccgccactcgggcacgtgcacacacacaagcccacaagcacagtcacacacatgcacacaggacacacagacacacgtacacacccccccaacacacacaccctcacatacatgtacagacataagtgcacacacacgggcaccatctctgaaaggggaatccatggggacctgccacagccactgggcagggagagggacaggtacggaccagtgaggcacagctcacgtctgtcaggcacactgtaggtgtccactcccgtcggtggagggtttgcagcccccaggccctgtcctgtgatccttccggtgctgggctgagcctggggaggagccagggagtgcaggggcactggcaagcaggaccacaccccaccgccagggcatctgggggctccgaaccaagagcccctctccagccctggctgcccctgcaggcctgctcaccagccgccagctgcccatcttctgccagctgatcctgagaattgggaacttcctcaactacgtaagtcaggggcagctccccatcccacctggtgccaggggctggtgagactcactccctgcccctcccagggcagccacaccggtgacgccgacggcttcaagatcagcacattgctgaagctcacggagaccaagtcccagcagaaccgcgtgacgctgctgcaccacgtgctggaggtgggccgtggtggcgggggcataatgggagggcttcaagtccccccggacctggggtgtagaggcgtagaggccatacccccatgcccaccactcaggccgccggtctccctgtctcagggctccgtctagagccagcagcctcagtcagagccacgcccccacccctcccagcaccccttccttcctgcagcactggctcccctgcacgagccttgtccctccccaggatacctgtccctgatctgggggacagtccctaggaaaagcagaaacatcacaaagtcatagccaggcccaagggaaagatttgagggtctggagtactgggggttttctggaccttaattgctaagggttagagctgggggagtgggaacagggtcatccccaggtggagagtatgaccacagtggatctcactggacgtgtcccattgcaggaagcggaaaagagccaccccgacctcctgcagctgccccgggacctggaacagccctcgcaagcagcagggtaggtagctcctgccagcccgcccacctcagccaggtgggggcctgacttctgtccccaggcagtgaggtggctgcccgccagggctgggtctcacagctgcagcgcagccccggcgccacggagccctgcccaatagaacacttcccttttgggacaggaccgggtctgccgtggcctatccccttctgacttaagcgaggaaacaggcctagagtgggcaagggctggccaggtcagggtcacaccacgggcaggtctaatacagccccttcacaaggtggaccttcacgacagccgtgagcaggctcgggcctccctcattgtatagatgaggaaacggaggcccaggaaagcagtgtcacctcctgggtcacacaacccaggcaggagggcagcctgggccaccccactacacagtccgggcccctagcacggagttcttcccgggctccacctgccctggaaggttctctggctcaggagctgctcagccttggggagaactaggcaagcaggacaggctgaccgttagggtccccgcccagatgctcacagggggctgagggtcagctggaacaggcactcaaccccaacactgcacgtgcagcctcagagtacagcctgcagggtgcacagtggggtgccggggggtgcaggggaggggctcccctgtcccagcgaggctgacgtcagccgttgctgtctctgcccggccctcctcacctttcaggatcaacctggagatcatccgctcagaggccagctccaacctgaagaagcttctggagaccgagcggaaggtgtctgcctccgtggccgaggtccaggagcagtacaccgagcgcctccaggcaagtgggcacctgggcctggggctggcgggagaggctgccctgatagagtgagctgggcgagtggctgtgctgtctcctggctccagggtggatcctggggcccgagtttccccaggtgtgcatggtcagggcacaggcccctgctccttgtcagagaccaccgtcctcagggcctgtccctgtggccgtcaccctcccgcaactcagggcctcaccccgggtggtgcccgcgcggggctctcacgggactgtcacgtgcccttgcccccaggccagcatctcggccttccgggcactggatgagctgtttgaggccatcgagcagaagcaacgggagctggccgactacctgtgtgaggacgcccagcagctgtccctggaggacacgttcagcaccatgaaggctttccgggaccttttcctccgcgccctgaaggtggggcagcccggcgggacacagcctgtctggctagagtggggtcccgaggcccctggccttcctccggcaggatgggcagaggcacctttcgtcgggccgacacagccatgtgggccctgcgctgctgcggctcagggagggggacgcccaggcccatggagcccctgagggatgccacgctggggtgacggggccacatctgccagtgcaggagaacaaggaccggaaggagcaggcggcgaaggcagagaggaggaagcagcagctggcggaggaggaggcgcggcggcctcggggagaggacgggaagcctggtgaggctgggccggctgggcggggagggggtgactctgggatccttgtctgtgctccagcctccccaccacccccagccctctaggtgggctccagggtcccatgccgctctctgagtgccccacgctcctcagtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctggtaagaccctctcccactgcctcctcatggtccccttgccactgtccctaccctgtgcctccaggaagtcctcctgacttcactggaaagccctctcctctccctgggccaccctggaggcccctaagactggggacagccgaggggacaggtggtggccgctcagccctcatccctccctccactcactccagctcctccactgtaaccgcaggccctgccctcagtgctgaagcagcagtccagcccgctgggctccagagagatgaggccaggcccactgaccgatgcccttgggctcagagggtgctagaggtggcaggaaaggcaggcggcaaggccctggtgggaggaccccattcctggggtggctgcctcagggtgctgggaatggcatggcccagtgtcccccaccctgccacagtgtagacagaccaaggacgctgaggccgggtcctgctctgagacatcagaggaggctttctggggaggaggttttgcagggcgttcaggtagacagcggaatggaggaggctgcacctgggctggctcgggggcagggtgcctgcccttcactggtgtgtccctccatccagtggccaccagtaaccctgcaggagatcccgtgggcagcacgcgctgtcccgcctctgagcccggccttgatgctacaacagccagcgagtcccggggctgggaccttgtagacgccgtgacccccggccctcagcccaccctggagcagttggaggagggtggtccacggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaaggtaactcagggaggggccccgggcaccgtcccacgccagggcgctggcacccagccggtccctccccttccccattgggcactgcaagttccagcggcacccaggagaggtgacttgggtgcggcacgggagaggaggcggcagtgcgtccaccgcagggcggctatgtgggctgccgcggcccgtgcaactattcctccaacctactaattccgaccttcacgccacctccgttagggagtagggggcggacaccgggcaccaggtcccaggcaagtggctgccatgtggcttagtggccagagaaccgggcagccctcagagggtgttggcatggctgtcccgggccccccagccccacccactccgagtcagggttgcttctgtgtgataagccgttgagtgcgtttcttttatttggaagcagaggttccccctgattctgatgataataaaacaaagaaactgtgtgtgatccagtaaggtatgtacgcagccggcgctccgtgggggctaacagcagctgcagggcagtggggctggagcttgctgcccacacccctccgggacactaacctggcttctctccagcccgcgtggtgcgtcagtgtggccttgccgctcccgcagccctggtggtgggcttcccgccccatcccctccctctccgcaggttacctgctcaactggtgcctcctgcaggcaggacgcaacctcagtgctggccccgggcatgcgggcctcgagagggcaggtggcagggccagccggactcccttagcaagcaggatccgggccctggggcgtgggcgggacctcctggctggcaggacaggctgaggttgctcctgtctggtgtcctggcgctaactgcagttccagtaaccctgtggctttcctgctctgtctgttggtggagggctatcttcactctaagtgtgtcaatggcgtggggccttctggggcatgtccccaggaagtctgtgaggagaccgggacagtcgcaagggcagatgctgccagggacaagtacactgcaacccccctcctgttggacagtgtcctcccaccccgaggccatgggtgggtctatggagaagcagattaccccccgcacaccgagtcttctggggggcgaccagccaaaggtcaatcagccaggtccgtccacagggctggagaggccaatgcatccagctagacaggaccagcctgcactgggtggaggaggggctagagcagagaaccagaaggtccagcccggccgatcatgagctctgtgagcccaggtcgtggcgtcttccagcacctccagccttgctcagagccagcccggtgtcggtgcatcacaaatatgctgaccgctgggcctggggcttaggctcaaggtgcacacctgaggtctgctggtgcccatcagaggcaagagcagtcgtgaccccggagaagcttctccggacagcttgtcctcgctgttggggcacggccttcaccctgggttccagcttttgcttccagggtcatcttccgagtgtggctctctggtgtgaagcacccacgtgtactttttagaaaggtgctggcatctcccttagaggctggaacttggacttgctggccctgagtgtgaggaacagtggagcatgcaggtctggggcgggcggccacatctgacaatggtccagtgaaagatggacgtgtccagtgccagctccacgctccacctggttccctcctgaacctgctacacgtgcttagcctccacccgccccagctcctgccacgcacgtggctgagggcaagaggaagaagtcctcttctctccccaactttttattttttattttttttcaagacggagtctcactctgttgcccaggctggagtgcagtggtgcgatctgagctcacagcaacctccaccttccaggttcaagtgattctcctgcctcagcctcccgagtagctgggaccacaggcacacgccaccacgcgcggctaattttttgtatttttagcagagacagggtttcaccatgttggtcaggctggtctcgaactcctgacctcaggtgatccacccgcctcggcctcccaaagtgctgggattacaggcgtgagccaccgtgcccagcccccacctttttatttagaaaatcttcaacaccacaggaaactgcatagatcagaatgaacaacaccttctccccgaaattacaaccatttgccaaaaataccaaaattgtgaccattttgctacattgcccccctccaactgaggcatctgagagtttcttataaacatcatggcactggagccctaaactcgcccacagacacctgagagcacagccgtcttcctcagtcccccccgggcagggtgcgctgccgtcctcccagtccgcccccaccgggcagggtgcgctgccgtcctcccagtcccccccccgggcagggcgcgctgccgtcctcctagtccgcccccccgggcagggtgcgctgccgtcctcccagtcccccccgggcagggtccgctgtggggcgcttcacgtccacatgcttctaatactcggtcccagtgcagatgtgccacttgccccaataattccttctctagttgttgctttgttgtttttgcaaacaagattgtatccagagtcacatgctgtgtttggttatcatatcacttcagtctcttttgttctagaacattcctgcccctttttgtcttgtatgacattgacgttctggaagataacttcactttgggtttgcctgattgcgcccccaagtaggtccaggttgagttttggggcaggagttctaccccaagggatgccatgtcctccccagctgggtggggacgtttgtggcagcagcgctgaccacggctgcgggggtggtttctgaacctccactgcacgaacaccacgctgtctggttaataagcaccggtggtgacctgtggaaccaaccgctgcagcgcggttctgtgttcgccgcccctcgtccgagcgttcccccctcccctccctttttccatcacgtgagttttgaacgtgcagtaatccttcactgccactgccgtgcatttgatggggaccagcgggggccctgagcgcttcccatctttggcacaagcccctgttcctagctcaccccagacttgctgatccccccatccctgcacgggccttggtcttggccatttctccaggttccctgagtggggaatggtgctgagaccctcctttgagtgattgttttggatagtttttgttttcttgctgtctgtttagagtagtggttctcaaaccctgcttgggccatcccactggggagctgggacaccacctggcactgtggtggcagtgggggtgacactcagacaagggccatcgagggcccctggaccagaaagcgaagagggcgttgggggcaggaggcctgtggggccatgtgtgggggccgtctgggtggcgggagctgttggggcagggctgagcgccctcagcagcccactggagaaagcgctgctggggtcctcgtgtggggcccagggcccgacgtggaagcaatggagggctgcagggggtggcagtggggatgaatgagtaaggacagagtgcagcctgggtctcagacagggggtgggggacaggccacagagattccctatctcagcagagaggagacaggctcaggctgccacgccttgccaaaacccagcctggccaggccagcccggcaccttccacctagataagttgtgctgctccagagaaagagcctggggtcagagtggacctgcgatgcatggcacaacctgctggacagtggcgatgaggggttcagggacctgggcacccagaagcgggcacctgatattgtacccagcaaaactgctcctaataatgtcattttttctctctcttacaggcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctggcccacacccgcatgcgcccggtgcagcctgccaagggccagtcggggggtgctgcgtcctgccagtgtccaccacagctctgcctgcccttcagcccagcaaggtttaatcaaaatgcaatgctttgcaagtctttactgcttggaggtggctgagttgggggccctgggcaggggtaagctggcaggcagtgccatggcaggccagggtcccctcccatggggtctggcccccgttccagcatgtccagcccctgaagttggagtggggggcggtctgcctttgctgccactgccaggcctctgccctgcagctgaaacttggccatcacatcaacagaaaacccctcccagtgccagctgcccagcgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacctagcccggtgtgcgactgtcgtgttcagaggctgcgggagtgggcggtggacgtgggctcccacaaacatggtgagcgctggacaggccccgtgtgaacactcactgttgaggggcccccaggccccgtgtgaacactcactgttgaggggtccctgggcccccaggcaccgtgtgagcattcactgttgagggtcccccagtcccccaggccaggggctgtccctggagccctcaggaggcagtaagaaacatctagaagagggcagacccagtggtgaaccgcatccaacagtggtgagatgggtgcagctctacaggggcgtaatttacaaaccaccagactccctggttatgtgtgtgctgcggtggtgtttgctctccagcagatcaagtttgtgcaatgatccattttgagaatctctccgtcaccccaagaagtcctctcgcacccatcagtccgaccccttccccgtgctcctccccagccctggcagccactcacctgcactccagacgctccagatgtcatgcatgtctcctggcttccttcggctgttttcacgcgccatcctcacggcaggctgtatcaggacttcattccatttcatggctgaagcacattccattgcatgcagggaccacattttgtttgtctgctcttctgtccatggacatctgggttgcttccagtttggggcttctgtgaatcctgctgctgtggacatttgcgtagtcctcgtgtggatgctgctgtggacgtctgcgtcgtcctcgtgtggatgctgctgtggacgtctgcgtcgtcctcgtgtggatgctgctgtggacgtctgcgtagtctcgtgtggatgctgctgtggacgtctgcgtcgtcctcgtgtggatgctgctgtggacatctgcgtagtctcgtgtggatgctgctgtgaacgtctgcgtagtctcgtgtggatgctgctgtggacgtctgcgtagtctcgtgtggatgctgctgtgcacgtctgcgtcgtcctcgtgtggatgctgctgtggacgtctgcgtcgtcctcgtgtggatgctgctgtggacgtctgcgtcgtcctcgtgtggatgctgctgtggacgtctgcgtcgtctcgtgtggatgctgctgtggacgtctgcgtcgtctcgtgtggatgctgctgtggacgtctgcgtcgtctcgtgtggatgctgctgtggacgtctgcgtcgtcctcgtgtggatgctgctgtggacgtctgcgtcgtctcgtgtggatgctgctgtggacgtctgcgtcgtcctcgtgtggatgctgctgtggacgtctgcgtcgtcctcgtgtggatgctgctgtggacgtctgcgtcgtcctcgtgtggatgctgctgtggacgtctgcgtcgtcctcctgtggatgctgctgtggacgtctgcgtcgtcctcgtgtggatgctgctgtggacgtctgcgtagtctcgtgtggatgctgctgtggacgtctgcgtagtctcgtgtggatgctgctgtggacgtctgcgtcgtcctcgatgctgctgtggacgtctgcgtcgtcctcgtgtggatgctgctatggacgtctgcgtagtctcgtgtggatgctgctgtggacgtctgcgtcgtcctcgtgtggatgctgctgtggacgtctgcgtagtctcgtgtggatgctgctgtggacgtctgcgtagtctcgtgtggatgctgctgtggacgtctgcgtcgtcctcgtgtggatgctgctgtggacgtctgcgtagtctcgtgtggatgctgctgtggacgtctgcgtcgtcctcgtgtggatgctgctgtggacgtctgtgtagtctcatgtggatgctgcgagttttcgttgctctggggtagattcgtagcggaggaacaactgggcgacacgctaagtttatgtttaactttttaagtaactgcctaactgttttccaaagcagctgcaccatttttcattcccatccatgctattgtttttcagttaaatagctccactcctccccctccccaccctccacagaactgccagtaaaactggactatggagtattgggtggggtcacctacaaggtcatctgcagcaagtgagaccatcgcccctcctgcctggagaggtgggactggggaccctgtgacaggaggagctgcccttcctggagcctggtttttctttttcctctgtgctccatgagaagtcagtttagtgggctacagccagcaaaggaaccaaaaccaacaggagctctgggggtgccttgcatggcgaggctccgtggctgcacgcgtgtatgcaggtggctgtgggtgtctgtgtgtcctgggccactgtgtgcgatggtcccactgggaggtgtggcccccaaagagtggaacccacaggtggacacacccatgcaccctcgttcttgcccaaggtcacacatcgagacagcagggcccagatggatggccccaagctcggtggctcccgtgctgcccacacctggggacaggcccactgtggggggtaaggggtggaggtgttctaattcgggctgagccgtgtgactggcaggggccccagctgttgggcctgggcaggactgtttttagaaaagccccaactccctgcccctacccgggcccgtggctatttatagtccgggcctggagaagtcagtgagtcactagcgttcgcctctgcagggtcagtccaagcccccttagtgaggtggtctagcatgtcccccagtcccccaagcctctatctgacatctgctagcccagagccccaggggtccccaggaagggctcagagctggtggccccccccaggccttggcagcacctccttgtctgatgggactttgtggttcctggtggacatttaacattgtcggtttctctcatctggaaacaaacctccatgacgctcttggtttctcctgttgcagtctgcctcttccctacctgcacagctctctgctgtgccccaaattccctccttgacacccccagacccactgccccaccctcaggtgcagccccttctcagcaggctccaggttctgccaaatctcagagccctccaaccctgctccagccccttcccaagctggggccggtggtctgttcacccccgaccagctgtcacccccaaggtggcactaggaagttcatgcatgaagactgcttttccactgaggccccactgactgcttggaacccatacaacggcattttccccgcaaggatgctgagggagaggaagtgtcgatgtgcccagtggaagaagaggggactggggacatgggtgcagggggcaggaggccaggcttcaaacagcccctctcccccaggctggggcacggtcaggtgccaagagaggaggggtggggaggctgcaggcaggggtgggcagtggtgtccttggctgcacctgaatcactaactcagtgtgagcgacctttgctgtgacaggcccaagctccactccttcctcacagggagtgtcccgtctccatggactccctgtcactagccttggagttgccctgagcccaaggggcctcgtggctccaggctctttggcaactgagagccgtcagggagggaacaaaggaccccgcctccctgctctgaagcaagaacctgattctcttttccgcccttggggccccaggacccttctcttggccaccagggctggcttcctccaagcctcatctacttgggaggggtggggcgggatgggtgagacaggacaaccagccgggaacacgggagcctcgcagaccatcgcctccctctggggcctagtccctccacaggctgggccgggaaggtctggtgtgggacctcttgggaacctgggccccacggtggcgtgcatccctgggggttgctcccatgccagccaggtgacgctgacaggatgggtccctttaccccagacttgggtgctgagggccggagctccatgctggagcccgcctgctcgctacagccaggcccgagccacagcgcgcccgggcgggacgcggggcccctgccgtggggcagaagtgcgggcagttgcggggacacaaagtcctcggagaggacgcgctgcgcggctcttcgcggccgccagggggcgcgcccgcgcccagggcactcggggttccacggggggcaggtgcgctcctcgagagtgcggaccctctaggtggggtgcaggacgcagctccccttttgcaaaccgcactccttccctggagggaacgaccacccctgcagttgctggaaccccgaagtcctgggcccggcaagggcttggtggggggtgaggtcgcggtgcacaagccctggtccccgacgggctagcgagaaactgcctccgttggcaaattcgtgggggcggctccccaggccatctgcctgcctggccgttggtccgtgcggcccctcacccctaaagtgctcgagactcaactgggcttcccgggcagcggcgagggggcggggatgtggcggccggaggtcaccggggcgtcactgcgcccgccctggccctcccccggcccgccccctgccccgccccctgccccggcccggctccatttaatggcgcggacgccggcggcggcgggctcctggccgggccagcgcagcggaagagccaagccagcatgtcggggacccgagcctccaacgaccggccccccggcgcaggcggcgtcaagcgggggcggctgcagcaggaggcggcggcgaccggctcccgcgtgacggtggtgctgggcgcgcagtggggggacgagggcaaaggcaaggtggtggacctgctggccacggacgccgacatcatcagccgctgccaggtgcgggctggggcgccgggtccctcccccaccgcccagcgagcccccctcccccgacccagacggcccctgtcctcccatgccctggccggtcactcacccgcttggatgccttccttccgggagcacctttcccagggccaccccacccacgcacgcacacgcaccactcacacaacccccgacccacacacaccgccctccttccacccacccctactccaccaccccggcagcgggccagggcacagctataaatacaagtcgctgagttggggacacccgatccttagggggtggcgcatgccatgggtgtgacgctggaccctccatgggggaaccagaggacccagccccaggatggtttgaggacccccaagacaccccccttcctcatttacagtgatcacctggggcctgtctgggtctgggatagggcttacctggctccccgcaaggtctgcaggtggtggagggggtaaaagctgcctgctgggtgggggtgaccccggtgagtcagccaaggagaggcagaggtggaagggggccaggccgtcctggggggcaattggggccgcgcctgagggagggtgcttgggacgatcctagccagacatgggagagggagggccacagacttctggccagggtgaccccgtggctggcagtgccaccgaggaggccagacctgctttgtcccccagggcccagggctgggcctctgccagccggcagctgctctcagcgcccccatctgttctgactgagctgcacactgggcactctctcgggccgccaccctggggctacatgccccatgccagggcagccaagtctgctgcccatgggctgacttacagctccaggcacaaaggggtcaactttgggatgcacgcgtctggggtttggagcctgcctggggctgctgccaataatggaacaagggcccccgcaccgtcccttctccgggttctgtggcctccttcctgagctccagagaggagggctggggcccaagacgaagggagtcagcccagcaccctgtgtggctcagggctgtccgagcccctcctgccggaagggactgtggcttcctagaaagttcttcctggaacagtgggggacctccccccttgctctccgtcctaagcagcaggcaagcacatccctcgctccagagatcccccaggtcctagaggtggtcctcagcccatgctccctccacactgcctctgccccgccaccttgtcctgggccgccagggggcatgtccagcgctctactgctcttcaccctccagggcgccctcagcgtggggcagccccggcccctgaccctccttagacctctctgctcccgtgaggcccaggcccctccctatgagctgccagctctggtgggcgccatgcacttctgcagggcgggctggggcccccacaggtgctgtacacagcattcacctggctccgcgctcccagctgtggagatggttctggatctgggcactccctgctgtgccccccacccagtccccccacagccccgctcactcgcagctgcacacgggagcacggaggatgcagcaggctggagcccatcccgcactccggccaccaggctgcccccgccaggccacccccaccaggccaccctatagcctgagggagcccctggctctccaagtgagtgggaataaaagaggtttgtccctggagcccacacctgtccccctgcagcctcctcacgagccagtgaggcaggatcatcctgaagagctccttcacaggggaacagaggctcaggcgtggaggaatgagtcactgccacatttggagccctcactggtgccacgtgcccaccatgatagcccagggcctggccctttgtccccacctgcgagtgcggggaccgagctggatctcagcggggcgccgctctgcaagggaaggtcagggactggtcttctttggggccccagccccaggctctctgcaagtgctcagtgacccctacctcacagtgcccatctctcctcctagcggtgggggttctcccctaccaccgggctcccagcacctcccctgttcttgtgcacaccatgtctgaccaccccatgtcgtcagaggctggcagagggtctggctggatctccccagggaagactgcgtctttcttacttggagtgtggatgcctgaagccagatgaaggtacccgacatgggggtctccaggcgcacagaggccaaacctcaccctctcactcaaggggctgagcagaggacagagcgagggccgagtggtccaggtggtcaaagtgcacgccgtgggcagagcgggctgggccgcatctgggaggcaggctggctgccaggagggctgaagctgccagccctggcaacaagcctgttctgctccccagtccccaaagggtcacctgggcctggggccaccctgggttttggctatgctccttccctggctgcccaagcctctggacacccaggctctggctctgcctgctgctgacgcctgcaccagcagagccatcacttcgagcccagctctcaagccccctggtggcccctggcacttggcaagagttgctgctttgctcaccctggacatggactttccactctgcccagaggtgatctggggctgcccaaagccccgcacggctcgcctcattcttttcccatcccggtggtttggggcctgtggtcagagtgcatctgggggcccctgagagtgtcgtcacctcccacagcctcccgccttgggtccacctttaggacctgtttcctgggcggcctcccttctccaggctgagcctacattttgcatcccccaccttctgaccacacccccacctcacacctcggctgtctttcctccattccagggcggctctgggtctgttcggctgcactatgccccctggccccactatgccatcttcctccttgcctgctcccctggctgcttccaagcctctctcccctccaggctgagtctcctctgagccaggtctgccctccctgctctgcggccacatcacatcgtctgcctgtctgtgctggggtcctgtgttccctctcttctctctgggcacggacaccccatcctacttccgagggggtccccaggtacctccgcctgtgcttcctcccttgcgtccatggcgtttccttcccctgcgtgctgtccagctcctacccctcaaatgggcagctgaaggcaggtgcacctgggtctcccctgccccctgttcccaggctggcagtgcccggccttcaccccctagttcctccttccatctccaagatacttcctctggataactgggctccctgccgaggaccacagggctccagcgcgccctggtcagggtttagaatccccgtccttctgctgcagtgctgacctcagggcactgggctgtttatgtctggccatgcccagtacacgggctgaaggggcctgccctgggtctccatagcgcactcccagcctcccgtgccctccaggtctagctagagccagtgtccagccagcagacgggtggaaagctatggccatgtatgcaggggtgtgagatcacagggtgtttctctgtggtgtggcagcgccaggtgggagctggcatcctgtgcattgagggcccctgtgctgtggctgttggggctctgggcaccctttccaaggggccatcaggtaacgctttgccttaggctccagggtgcaccagagaccttctgggagtcagaggggcagctgccttggccagggaatgcctggggttgcttccagaaagaggtcttccccctaccccacctctgcactgttgatggtgctggttactgggccgtggctccaggacagagggtccctgcagttacacacagccctgcctcattgcaggaacaccagtcccgggcagctgagacctgcacacctgtagcagtgacctcggttctgtcccagacctcaccccactaccaaaaggggcagagaacaattcctttgggttgaaggaatgaatgaatggtgggagcctgcaagcagagcccagaagggagtgaagcagtgtaagtgggtgaacccactgcaccacactggtagtcacaggtgtgtgcacactgggcgccagggccccttgctctgtgccgggcacagtcgtcgtacaaactgccattgagtgccagtgccaagaggttgggcccaggagcctcacggcctctgaaaagcaccgccggcctccccctgcgcttgccactctgctgccttcactgcctggcgtgagctcgctgacagccaggccctgggccagggctggggatggacacagaggcaggagagctggtcgctcccattccagggggagaggtgcaaacagccactccactgtcccctcctccccaagcctgcatgagagctgaaccaggaggtggtatagcatgggcctggcacagctagggccgagggggaagcgggcagagtgcagtggcgttgaggcacggcgccgtcagacatgcagtccgctaacgctgtggggaggagaaggctctggagcatgggaggtagcgagcctcgtccaggtgttgctgcaggtagggctgacgatgggggctgcattgcaggggagaaaggggcctccttgggaaccctgggccaagcagacgctgtggccagaggagtcatccatggcagtaaagggcctatggactgcagggcagagaagggcagtggcaagtgggccgggagtggagggggccctggcaggtcaaaggaggtcaatggacagcccccaagccaggcagatggcaggtggcatcccaaggatttagggacggggtggacaggagcaggacgatggctgcagggcaaggctgggacccgcacgggtgacaagctcagtgcaggggcagggcatgcgccatctgggcagtgtggaggtgaggagcaaggacaaagcctgtgtgtggagacgccttgcacgtgtcagcagcatggcgtcggcgtgggagggaggaggtagcgtcggcgtgggggaggagcgtggcgtcggcgtcgtggggaggagcgtggcgtcggcgtggtggggaggagcgtggcgtcggcgtggtggggaggagcgtggcgtcggcgtcgtggggaggagcgtggcgtcggcgtcgtggggaggagcgtggcgtcggcgtcgtggggaggagcgtggcgtcggcgtcgtggggaggagcgtggcgtcggcgtcgggaggagcgtggcgtcggcgtcgtggggaggagcgtggcgtcggcgtcgtggggaggagcgtggcgtcggcgtcgtggggaggagcgtggcgtcggcgtcgtggggaggagcgtggcgtcggcgtcgtggggaggagcgtggcgtcggcgtcgtggggaggagcgtggcgtcggcatggtggggaggagctgtggggtggcaacccagaggcaaggaggtgggcagaggcccacgaacctggccctgaccctcagctcgtccccagctcacagcacagccctcccctggctgcctccaaggagtctccagttactgagtggccactccgtgccagctcagcccacccctcaccttcccagtgcctgtggaggcccaactagggtgacgctgggagaggagagggcttggaggagccacgggtcaaatgcaggaggccacacctgcctgcccaggaggactgcaggagccggatccttaacacctggaggggagcgggtgggtgcggtggcgtacatctgtaactccagcactttgggaggccgaggcgagcggatcacttagggtcaggagttcaagaccagcctggccaagtgaaacccggtttctactaaaaatacaaaaattatctgggcatgctggtgggcgcctgtagtcccagctactggggagggtgaggtggtagaatagcttgaactcaggaggcagaggttgcagtgagccaggatcacaccattgcactccaacctgggcgacagagtgagaccctgtctcaaaaaaaaattccattgtttaaagctgtccaggctgtgtattttgttttggcagccctggagactatagatagatagatgatatggagagaggtgtagagagatatttacttataaatatatgtacatatataaaatgcctggagggaccagcaatggtgggaggactggggagtggccccgagaggtgctgcgggtgtgagggtgcgcacagcctcctggaggggaggggcctgagtggggcagtggagatagggctggccacagggccgtgccttccctggcccccagaggggtgagttgggtggacccgcagggacaaagcaggggtcagagctgtgtttggttcctgagtgggccttgtccaggatggagagagcctcttttcctaaactccctgccaccagggaggcagctggcacggatgtcccctagggactgtgagtgacaagccagactaggcagagagtggggggggggggggggctcagtgtccgtgggggctcagagctgtgtcctgacccaagcctgcaccacagaggggaagaccccaagagaaacctggaggcaggtagagagcgccagggggccaccaggctcccttggtgcccctaactctgggcccccagcctggtctgagcctttgggtacaggtcactcaaggcaggtgttctgcaccatccatcttcatatcgtctctctcactcgcacccttgcatcactgtgcttctgagagttgggcgcttaccttaatctactgtccctgacctggcaaacagtggaaaggtggcatgatgtggccctgcagctgctacacctctaggcgccatcattcatgccatggctctgtgacagcaccccctagagttgtgcagtgtgcaacatgggtgactgtccatggcagctcacagcatgtggctcagcccattggccatgcagggggctcctttcctaggagcagcagggctgggcttcctctccacctgtaggggcagcagtgggcatcttaggtaaatgcaggactctgcagcccctagaggaccctgagtggtggctgaaggatggatgtgcccatggccttcccagagctcaggtgcctcagctctgctttcagaggagcagggcagccgaggggtgcctggcagagaggcctgccggctggacgtggggaccctggagcttggcctgaggggctgtggtgggagccgtgcctgagcagggctgtcccgtggcacacactcgccctggctcttctgcccatcacttatccccatgaggcaggaaagacagagtgagtgcggctgccctgggggctcggcactggggggatggtgacaggactcggggctcagggccgggctgcctggaacaagcagaccctgaggggccccctgcagcaggatccatggacccatctactgggccagcaggggccaggaaaggagaagagggagaccggtggggctggaggcaccagtgcgtctgtgcaagaggaggaagccctgtgagagggcagcagcctccggactgccctgcacaccgtgctgagaggcctggcgtccacctgcagcccaaggcagctccaaaagaaggtcctggtgcttctccaggaggcgaggctggccctgatgtttggtccctcctcatcggccagcctcatggtcagccttggctggtggctcccatggcaaggcagaccctggcctggacctgaaggctctgcctttgtgcagagccccagcctgacggtaccagttttcctttgttcccctttgtccagccctccttggatgcctttgctgtgggaatcccaggctgaagctggaggaaaggcaggaggacttcttgtccccagcctctcaccacgtgcctgtgcagcctgacgtcctgagacctcaactggtgatggggaggacagactggtgtctctctggggccatcgtcctgggctccccagaactgggagcccctgcggatcagcaggccccaggctcagcgtcctgagctggctcctgctcccaggggtggcctggcactggccctgcggtcattggacacccactggcctacgacaagccgcgcctgttcctaggagcctgtgtttgcccccaacagagccagggtgtgcctagcagggcgttcctgggcctgttgacgtgggcactgggcactctgccatggtaggcagcacttggcctgactgccaggtcatccctcgacgcctgcccccccgcccaggcggggctgtgtacaagggataggcttcccttctctcagtttccctacctgtcctcagagacctcacccctgactgcccccaaaaggcagcagatgcagtcgtgggcatgaaggtactccatgaccccagcggagaggaattaccacatatgtgccgaggcaaggacagagtaagagtgggggtctccaggagggtgctgtgacccccaaacccagaatctgttcgagtcacgccagggcctgccccgtcccgatggactgaacctgtgcgcccagggctgactcagcgtctgctgagcagcacaggctgagagccctgcccatccgcccaggctgcagaagtaccctgaccctccacccccaccctgccttggcgcctggcagcattagctcccacaaggcctccaggtgccctcagaccaccctccctcctgccaccaggcttcctgcatctctccacctcccaggatccccacccagttcacccagcaccgccccgcccagagccactgtcctgaactggtttcctataaggactgggcccagccaggcagggccaggcagaagtcagggcgtggaggtggggactcctgccctgcgaaggggcttcagggctctgagtgctgcctaatctgccagtgtgtgaagttacgtcccaggagggtgagccccctgcctggcatctctggatctgccccccctctgtccccagggttgccctgccacgaggcgccggggctgtttccgtgtaactcttgtccagatgcatcgtgaggagctagtgcagagggagggggccgccatcacggagggtcctgcttgggcaggcggggaaaggctatgtgagacaccccactgccaggcttgtgagggtgggaggggagctgagacccctctgccgggcagagagcagtggggtgtggctgggagaatcccccatgcgtagacaagttgagggcttttctgccgggaggtgaggcaggaaggtggggctggatctgggctctggggtcctggggacagagtgggccccaaaagggaagtagtgaaggagagaccagaccagtctgtggggcagggtatccgtgtgtggccccccgcaaccccaccgggaccctgcttaccctccaggtggagctcaaggagagagggcaacaggaagggtcccccatgccatccagtggctggccagaagtggggctggagacctggccttctctcctggggcagagaccttctggggctccctccaggctctgtcacactgggcctacaggggtctcttatggtggcataaagaccaaaaggtgctgtagggatatcccttgccgttggtgggggcctggcttcaggggcaatgagccatcatgggccatcagagatgctgcctcttcctcagctgtgaagcggggcctcctgcctgcacgtaggggagccctatcagccgtgccttgggactggagtgtccctgtatccatcatgccaccagcccacctgccctgcaggagcagagggtgggggcagcaggggacacccactggacctgtgccctgctgagcagagccaagcaaaaggcaggagggctttggttcttgccccacctggagagggtccctagcttatcctctagcttccactggcacaagaggcccttggggaagcgaaggcagtggcatccagggcgtggcacagtttgcttgtatcatgtggctgtctcatggcaggagggggattggagcctgcacatgctagtcccaggccctctccccaccatcagcaggaatccccccagagaggggagcctgtggctgggtgtttcccagaacagggctggctcagaatggctttttctttttcattcttagacgggaggtgcctgcccaaagggaagggtttctgctaaagtgggtgagggcaggtttggccgtgggggtgctgaattcatgttctgtgggagggttaggcctcctcattcctgcatgagaggagcgagctccagagcggggcccgcagctgcagagacctgcaccaagccacctggaggtgttggcaccagcctgggccagaccctccccgacccaggcccctgaccaaactgctgccctccttccaaggtgcaggatgcccacatcccagtcccgcacagacgcatcagagctggccaccaaaccagacaccccaaaatccaacagcagtgccctgcagggacagacgaagccccatgtgggtcagtccatgtccggggggtcctcagtacccaagtgccttcagctcagccgggtttctgttccaggggggcaacaacgccggccacacggtggtggtggatgggaaagagtacgacttccacctgctgcccagcggcatcatcaacaccaaggccgtgtccttcattggtgagtgccctgccccgacctgtgtgtgagcaggaaagggggtgtcagccagcccaggagccccacgcatgggggcacggggcaccagagcctggtgatgactgctctagcagtaggctggaccccagcctccacctgccccaccaggcactggtgcacagaaacctgcatagcccgggcctgggctgggaacgcagctgagaggacacagggctgatgggaggaggggcagagtcacatccaccgcgcaggagcgggagtgcctgatccctgatccctgatccctgatccctcacatgcacatacttcctgtgtgggcatggagaccacacgcccatgtgcccgtgactccatgtgcatacctgtgagtgagtatgtgcttgcgacaggcctggcttctcgctgcgtggcgaccaggctgtgtggacaaggccgtgccctccccggccctgccgagccatgtggccgtcctcttgcctgggctgctgtggccacgtggcaggcctggttccagccccttcccagtccgtgctgcagagggacctccttccacatcgcctgccccctcctgggtccggacacagctcctcccctgcagccacctgtgaccactcagtgctccaagaggcgagccacctctgtccccagggttccgtggctctttccctccttctctcggtcagaagcctgctctgtgcaccctggcctcagctcttagcccaaaacccccttgctcagagaagcttttcctgatcccagtggccaagccagccaggccccttcttgtactttcccttccagctgtttccagacttcagcaaggccatccttgtgatgtatctgaccccttcccagcccgtcaggaagtgggggtcaggcgcctcaggtgtgtgcccagcagatgcatgggcctggacccattcaatgtgagcagagggaggaagatagcgcggaggtggctgccgcaggggccatgtgtggtcaggggctgagctggagtgactcacccaagaccatcccctggggtgcagacccagtccctggccctcccagcagtggggccaggacagtgtgggggcggtccctagttcacagcagggaggccctaagcagtgaggtggcctgcccgccatgtcgcaggagcccctagccctggcagactgggcagtagcgctggctggccgctccgggttgtgctgcaggaagcccttctccagccgccagcctcgtcctgcccagccctgggccccacatggcaggaaacaaggccaaagaggcaccgcttagcaagcggcaggacgtgccagggctcacacagacaccctgagcttgcaacactccgggcctctgccgcgtgtttatttcaggatgccgtggcatttgggtgaccttttgtgctcaccatggcttgcgtcgtctccgggtcactctcgtctggactgaagtcccgtctccctcagctgagcctgtgccatggccagcctcagcgggaactggcaaagggaaaggggttccttggggaggcagcaggggtttctgaaggcttcatcttcaagcaaggggtttagagctcaggagtgtatttgtgtttttttgttttttgtttattttgagacagggtctggctgtgtcactcaggctggaatgcaatggcacagtcctggctcactgcagcctcaacctactgggcccaggggatccccctgcctctgtctcccaagtagccaggactacaggcttatgccaccgcacctagctgatatatatatatatatatatatatatatatatgcatttttttttttttagaaatggagtcttgctgtgttacccaggctggcctccaactcctggcctcaggcaatcctcctgcctcagcatcacaaaatgttgggattataggcatgagccaccatgccccaccagagcggtgcatttgtgacaatcgatgaacctacactgacaggtcatgatcacccagagtacatagtcacctctgggttcacacttggtgctgtacattctaccagtctggacaaacgtatgctgtgtatctgccactatagtatcgtacagaattttttactgtcctaaaacccccgagctccacccatttcattcatctctcccccctcaaccctcggcagccactcaccttatgctgtctcctcagttttgccttttccagaatctcagagttggaattgtacagtatgtcgccttttcggattggcttctttcactcagtaacatgcatttaactttcctctatgtcttttcatggcttgaaagctcatttcttttcagtgttgaataatactccactgtctggatggaccacagttgatttctccttttgtttactgatgggcctcttgactgctgccgagtttcggcgattatgaatagagctgcacatctacgcgcaggtttctgcagggacatcaatttccagctccttaaataccgaggaatgtgttttgcatccatcaccaccatccacctccagaactttcttatcttcacacactgaaatgctgaaatatcaaataactccccagtctccctctcccagcccctggcgcctcccattctactttctatctctatgaatttcacttttccagggacttcatataagcggaatcatcctgtttgtgtccgtttgtaactgccttatttcactcagcataatgtcttcgaggcctgtgtcagaatttccttccttttttaaggctgaatactcttccatcgtatgggtagaccgtgttctgcttacccattcatctgtcaatggacagctcttggctactctgaataatgctgctatgaacataggtgtgcccatttcatgctgggttgttttttgttgttgtttgtttgcttgtttgttttttgagacggagtctcgctctgtcacccagagtgcagtggcaggatctcagctcactgcaacctccgcctcccaggttcaagcgattctcctgcctcagcctcccgagtagctgagattacaggcatgcgccaccatgccaagataattttttgtatttttactagagatggggtttcaccatgtgggccaggctggtttcgaactcctgacctcaagtgatcctcctgcctcagcctcccaaagtgctaggattacaggcatgagccaccgcacccacccatttcatgctgttcttaatgtatgttttccagtgtctgggacacaactctgtctctcatgcctctgtctctcatgcaggcaacggggtggtcatccacttgccaggcttgtttgaggaagcagagaagaatgaaaagaaaggtaggtccaagctcctgcagacttgccctgtcccagacgcggtgccctgagcggttgttggctggagccttcctgagggtttctcccacggaggggactggcaggggtgggttcccaacatagctggcccagctcatcacccgccggctctacccgcgcagaaagcgagtgagctgggcaacccagaggcctcagatgctggtggcctcagcatcacggggccaggtagcacctgggaagtccaggaaggagccagggacctggaccagacacccagtgggaagtggggactgctggcctaactatgcctgcagggaaggatgtggctcctgggggctctgcggagcatctggccaggcacgcagaggccagacccaccagctgggggtgtgggcaagtcagacctagtgtgggcagggacggacggcagcctgagtgggtctgggaggacgctgagctgcagcctcaggctcaagggcgggacgggtgtgaaaagagcaagaatgtgattctggggacatgggcaccagggggtacccagactgaggccctgagggggcaggtcaccttcagagtggcagcagctagggaggaaagccgggcactcacaccagctctggcttcccagcctggagtgggcgaagcctgcaggcacgagagtgggcatcctggcggcggggtggagtgagggtccgggagtctcagctggggaggagacaacgaggggcgggtctgccgcttgctgcgcaacagaggtggccctgtcagcctcctccctgcatgccttacctggatgggagccgggcgagctagcccagctctggcccctcacgtgtgagctgcagcgcacctgtgaacactgacccacctgtgtgccgtgtccccgcaggcctgaaggactgggagaagaggctcatcatctctgacagagcccaccttggtacgtttcccactggagtacagggaacagcccctcctgcccccaccattgccagccggccctgctcctacatggccaccgagatcagggaagtccccaaggccttcttgctccacatggctccattagcttgtacattacccttttcaaagagcttcaagttgggagctgggtcaggggtcactagcccatttgcaggtggggagactgagccccagacactcatggtcacaccccagtttgtcctctttgaaatctcaaccacccccttcccaggagactcaggccagcaggaggtgaggtccatgtatacacatctgtcctctgcttctctcctgtctcctgctgccctcacctggcccgcccgacagtgtttgattttcaccaggctgtcgacggacttcaggaagtgcagcgccaggcacaagaggggaagaagtaagtctgccgggacactctcaccctcggggagtcttctgggcccgtaagccggtagactgtggggcgtgtctggtcctgggcacaacgaggagggtacctcaacccactcaaagcccctggagaatggcaccgtcaaaattccacagcgcatcacccaacccccggacgagccagcccgtctctctctggggttgcacactgtccttgccggctgccactgccacgcggctccccccaggagtgcataagccctaccgtcacctgtcacacccaccacctttcctgactccacacggccccagggaagacacgaggaacactaaagcagtttagtagaacctcagatgtgccaaggacacaggagtgaagcagatgagtgtcctgcctcagagaggtgatggtcacacacttacccactcacactctcacacaggcacacactcatgctcttacatacacaccacacgcccacgcatgctcgcacagttatgcacatgtgcacacgccacacaagcccacacacccacgcaaatgcacaaaagtacacacagccacacatgcacacactccacatgcacacatccacccacaggcacacaccataccagtacatccatgctagtgcgtacacccacacacgcacacactcacagctcagccagacacaggcagcaatggtgggcactggagtcatgagccggcgggggtcatggcctcagtgggatgcctgagctcctcagggctcctgggttctcatgggtacccactccccatctttcagtataggcaccaccaagaagggaatcggaccaacctactcttccaaagctgcccggacaggcctccgcatctgcgacctcctgtcagattttgatgagttttcctccaggtacctgagccgtctgcagtccccggggaggatggggagaagttgccggaagggactgtggctagtggggagggccctgaggaccagcatggaccatgacagggggtgatgatgactgtcccttgtgcagattcaagaacctggcccaccagcaccagtcgatgttccccaccctggaaatagacattgaaggccaactcaaaaggctcaaggtgaagtcggggccgcagtgtgggggctgcggaagtgctcctccagggaggctggatgtcctacctggtgctcgttgaacacccttggggcacacctgatactaggcattgttatgggctggccaaccttcttgggacgcaggcctcccctgccccaggccacaggctcactctgctgcttggcccttccttgcagggctttgctgagcggatcagacccatggtccgagatggtgtttactttatgtatgaggcactccacggcccccccaagaagatcctggtggagggtgccaacgccgccctcctcgacattgacttcggtatgtccgggagggtgtgcgtgccaacgacctttcgtgcctgccagggaagacccagctgcggagagccgtgggaaccgatgggggagggaggggcagacccgctttccaaggccacagtgccatccatgcccgcggaaatgatcctcgtgtccttagtgttcctattgtcagcaagggaggggagaggagaaagggctgggctagagatgaaagaacagggtgacaaggtcaggggtggggccagggagcctggcaaggtgggtcagagccagcccttccgatggtctgtacagccatatcccgtcctcacccccacgggcgcaccagcttaccctcacccccgaggcggcctggtcacctcaggccatgctgtgggcaactttctccctcctctcaccccagactcttttgtgagccacatggcccagcacacagcacccattcggccactccaccaggacaggccaggctggcgaccccacggagggggccccccacggtttgaactgcccactgccctttactgagaaggcctcttgggccgggtggaataatctacagggggtgacaggtagccccctaaacctgctctgtcttgcagggacctacccctttgtgacttcatccaactgcaccgtgggcggtgtgtgcacgggcctgggcatccccccgcagaacataggtgacgtgtatggcgtggtgaaagcctataccacacgtgtgggcatcggggccttccccaccgagcagatcaacgtgagtccccagcccctcgggaccccgtgggaggacagggaggccaggcaggggtgccgggggtggggtgagcagtgccagggtggaggctctgcggaccttgccagtgccatctccccatctcccaccagggcgcttcctgccgtgcaggccaggggagagcttagtaagaggcgctggggtgggcctgttcccacggccacagcacgtgagctcacacggggtgcgcacatgcccacacgtacacgtgacctcgttcccctcggagtgtgtgaggcccacaggcaagtgcggacgccttgcagttcctcaggacaccctcattcggggtagctggtggactcaccttggctcagagaggacactaagcatcttccctcagccttgtccccaggttggggggtcctctgtcacaaccaagctagaattggggctgaaagccaacccccacaaccctgcccagctctccagccccaggaaggtttctggaagctgctgtggccccagaatcctcaggagaccccagccttcctctttcaccctcaacctgtgacccttggtagggcaaggacatggcccttgtgcctgagcaggaggaagggcaggtgctgggaaagccaacacggggaggggcggacgccatccagagaggcttgagagggtgcagggatacatatcgggagatacacacacccctgacccccaaagccaagctgcagggccaggcccgcctcccccagctgcccatggcaggaggggaagacagcaaggctgcccgtgccttccccagctcacaaagcctagtggtctggtgtgttcaggaagagcgctcgccggctcgggtggcattgtgggccaggccttgcccattgtgagcctcagctgctggacaggcttaccaggggtgtggggatgtccgggagctggatgtaaggactgtcggtggaggcggggcaccctcagggattctgagagctgtgtgcagggaggagggggagcagcagggccaggctgcacaaggctcccacgacagctcacatgacgtcctccctgttctcatgtaggagattggaggcctgctgcagacccgcggccacgagtggggagtgaccacaggcaggaagaggcgctgcggctggctcgacctgatgattctaagatatgctcacatggtcaacggattcactgcgtaagcaacccatgctgccatccccactgggaccgtccctgactcccgacacctgcagaggcaagcagcacttgacgcaggggctgagggccaccaagtctccttggacaaggtttccactgatctcgacccttccacaaagcacggcccagaggttagcggtatggaggcctgtgcagggtgtgttggagccagccgtaggagcacaaactcccaccccagggctgatgccgtgaaggatgagggcatcccggcacttgtgagaggttaaaatgcttcatgtggagagcggaagtacccaggacgaaaggatgcactgtcatcctgctagaaggacggcagcatgggtgccggcctgttgaggcatccgctctgcaggcccctctgctttccacagactgacccaggctgcccagctgttcgggctgtctcccagggatctgaaagaggctttgtgtgaggggtgggctcacagcttcctttccagctcagtcagacaggccaaggctgtgagtcgcacatctttcaccagggttgagagcatcagccaaaattcctggagaattaaccagacccctgctaggtgggtatagagctaatccggcaacgggaagcagaggaaccgagtagctgagggtgtggcgtctgggatccgtgaccctcactttccttgtgcgcgatgcagggttcacggcgcagcctcatcacgtgctagggccagcatggaggacaggcagggtcagcagtgctcagcagacccatccatagcctgctgcatctggcgccccttcaggctttgcccacggagggaggaaaaacagagcccatggcacagggcctggtgccgaagatggaccaggaagggaggctgccatcattggcatcagtgggtgggtgggcagggaccaggaaggtgactaggacaagggtgccatgctcacgggctggacacagggcagtgctgggccctaaacacggctgtgctgtggggaaagtgcacgtgtggggacgggaggggagaagtggagcctgggggagcaggggtcccggggggcactcgaggtacaggggacttggaaaggcagagatgaggtgcagggcgtgagcagaagcccccaccctctggcatgtttgtcaatggcgcttttttgggatcacttaatctctcttttccactcagtgtaaatcagcagtccctaacttttttggcaccagggaccagtttggcgggagatgattttcccacagacagggcaggtggcaggggtgtggcggcggatggtttcgggatgaaactgtcccacctctgatcttcaggcattcgattctcacaaggagcatgtggcctagatccctcgcatgcacagttcacaatagggttcaggctcctgtgagaattgaatgacaggaggtggagctcaggccgtaatgctagcttgcccgccactcatctgctctgcagcccaattccaaacaggccaccaaccagtactggtccacagcccagggactggggacccctgctgtaagtaacagaagcgagaggtcaaaagcaagcggaagaaaccccagcactgctgaccacttcttgggtttgcccggccccttggctttccacaggctggccctgacgaagctggacatcctggacgtactgggtgaggttaaagtcggtgtctcatacaagctgaacgggaaaaggattccctatttcccaggtatgtgaagtggggcaaccgttctgcctgttgggccgtttcatggtattggaatagataggacctgtgacttctcagagaggggtgagttcccacgttcacaggacacagggcaagcagcttgtctccagtgaccagcctccatcatggcttttgcctctcacgggtttctccccacagcgttccccaggaggcctggctgggcaggggtggctgtaggccccttccagtgttttgggaatggctcagggggacagactactcgcctgggaccctgggggaccttcagctgccttgaggaaaaggcccacctgcagggagccacgggaggcacacaggagttagtggatgcggtcggctctggaagatgtaaagctctatgcggacgtacaggatgactatttcatctgagaaaatacgctttgtggcgagatttttaagacctaaccgggatccctgctccatgcaccccttcttctggaaagcatgaaggaggtgccattttcctgggtttcacaggtttcagtttcgtgtgcgtctggatgtgccccctcgacctcggtccagggtcatgttctgaccctgttccccacaatggcttcctcctcagcagccctgggcgagctgctcctggctggtctccactcagcagatctttgtaggccacacagggccacttggctacaggagccatgtgtgtccttgcaggcggtgtccctgaccctcctgacccttgacctttgagaggctgcacttgtgaggactgcaagctctcctcatggtggtccagggtcccagggggacacgcaaacactgcctggctccaaggctcaaacacacttgcagcgagaacccgtattccagcatcttccatctgtaagggtggttgtcttctaccaggagccacagagtcctgcacagggccgggatccctgccctctgggagttgatgctcttggggtgggaggacacagatgcttcaggatcccttagtgcttcaggattctagagtctcagaatttccaagccaaggcttggagtgcctcagctgatgtcacagtggaggttctagcagagtgggtagcacatatgtgtcatgtccctctggtctggaaggcgtgtagtgtctgagccccactgctgtcccctgcttaccacccaacactgagaaaatcaaactgggccacgtgcccacttgctgccttccttgcagctgagtccctaggcaaggaggccctggatgggggtggccgtgtcaccaaatatccgcttccctggtgataggaggtctgtgggccccactcatctcctgtgtgcttcccccagctaaccaggagatgcttcagaaggtcgaagttgagtatgaaacgctgcctgggtggaaagcagacaccacaggcgccaggaggtgggaggacctgcccccacaggcccagaactacatccgctttgtggagaatcacgtgggagtcgcaggtgggtgccctgcatccccagccaccctccctgcaccctggatgccccaaggggcccacatcccagcgcagggcttggtgagcaataagaaaaccaagtgtggtcaccaagcgaatatattgcatggcaggaggggaggacgactcggagctggggcagtgtggctccgggctagggtgtgggtgtgaccttgccgggagcccctgcctctccgcatccagaacaacagatgggacacatcccagccatatgagtgtgtcatgtttaccctcataacccagaggtgtttgcacctacagagaaagggtctgcagggagagtcactaagtaactaacgttgccatttccaaggaagaagggaggagactcctgttttccgctgcgggaggatcagtcccccaacatgcactaccttcataacttaaaaattagaactgcctccatttggagagaaaatagccccttttaccatttgaactacacagaaagatacgacactaaagacaactttttctgaactttctgcctccagtgtgtatcataacagtcttttctgctctctcagtcaaatgggttggtgttggcaagtcaagagagtcgatgatccagctgttttagtcacagactgagctgatcccaacaggccctggcagcgtctggacttgtgtaaacagcagcagtcacgttcctcggccgccacaaccaacaccaaagcaggaaaaccattttctgtacttttatatttctgttcaacctgttggtttctacaatgattttaaacattggaaagccagccttgtgtatatttttaaaaattatattcaaaatgagccaaagtgctcagagaccttctatgacacattagtgtcacatggttgcgtgtccagccgaagcagtgtaataaacatctccaatggccactgaatgggagcagttgttacatgtttgatttgactttgtctttattgcttttaaacactgaaagacaacaattcactgtgacaggagtctggaggatgtagcttcctaagagctgcccatgttttttgggtaacaaagccaagccttgtgtttactcagaaaattaaatagaacaagcccatataagagaccaagtcaattaaatatggtttgttttgagacagagtcttgctctatcacccaggctggagtgcagtggcgcgatctctgctcaccataacctctgcctcccaggttcaagcgattctcctgcctcggcctcctgagtagctggtattacaggggcccgccacgacgcccagctaatttttgtatttttaatagggatggggtttcaccatgctgcccaggctggtctcaaacgcctgacctcatgattcacccaccttggcctcccgaagtgctgggattacaggtgggaggcaccgcgccagcgtgtttagtttttaaaatgatattaaggccaggtgcagtggctcagagttcggagtaagtttagaaaaacaactgcccttccagtatcctttcaaagacagggaatcctacagagacgccagtctggcggggttagaccctgacttttgagcactgtggctgtcagctggtctcgctagcccaggaagttcagcaggctctactgacacggcaggggcctgggggcataggctgggttatgagattcctgtgactccagggatgcaagcaacttttctagacagtaccaagaacagccctcagtgacttgagcggcaggaaagccatgcaactgcacggctctgccccaggccacgggcgcttccttcctcaggccggagtccctcagcagcactagccaccttgagatggggtgggacacacaggcagaagccagcctttgagtattcccagatgctctcctttcataacacagcaagagagacaaaaagggagccccgaggcaggggtaagctcctggggagagggggctgcgggctttctctactcagccctcacatctacactgggccctcaaagtcaagtcatctaaattgaaatttgagagctgcaaaataggttttcaaacctctgttttgtagtagctgctaaatcttccaccagaacacaagttgtcatcgttttctttcctctcgggatggaaggcaggcgtttcacagggtaaaaagacaccaacgcagaggggaaatacttctcccccagcaccaactcactcacttccacgtgaaccagagacaagaggctctggcgtctgagcggtgggttagtgcagacaggcaggtcaatcattcgggtctccacccccttcttctcagtagcagatgtttggagggtctgagtggttatagtaaggggctctctccacttttcatcaataacacagccccagtgtagatggggtcagagtggtctctgttgaatacatgggtaaaagacaaattagtgataattgtagtgaattcttatcattttatgacaatatttattcagaatggcatccattctgaataaaagtgggactttctggtacagaagcagggctcagtcattcttgacagtttctagctcctcacctcctcccagttgcccagggtggtccacccagatctctgctttatacacctgccagctggtgaccagctccctatgggacacctggatacaacctactggactcagcccctggcccccacacccctcacggactgtgcagacgtgccacagtgaccaccacccagtcacagcaagatgccatgaagctgatgcctgccggctcgaaatcacaccccacaggaaatgcacttgagtaacaacaccctggacctgaatacagatttggtgcacaggccgctggctcgctccccaccatctggctgggcctgcctgttccccgtggctccccctccccactggcctgtgaggaacgctgcctcctcgctcccgcccggttgagtcacacacctgctctgcagtttcatgtgttctgctgtgctgcctcctccagctctcacctgacccttgcacccaaacctcactctcctggtcaggactctcccagagagaccatcatgataggaatgaactgatcactgctcagacaaaagccacaggctgcctgccaaagcctagaagcaagctgctggtgagaggaatgccagcacagctggatacacaggcctgaggccatcagccagggtcaggaggcatcccacgagagcacacactgtaaccccatgcccaccgcccccagagccccatcagggaagggccaaagtttacagccactctccaggagagacctcaagacgaattagaggaaaactatgacaatgattttgtttaatgataattttcctttttcctagcactctggaaagctgccagtttctttacaagttaaccatcaatctgatgcagggcaggtgagccccaaaattggggcttaaccctggagggttcatggcttcacccaggaaggcattcaagggtgagccagtggtgttagccaggcaagtttgttaaagcagcagaatcctacccagcaacctctgaggaaccggcatgtggcctgggggacagccccactccataagctgcccgatgttctgtatctgtccacgatggtgatgagaccctaggagagttgcaagtctgaacacagggaaatctttagaaatccccacgatccataagattgaaaacaatcctcctctctgagaacttcatctatttctgggataaaccaaatctgtgtttagtcacacgtgactccaactgagtaactttcaagtcatttccctaaggcagaaaaaattctccattatgccagcaaagtggcaaggaagagccaagaatgcttgatcccatccccaccacagggaaccctgcacggcaggaggagaaaggacatctaagctggagactggtaaggtttcagccacccatggctaggaaagcatacactgcctctgagggggcgtgggcagctgcaacacgggagtcacgtgggaggggtttgcgggactccaggcatcacctcttcacaccggaggcaacaccgatggagtcgtgagaacatagtccaggtgtgtccagaattggtgggttcttgatctcactgactttaagaatgaagcactaggtcctcacagttgactgttacagttcttaaaattgttatgtctgcagtttgttccttctgatgtttggacgtgtttggagtttgttccttctggcagactcacggtcttgctggcttcaggagtggagctgcagaccttcacaaggagtgttacagctcttaaggcagtgtgtctggagctgttcattcctcccggtgggtttgtggctttgctggcctcagaagtgaagctacacaccttcccagtgagtgttacagctcataaaaagtgtggacccaaagagtgaaagagcaaagccccaaacatgtggcagaacaccaacacgttcccactgcctgctcgggcggcctgcttttattcccttatctggccccacccatatcctgctgattggtccattttacagagggctggtctgttttacagaaagctgattggtccgtcttgacagggcgctgattggtgtgtttacaatccctgagctagacacagaagttctccaagtccccacagagcactgattggtgcatttacaaaccttgagctagatacagggtgctgattggtgtctttacaaaccttgagctagacacagagtgctgattggtgtatttacagtcccttagctagacataaaggttctccaagtccccaccagattagctagatacagagtgctgattggtacatttacaaaccttgagctaaacacagagtgctgactggtgcgtccacaatcccacagctagacataaaggttctccaaatccccaccagattagctggatacagagtgcccatgggtgcatctacaaaccttgagctagacacagggtaccgattggtgagtttacaaaccttgagctaaacacagtgctgattggtgtatttacaatcccttagcttgacataaaggttctccaagtcgccgctagactcaggagcccagctggcttcacctagtggatcccacaccggggctgcaggtggagctgcccgccagtcccgcgccgtgcgcccgcactcctcagcccttgggcggtcgatgggaccgggtgccgcggagcagggggccgcgcaagagcccacggcaggggggagactcaggcatggcgggctgcaggtcctgagccctgcctcgcggggaggcagctgaggcccggtgagaattcgagcgcagcgccggcgggccggcactggtgggggacccggcgcatcctccgcagctgctggcccgggtgctaagctcctcactgcctggggccggtggctccgattgcggggcccgccgagcccacgcccacccggaactcacgctgacccgcaagcgccacgtgcagcccgggttcccgcccgcacctctccctccacacctccctgcaagctgagggagccggctccggccgcggccagcccagagaggggctcccacagtgcagcggcgggctgaagggcccctcgagcgcggccagagtgggcgccgagagcgagcgagggctgccagcacgctgtcatctctcacagggcgaagcccacgccacaggacgggtcggttctgtacccgccggggcaggggagagccgcctctggtgagcagaaccccggagaagggacgacgcgggtgcacctcgcggcatggggacaccaagtcagacgaacccgctgtgcaagaacattttccacacagcggcgcatacccccgcccgggggcgctcggcagccgcacgcggccctcagagcgcagcccccacacgcctttacttctggaaggcggagaccgccacagtgaggagctaagccagctgaggcaacacagaaaaacccccgttcctacccaaaaccaaaaagcggggcgcggaggcgcgcgcctgcggtcccagctaccggggaggccgagaagggaggatcgcctgagcccgggaggcgcaagctacagtgagccgagactgccactgcactcagtctgggtgacagagcgagaccctgtctctaaaggggaaaaaagagctaggaagaagcgggctgcctcttaacttcggagaagtaaatgaggaactataaccagtgtctaccgtttaggaaccaaacaaaagctgacaggaatcccgccaccgacccagccgccccagactttgccctggcctatcccgcgccgctcctcaaactagacccgccccgacgtcgccctggcctatcccacgccgatcctcaaacgaggcccgcccccgatgcacaagctccgccctcgttgcaccgtcctgaccctcggcctcgcccccgccccctggctcttcccgcgcagccgaatgccgcgacctggctcccacccttcgtcgcttcgcgccgcataggaaccccgcccctagtctctcctcccgcctatcctgagcggcgcgcgcacaaatctctcccacggacccgcccaccctgatcctcaacctggcccctggcctttcccgcggcgtcgagtccagtacaccgacgcacgagtcccacccccgatctctccctcggcctatcccgcgccgctccgcgcaggagtcccgcctcccacttcgcccgcagcctatgacgcgccgcgtcgctccctctcctcaaacccgctctcgcccgcggatgggcgcgcagctgtgacgtcacggcgtcgttggtaaggggctggcggccggggagctgcgtagctcccggccccgcggccatgcccaagcggagctgccccttcgcggacgtggccccgctacagctcaaggtccgcgtgagccagagggagttgagccgcggcgtgtgcgccgagcgctactcgcaggaggtcttcggtgagtgtcgggcgggctgccgagggtccgctgcgtcggggcctggaacgggccgggcctcagcgtcccctctgaggcctgagcggggggctggagggccctgctttctggccccgcgttcccggaagctgggaggccgcggggacacaagctggccacgcccagggctggggtcagtgagggggatgtgaggaccccagcgttcgcccaccctgtccaacagcctgaaagaaaagggtccctgcccctagcccccgcgccctcttccacgatcccggttagtcgccgccctgcagtgagcggcacccgcctggtgctttctcaggactgtcccgtgcaggatgtcctgggagaggttggggagcggggcgtcctgcatggagtcaacccgaagagtgcccctcctgtcccaagaggtattcatggagcgcgcggccctgccaggcacggcggctttctcgggagaccaaaggcaggcaagacagatgtgccccgtctcccgggagctccccagcctagttggggagaccagcaggaggagtcgccacaggtggtcggggcaggcacaggtttgtgcaggcgcacctgcagggatggcacggaaggcttcttggaagaacagtctgagcggaatcctgtgggggcgagtaggagttagccaggcagaggaagggaaggaagagggcgaggcagaagccaggcagcaggagagcgaaataggactccgtgtggctgcagtgtccagttctgggtgggatgtgagggcagtgagctcccaggccttctctggctttctcctgtggatttcaggcgtgttgatcttattgatcatcactctgactggggtgattaataccctggggcaggtaaaaagtggagcttaccttgcctagtgattgggacacaaagtctgcacctgtagagcagttagaggatgacccggggtgtgtgatttacctggtgccgcttgtgccttgggaatgagggaaagactctgcctcccgaggttcctctgtgcggtgtctccagtgtgctagggctgtgaaagcgagtgctattctgggccatggggaggtaaggggaatgatgccgtgggaactgtggcaggaccgcaatcgtgtgccctctcaggacagttgaaaaattcaaacactgtgcaggcaagaagaggaagatggaaatggggcctggctcagtatggccctttattcttcccgagtgtcctgacctgggcgttggcaggtgtgtgccactcaccgggtcaggtcagggaggtctgctgggtgcagtgggccttccatggtaaatgcaggacacctactttgaactgtgtgacagtttccaaattccaggccacagctgttaccctgatctcttaacctcgaattgtccacaaggccttgaggacaaggattagcctcaccacgtgtctgtcccattcctttccccttatagatgggggaaggtgtggggggccaggaggaaggtgcagggtgttgtgggctggcatcagctactccatgtgagttaccctgtcactattattgctgcccacttcatgtagagccacatagagtttctgggatctctgcctttactgtgttatggtgaggtgcaaaacaaaaaacaaagcatttctgggtctggccctgggcatctgatttttcaaagctccccaggtgactgaactgtggcctgatggaaaaccactgctcccagggatgggtgggtgttctagaacaagaggtctggaaggttctgggatgcttgtcttgccagcaactctgtagcaggtgaagggggtgtgctctggccagaggctgtaggcccagctccaagcctctggctgcttccttggcaggggacgagttttgtgaattagtgctccacagtgcagagctccctctgtgcattccacagagcctggtttccaggtggggagtgctggggaagcagaaaagggagaaaggggacaagcttagtgaggcgaggccagccgtgaattgcagaaaatgagccgagtgataggagagggaacccttgcatcagacacaggtggggctgcagggccagagccttcctggaggagatgacagctaagccaggtaaggaaaggacgcacaagcattctcagcatagaggcagagcaggacccagctcgccagggcacaacacaggctggggttactgggagacagagggcacacaggaggacgatggggttcatgtgaggctagaaagactcaatggccatgcaggggcttcgttggtacacagtgaaggacgtgagaatgatttatcttcccccagagaagaccaagcgactcctgttcctcggggcccaggcctacctggaccacgtgtgggatgaaggctgtgccgtcgttcacctgccagagtccccaaagcctggccctacaggggccccgagggctgcacgtgggcagatgctgattggaccagacggccgcctgatcaggagccttgggcaggcctccgaagctggtgagtggcaccagcagccctttgtggctgtggcactgagggcaggtggtggcacgagcatttttcttgatttgcaaggtcaggcttttcctccctgggtaagcaggactctgacccagagcttggccttctggctcagaaggctcctgttatcaggaggtctcacattcaagactggaagttgttaaacagcttctaagtactgggccaaaaaagcagcagagactccccgggtatcccgtctgctttccgcctgcagccccctcagatagtcccacaaggctggaaacatgccagtcccatccctatgcagtgtggggtctcagagcatcacctgtgttgctggttagaaatgcaatccccgactctacctcaagtctggttggtgtgtctaggaggagcccaggcacctctttgttaaccagtaaggcagtgggccacactgagacccagatgggacacatggagttctgacaagcaacaggggaagaatggtccttccagcactagcctccaggtagcagagggacctggtaagggaaagagcactgaacttggagtcaactacaggcatatctcaccttggatctctgtagtaaaacgggggtcctgtgcactgtaccaggctcacgggttgtcagaaggatccagtgtaggtggggatggggtaggcaggtcagagccctctgccctcaggtatgcatggaggcaggtagcccggcagtcccggaaactccagtctccttgcagcctgacggcttggcgtttcttcctcacagacccatctggggtagcgtccattgcctgttcctcatgcgtgcgagccgtggatgggaaggcggtctgcggtcagtgtgagcgagccctgtgcgggcagtgtgtgcgcacctgctggggctgcggctccgtggcctgtaccctgtgtggcctcgtggagtaagtacttcagtccctggagctgctgagatcccatagccccagcaagccgtgatgggggacgggtgggtcacccatgtgggcccagaacacacacgtgtggcccctgatgcagtgccatctggcattgcctaacgggacatggtggcaatagatgcttggcccaactttagtggttagtaatcctctctaagggaaagctgaacctcacagatgacctgctctgtatccggctctagtccctgtcttcagccacttcctgttctgatctttgagcacccccacctcctcctcctctggtctttgagccccccctccccccgtccgaggagcccctggttggtgacacaggtgcacaccgcagcttcaccacagtcatgcgtgccgtttggttgtagaccctctcaggcaggaagtggagtgtttgtgtagtctcccatttgtgggtgggtttgctgcagctggctggatcccgtccttactcctaaggtggggaggggcgttctcaccctaggggctactcacctggtggatgggagtggacagtgtggagcctgtttgccctgccccgtgagaaagatgacttcatccagacacatgtggaactggctccatagacccaaagcaagcttagtccaaacaatgtctgaaattgtccatctaaaatagaaaccacatgttacatctcgagtcctttctctcgagcctttcttcagtcggggcagaggcccagactcattggagacggagagccctgggcagggggggcagcaccagggagaagcgccgcgtgccagtgatcggctcccatggcttcagcatgggcaggagtggggtaacgcaccccatccaggttgggaatcatctgcagggctagctatgaatgtgggatactctgtctttgcttttcacccgctgagttcatcttctttcctagaagtaaactgaaaagggcagggttttctcattgtctggtggccctctcaccaaagcagaagtgaacatagccatgggcaggttcagcggagaggtgggtcccagagcgctgcgtggctggcctcccactcctgccctgcacaccatccttgagggactcccttgcgcccatttcctcctggcctctacctactttctgctgctgcttcctcccatacccacagagttcacgttgagctgagtgggccactgtccccactgtggacacactcttttatcgcagctacagcacaggaggtgggctctgccctctttcacaaataaatgacttgttccaggtcacaagccagaagtggcattcccaggccaggcagcccagctggtggcacccgcagtctcctaccccctcccctgccatttcctacttcaggaccaggcgtcgcaggagtgggggaaaacagggatctgtccacacggctctggtttaacacagatgcagcccagcagcctttggcgtcctgctgatggcctgcactggcccacgcctggcccgtcctctgcagggctctccagctggctgccggtggcggtgaggggctgtcttcgcggctcacccacaatactactggcaaactctgcaaaccaagtggcaagcagttctggctgccttgttgactccacggccctgtcgtgtttggggtagccattgccagtcccgtttcctcgcaacatctctcttaatcactttctccctgtgttttgccgggttccctagcctttacctttagagctttcttttttttttttttttgagacggagtctcgctctgtcacccaggctggagtgcagtggtgcgatcttggctcactgcaacttccacctcctgtgttcaagcaattttcctgtctcagcctcccaagtagctggagttacaggcgtgcgctagcacgcccagctaatttttgtattcttagtagagacagagtttcaccatgttggccaggctggtctcgaactcctgacctcaggtgatcctccggcctcagcctcccaaagtgctgaggtaagccacaccatacgcgtgagccaccatgcccggccctacccttagtcttgatatatcagaaaagcactgtttgatgtgcttcagtgtaaaccattgtggttcggtgaattctggcaggtcatctggaggtttctttggagagcttctatcctactggaaacccaggttgggccccatgtggattgatcggcagtgggaatcagctagggctgctgtaactgagttcgcagacccagtggcatagacagcaaagaggtactgccacgtggctttggagaccagaagtctgagaggaaggtgctggcagggctggttccttctgaggctgcaatggaaaacctgtcctggcctctctcctggcatctgctggttatctttggtgttccctgtagacagctgccccctccctgtatcttcatgtcgtcttccttctctgtgtccttctcttcacgtagtctttttaggacgctggtcgtgttgccttagggcccccatgtcagtgccgtcatctagactgatgatgcccgcagtgatcctgtctccagataaggtcatgtcctgaggtgttctgggttaggactttgacgtttgaatggtggggggtggtggacacaattcagcccctgacagcagcttttctctcccctccctgacgctgtcgcagctgcagtgacatgtacgagaaagtgctgtgcaccagctgtgccatgttcgagacctgaggctggctcaagccggctgccttcaccgggagccacgccgtgcatggcagccttccctggacgagcgctcggtgttcacactgaactgtggggtcgacgggaggggtgccttttacatgttctattttgtatcctaatgacagaatgaataaacctctttatatttgcacaagaggactcttgtctgtcagcacttctgagggtggagtttgtgaccctccacctgggagggccaaaggagcagtcagtgggcggggcctgctgcacctgctgtctacccgccagctcctagagaccccactgtgcattgtgtgaggccccttactcgccccctgctacaggtgggaaggctcagcccagagcacgctcctccccagctcgcccagctggtaaatggggagaaaggacccaggtctggctccagggtacacaaccagtgtactagaccttcacggagagaggtgatactcgcgccccatccccagacgccactgtcatgcacgcctgatccatcacatcttggtgtccactttacttttttggtgcctgtatggtcaggccccgtgtgattgataggcccctgccctccaggagctttgctctagcaggggagatgggcccagctgtgctccctctggagtcggtgtagcttgtgtggggccttgaaggaagaggagttgacaggagaggaggcggggtggcctggaggacagaagagggcaggctgcttgagtgctggtccccacacaagtcgactgaggcgggtcccagcccctccagggatgagtgagcagttgagccacagcccctctgagaagctctggactagagtaaaggttgtttggggcagagggtgggtgggagcatgtgctggggacagttgagaagagcctttgctgttcctgggaagctgttagaagagcaaattatgctgattcttagagaaaagtcagtggtgcccaagtggtgggttggagccaggcccagagtgggatttgctgccctggggccgaggatataccactcccgtgtcacgggtagagggggcgctcagagaggtggtcagcatggtaaaattccagggggcaacttagaaggggattgcagaggactggctgggggcttcctgcaatgaggacggccttgaccgcctgctgcgagcatcgggagcaagtggccacggtcagccacgtgctgactccttccaggtttccacaacagactgccacccaagccctcatttctgttactcctgtcgctgccccctcgggcctgtcggctcttcccttcacatcctctggccacatccctgccccacaggaccacactactccagccagcctgcctccttcccctatagggtcactacatagcgccttccaggctccctgcttctgccctgcacctggcagtctgtccttatacagcagccagatctgtcactcccctgtcccaacactccagtggctaaacatgtccttaaaagtaaaagtctgtggccccacagcctctggcttcacccctcctcccctatcccaaggcttgctctgccccagccaggccttcctgctgttctgagaatgctcagcatgtttcccctgcacccccctcgctccttctgcctggggagctcttcctctggacatccatagggctcccccggattcagctcagagaagcatcccagtgccctaatgtgtaggacaacccctccatcacgctccctctcgccctacctaactttaccactggacgtaatgcatatttaagtaaatatgcaaatgtacttattctaactctactaactgaggtgtcgcttccgtgaggggtgggactttgcctagagcagtacctggcatatatgtttgcagtaaatattgttggtcttccagctgtggtggagcaacaaaaactggcccatagatgactatatagagagagagacatcggacagcagccattgcaggatagtaacgcctgagagagggaacaaacaccaagagcccagggcagctgcaacactggagtagaaattgcctcagtgttcccctaaggctcctgctgaggactgatggctcctgtgtgtgaggaaactgcctgaggctggggaaagagccattggaagaaagcgggaagcaagtcacattcccagcactaagtgtggggaaacatcattcatggagaacagggtagaggactcaaaaggatattgatgccatattcaggctagattagccctagactagagactgctctgtgccttcctaacacctttaagtcaagcctcaaaaagaccaaacggttgcaagtgctttaatagcatccagaacaaaactcaaaagtaagggggaaaacatatttatttacttattttttttagaacaaacgaggccgggtgtcagaggctcacgcctgtaatccaagcactgtgggaggtcaaggcgggtggatcacttgaggctaggagtttgagaacagcctggccaacatggtgaaaccccgtctctaaaaatacaaaaataagccaggcacggtggcatgtgcctgtaatcccagctactcggaaggccgaggcaggagaatcacttgaacccaggaggtggaggtaagtaagccaagatctcaatctcaccactgcactctagcctgggcgacagagtgagactccgtctcaaaaaaagaaaaaaaacaatcaaacatgcaaagaagcaggaactataccacacaatgagaagaaaagttagtctgtagaaacagacccagaaatgacacaaggtggtagaataattccgtctactaagtagacagggacatcagaatggccattattaagaaggatagacgaaaacaggagcatgttaagaaaaggaatgaaagacataaaaatggcccaaacaatttccagagacaaaaatacaatgtctgagatggaaaatacactgatgagattaaaaccaaaatagacattgcagagcaaaaaattagtggacttgaagccattgcaatataagctatccaaaagggaacagaaaaaaaatgaggaaaatggcagagcccctctgagttgtgggaccacttcaagcagcctactgtgcctttaactggagacccatggacgaggggcatagcagggtggagacaacttttggaaaaaataacggcaggccgggcgtggtggctcacgcctgtaatctcaacactttgggaagctgatgctggcggatcaccagaggtcaggagtttgagaccagcctggccaacatggtgaaaccctgtctctactaaaaatgcaaaaattagccaggcgtggtggcaggtgcttataatcccagctacttgggaggctgaggcaggagaatcgcttgaacccgggaggcggaggttgcagcaagctgagattgtgccattgcactccagcctgggcaacaagagcgaaactccatctctaaataaataaataaataaaataatgactgtaaaatttcctaatttggtggaaacataaagccacagatccaggaagctcaacaaaccccaaaagaaacatggagaaaattacatgaagcacatcatcatgaaattcctccaaaccagtgacaaataaaaaaaagcagccagagaaaaaagacactttgtgtttacaggaacaaagaatggcagcaagacttctcactagaaactgcaagcagacagtgaacaacacctgtgggttgggcaaagaacttgaataaacttatttatttatttttttgagatggagtttcgctcttgttgcccaggctggagtgcggtggcacgatctcgcctcaccacaacctccgcctccctggttcaagcaattcgcctgcctcggcctcccaaatagctgggatttcaggcatgcgcctccatgcctgcctaattttgtatttttagtggagacggggtttctctatgtcggttaggctggtctcaaactcccaacctcaggtgatctgcctacctcagcctcccaaagtgctgggatttgtaatcccaagcccagcttgaataaacatttatccaaatttagttttgaaagaaaagaatgtcaacctggaattctatacccagtgaaaatatctttcaaaagtgaaggtgaaataaagacttttcagacatacaaagctggaagatttacaaaaattgtcaaaagaagtttttctggcagaaggaaaatgacaccagatggaaactgcttgtacacaaagatatgacgagcacctgaaatggtcactgtttgggaggacacaaaaggcagggttttttctgatttttaaaagtgcctgttgtcccagctactcaggagattaagctgggagaatcacttgataggggttcaaagccagcctgggcaacatggcaagaccctgtctttattttattttatttattatttttttttttgacagtgtcttgctctgtcacccaggttggagtgcagtggcctgatctcggctcactgcaagctctgcctcccgggttcatgccattctcctgcctcagcctcctgagtagctgggactacaggtgcccgccaccacgctcggtgaattttttgtatttttagtagagacgaggtttcaccgtgttagccaggatggtctcaatctcctgacctcgtgatctgcccacctcggcctcccaaagtgctgggattacaggcatgagccactgcgcccagctgaccctgtctttaaatatgtatatatataatctctttaaaagacaattgcctaggccagctgcagtggttcacacctgtaattccaacactttgggaggctgaggcaggcgaatcacctgaggtcaggagttcaaggtttggccaacatggcaaaaacccatctctactaaaaatacaaaaattagccaggtgtggtggcggcgcacgcctgtaatcccagctattgaggaggctgaggcaggagaatcccttgaacccaggaggcagaggttgcagtgacccgagatcgcgccattgcactccagcctgggcaacagagcaagactatcttaattttaaaaaaggccaggcgtggtggctcatgcctgtaatcccagcactttgggaggctgatgctggcagatcacctgaggtcaggagttcgagaccagcctgaccaacatggtaaaaccctgtctgtactaaaaatacaaaaaaaaaaaaattagctgggcatggtggtgggcgcctgtaatcccagctactcaggaggctgaggcaggagaatcgcttgaacctcggaggcagaggttgcagtgagcctagatcgcgccattgcactccagcctgggtgacagagcgagactctgtctcaaagaaaaaaaaaaattttttttaattgtctatacagatgctcctcagcttacaatgggttacatccagataaatccatcacgagttgaaaatattgttaagggccaggcgcagtggctcatgcctgtaatcccagcactttgggaggccgaggcgggtggatcacgaggtcaggagatagagaccatcctggctaacacagtgaaaccccgtgtctactaaaaatacaaaaaattagccgggcgtgttggcaggctcctgtagtcccagctactcgggaggctgaggcaggagaatggcatgaacccaggaggcagagcttgcagtgagccgagatcgcgccactgcactccagcctgggtgacagagcgagactccgtctcaaaaaaaaaaaaaaaaaaaaaaaagaaaatattgttaaggagcatactgaatgtgtatagcttttgcaacattgtaaagttgaaaaattataagtttaaccattgtaagtcagggaccatctatacataaagaactcctaacacgcagcaattaaaaaaaaaatccaaaaatgggcaaaggacttgagtaaacatttgtccaaagaatatataaaaacagcacacacatgaaaagatgctcaacatcactgattatcagggaaatgcaaatcaaaaccacaatgagataccacctcacacccatcaagatagctactatttgaaaataaaacaagtgtcggggaggatatggagaaattggaacatttgtgcactgccggtgggaatgtgaaatggtgcagccagtgcagaaaacagtaggcagttcctcaaaacactaaacataagcctggcacagtggctaatgcctgtaatcctagtggtttggaaggctgagacaggaggatcacttgagcccaggagtttgagaccagcctgggcaacatagtgagactatgtctcaaaaaaatgaaaggaaaattaaaactgaacacagaattactgtttgatccagcaattccacttctgggtacagacacaaaataattgacagcagggacgtgaacaggtatttgtacacaagtttgtagcagcattatccccagtagccaaaagatggaaacaacccaaatgttcatcacaggacaaatgaataaacaaaatgtggtctatacatgcaataaaatagtattcagccttaaaaagaaataaaattctgacatgctacaacacaaatgaaccttaaagatactatgactgagtgaaataagccagacacaaaaagacaaacactgcatgatctcacgtatatgaaatccccagagggctggggagctacattcattcatttattcaaaatatatttattctaaatgcaacacagtatcctggattgtatgtgtatactggaatagaaaaagaacatcagtgggaaaactggtaaaatccaaaaaataagccaataaaggagataaaatgagacaatcggcaatacttatttaatacaaaaaaaggaaaggaaaggaggaacaaagaacaaatggaatgtatagaaaaagagcaagatagtacatttaagctcaaccatatcaatagttgcattaaatgtaaatggtctagacaccttaattaatgggcaatgattgttagacttttttttttaaataacaacaaaaaccctacatgctgtcagccccttctgtagctctttcccagacttgctagaagcaaaaggatgaaataattatctgttgtatgataaagtcagcctttgaacagacattcactggaagtgacatcttctgggaaggcaggcctagcccttatcctgacatgccccagtagcactctcagctcctgggacctcgtctacaacattgaggcccccagacccagagacctgcagagccttcagttacccacacctgctgaaacatgggaggtctaagtgctcaagtcacttttattatcttcctcccttccaggccggccttgtgctggaaagagcatgatgtgggcatgtgagaaacaaactcacccatccacacccgaagaatggactcagagacctcagagaccggagaacagcaaaagtgagacttttaatgatagtcttgcaagattgggtgcctgatgagctggcacacccagcacagtttcaacaagcaatttatcccctagtgtgcaggtccctcccccggttcttcataggctgagtactatggggtcacaaccttcctggacgtcacctattggttgttgggcaggggctttaggtgttttctttagagttgtcttgctgcattctgttgcagcccacaatgcattgcaatcctagttagctcaggggctcttcaaatatttgacttctgacctaagtagctgggcaggctgatacgaacagacaaagcgagctattttggaggctagtaaactttcattttagactaaactttggttcaggtgagggaaactaagggacgggggctggcggtgacaaacaggcgttggctatccaagcaggggcctagtatatcctgttgcttccgtagtttgctgacctaagctgattttaggcactttgtcttggaaatggacactttatgcattgtttccttcggggtacctctgacacaggaaggagagcttcctcttggttggcgtattcctgttacaacctctccagacagccctcgctgttcggcaggccctgttggggctgcaggatcctggccctctccacccgctctggcctcgctggccaggactggactgccccttgcaagggcacctgcacctcctggagtttcctctctgagatgtgcatctccttgcacatctcacccctcactgacaccctccaccccactcctgggatgctgcctcctgctgtagatggttctgtctggggctgctaggagggtcgggaaattctcagagggtctccatttctgcgttcattttgttaggtcctcagccacttgtaacggggacataacacagggtcatgtctgtattaatgccaatgacgttgaagcctctctctctctggactatagaactatccctaagaggccaggtgtggtggctcacaccttataatcccaacgttttgggaggacaaggcaggaggatcacttgaggcccggagttcaagaccggcctgaacaacatagcgagaccctatctctaccataaaaaaggtaagaaatggccctaaggcaatcctatattgtcagagggggccgtgctgggagaagcagcccatgcttctcagccgggctgtctgggagatgctgcgtctgcctgaccatttccataccttggttactttcagcaatgctttgctcaaagtttgtggatattggaagggcattgctgtattttttggtttctaagagtcacattattgatagatctgaaatccagatgcctctcaccctcggaacatcatttactgtgtcatgtttcgtgtatttcccgaaaagcggtatcagttttgcggcctgttagaactgaagcaataagggatcacccagaggagagcttcgggctgctccagatgtggctgttcttggctcccacagacccagaacatcctcgccagcctgtgctccctatggggcaccccctccagtggaagtgagggcagccacgcacccctgggaatgccttagagaggggccaattgccatcgccaggggcctgactctgcaaccatccacacctacggggagtccatttgagagatgaggaagctgaagctccaggcccctggctcgtgctggtcacccaaccacccggaacctggtcgccaacccgctgtcagttgctcggcagtggactcctctcctggctcagggcgcggttccggcaggcgtccaccaggtggcagcaccggcacattctgcaggctgttccggctcagagctcgatgtagtgctctggggtaacctgggccccagcctgtcccctcccgccccctgcagcccctcctcccaccgcctgcagcccctcctcccgctctgtccagcttcgaacaggccactcaggcctcccagccttacttccaccgtggcccaggccatgaccttggccccaactctgggccctgccctatctgtccttcctggtggtctgtctcattcactgccctacccaggggaacagcacctggggctggggggcagatggccacgtggtccaatggtctccttcatggctggggtgaagctgggtggggtcaagggaagaagaggtggatcccaacgggggcagggccagccagggcctcccatctcccctcaggccaggcctctggagatgggggtggaacaccttccatgggaggctgcccctgggaacaggcctgtatactcccgcctcggcccaccacacagcctgtccccaaacctgttggggtggcggtgcccaccaggaggagctggggaggaccagctgctctgaggatgctgcttccctcccaggactccccactccctccctggccacccactcttccacccagcaaagtgagccaaaaatttgaaaagcaacttttattgaagaatttggagggaaggttccatattatattataatagtaaaaatactaaagttgaatgttgtaaaaaaacgccgtggtgcagcggcagcggcagcgtctggccaggaggcgtggaggggcccagggatggccacccccacagggagtcagggagggcctggggcgacagcggaaaggttaagcgtcgaaaaggtcaagtgctaccgtggagagatcatctgagggggaggctcccggtgggacagtcaccaagaactgtgacacagaaggggaagggggagggctttcctgtcacaaagattaaaaacccccaaaatgcatttgaacaacataatacacaataacaaatttaaaccttgctcctctgtcccactgggtaaaccctggcccatcccccatccctggtcccatcccaggggcccagcctccgatgacgtcctcagagacacggccttagtgctggggggctgctgtgtgcctgccacccccaggagagggtgctggccagcataccatagtgaggttgcatctggtgccaccaggttgaactgaggcccagggccccagagagatgacagatagctggtgacagacagcccagggcggctggctgacagagtgaggggacacatgggcaggacctgcccggccccccaatgccacattgcgcatagctgcagaagtccttaacatttccctacgtgaatcggattgttctgagggctgaggccacacccggagaacaaactggatgaaataaattaaaacccgcaggatagttttcttccctaccccgctgcgggggagggtgctgcccacagcacaaaaacgtctttccatctgggctcgagaggacagcgtggcttctctcaaatgcacccgagaaataaaaaccattaaatacagatcatggcacgaggccgcctctccatccctccaagctatcgtccagcgcagtccaccgccgcctcaggccgtgccgctggccgagtaggagaactgggggaagtggggcctgcgctcgctgtccacacactccatgctgtcatctgtgggtgtagacagctcagaccccggtgccccacctccctgccacctccacccacccacagctccagtaggaagccaacctcttaaagcacggccagcacgctgccatactgccaggaaactgagacagggccccacagattgacacagggacctgggccctcagagcactgcctcccaccctgatcattggcactctccaaaaggaacctttttaaatatttagattttaaaacatctgaagccaaaaaagctgaacactgcaggcctctctgagtgtggagagaaaagggagtgggcgggggcaggcagtggcccctcaccttggtcaggtggtgtgatggtgatcatctgggccgtgaactcctcatcaaaatacctggtgtcagtctccgacgtgacctggggcttgaagggtgggctgagctgcagaggtgggcagacgggacagtcatgagcttcgctccccactcccagcacaccctcaagtgtgctcaagaccttcaaagcacctggatctccaaggggtctccaggcaggactgatgtcagagagcagcaagccaccagccccccacagaggcagctctgggagggagggacatgaggggtgcaggagcacggagacaaccctcaacagctgagacgcaaagctgccctcacagcagccccagcaggcgacaggaggtagtgcagcccagctctgagagaccctccctgctaccaggaggtgataactttatttttcctttttctttcttgttttcttatttttcttattggtcttcttgtaaattgggaaagagggagactgtggaacaaggtgcacaggatgagcccaccctgcctccatggctcagggactacaggaccacagcctgctggcatctggctgcagacaggactctcaatgacccaggatgaagggtgactataaggtgatgtgcacacgtgaggagctgccagagagcccctcaggtcccacagtcaaggaccccctcaagcactgccccaccccagagtctgggctgggcaccagcattgtccattgtcaattagcaaggtctctggtcaaggctgggcagaggttgagcactgcccaggccccccatacccttggagggcagggcaggagggtggcaggcctcaaggcaggaacggggaccaggaccagggcaccctgtgttaatgggagaacaggtgcccagctgggtcccagggctgcccagcccgaccagctgcacacagcctaggacaggcattcaggggaggggcaggctgggaacggggcagaagcacacctggtgacagggcacccagcatctcagagtgcaggcttccgaacccagctggcagaccccatcagctggggtgatggccagggctcctagggtccctgaaagatgagcacccaggatggcgactcatgcagaaagagctgcctccctccagggcggactcccccatgtgccagaaaagtaggtgctgtccctgtccctgcacagccagaaatagggctgggctctccttgcggcagaagggattgaggtcaaacaggaggaactcgtggaggccaaggggcagcacccctggtccaccaccagccagccttcactgcacagcgtcagggaagggaaccccaaggctggcactcagagtgtgacacacctccgaggggaggaggaaactcagagtgtgacacacctccgaggggaggaggaaatgaggaccaggccagtttcctggtggaacccggcagtgccagagcctctgagcaccaggcgctgaggttggtgcagcaaggccctccttgtaccaggactgcagcaggctcctgaggtgagggcgagtgtgtgggaaatctggcgagcgtgccacgtgcatgcgtgagtgtggatatgtggggagcatgcgtgcgcgtgaatatgcggggagcagccgcaccttcttctcgtacacgtgctgccacacgataccggcaaagaagcgatgctgcatgatctccttggcgtcctcggagcccccgccaagcctgcaggcaggaaacaaggccacagtgtcggtaccgccacctgcccaggccctgggttcaggccccttcctcctgtgatgtagggcccgccagacaggacgttccggggccagggaggggagccggtggtgcagcgtccctgagcagctgtgggtagcaaagcaccacagagctcacggcagggcaggggcttcctgagtgggtgggtgcaggctgcagggttggggacagaggcccaactgaccccggcctgcccgccactctgcttgggcctgaggctttggagatcagccctggccaaggacatcaagctttggctatcagtgtagtctgggaggtgccaggaccgcctggcgcaggggcaggtgcagcctggggatgaggggatggaggtgtagcctgtagctgggatgggcggccctcacctctgcttggggtccttcttgagcagccctgaaagcaaggacttggcctcgggaccaagcgtgcgcgggaagcggatctcctccatgaggatgagctcaaaaagcttctcatggtcctggttgtagaagggcaggcgaccgcacatcatctcgtacatgaccacgcccagcccccaccagtccactgcacggccgtagtcattgtcctccagcacctgcacgggtggcagatgggcaggactcggcatcaaggggtgtccgggacactgccgggggaggtgtgacgtgcttggggcacagagaggacacagcattgcgtgtgctcaggacgtggggacgcagcaacgcgtatgcacgcaggtggggcgcacacctcgggggccaggtactcaggtgtgccgcaaaaggtcttcatggtggcaccgtccttgatcccctccttgcacagcccgaagtctgtgatcttaatgtgcccgtccttgtccagcatgaggttctccagctaggggaaaggtggcctcaggtcagtgccgccaggcccccagggccctgcccccctgcctgcccgccagcgcaccttgaggtcccggtacaccacgttcttctccgagtgcaggtagtccagggctgacacaatctcagcgccatagaagcgggcccggtcctcggagaacacacgctcccgggacaggtggaagaacagctgcgggaggcgcaacctgaggcacagccgtggctcgggcctctgcccccatggcctgcagggctggggtttctcagaccgggtctcggcattgcacagggaagggaccagccaccagagggcacgggggcctggaaagtctcagaagccctaactcagcaggaacaagtcaccccacagcaggcagctgcctgggcaggcatcacaccacccacccagcagggagcaccgtctggtgccatggagagtagccgaggctccgggaaggaccggccccaccatgggcggcccacaggccgcgaagtccatcccccgcagccccagcccctacctcgcccccgttggcgtactccatgacaaagcagaggcggtcgtgggtctggaaagagtacttcagggcctgcaaggaaggggagctggaactgcggccccacaggcaggacggcagccccgcaccacgctgcccgacaccacgctgcttgataccacgtcgcctgataccacaccgcccgtagccccacaccacactgcccgacaccacgctgcctgataccacaccgcccgataccacactgccccacaccacacaccccatcacactgccccacaccatacacccccacatcacactgcccccatgccacgctgccccacaccacactgccccacaccacactgcctcatgccacgccaccatcaggctgggccccggcagcccctgaggtgccaaggagtgtttgaaaggtgagcaaggtggcctgggctcaggtcctccagggtgagttgggacctcagcaggggacagtgctcccagcaccagggccttcgcaaagggaggacacaccctcccaggcgagacccaccctcccgccttccaccacaggcgactgtgcttttaaagcaaaggccccatctgcaggagaatcgtccccaaacacagtgacctggaactaaccaagtggctggaccctggcccccttcacagtaaatacctcctgggccaagtccccagaacaggttctgcaggacagagcccgggcctcaacaaaagcctggcaggcagggctgcagggcatggggagctggggcctcctggagcctcggcagagtgcaaggaagaccagggccacctgccccacccacctgcccgcacacgggagcagcgagcacagcccctagcccacactgggcacctccacagcctgaccctccagggcaggcctgtctcaccagcggcggagtccacggtgtgtaaagccctcacgtgcccaagaagacaggacatcgtcccctagagacagccccaggagtcgctacctggccccagcccttcagccccatctgggctcccactcactgtgaggaaggggtgcctggagttctgcaggacgcggttctcggtgagtgtgtgggccacctcgtcctgtaaagcagggctgggtgagctgccaccccgcaccctcatctccaccctgccccaccgccccggccccaccttggccacgatgacttccttcttgaggatcttcatggcgtagtagcggcctgtggccttctccttcaccaggatcaccttgccgaaagtgcccttgcccagcagcttcaggtactcaaactcgttcatggtctatgggcaggcaccagggtcagcaagcggcgctgccaacagtgcccagctggtcggcatgcgtggggtggcatgaggggccccagagtcggaggcagagccaggagaggcgtccacttcacacctggtggcctactgggctcagcggggagtccaggcttacagggaacacatggctgcggccccagctcagagcatggggttcagggaagggtggggtaacattgcccaagcctggcagggctcagcaaccccagttttcctctgacatggggaagaggacccacctgggaagcagctgcgccctacatggaaaaccggcctaggtggagatgccgtggagtgctgagtgtctcctgggccgagctgggaccccatgacccacccagccctccacagtccaaggcagccccaggcacaggcagaagtggggacaggcctcaccacgcggtgcttgggcttggccagggacacctccatctcttcagcccctgagttgtcactgggtgagcccgaccggaagtccatctcctcctcctcctgcttcttgaggccgtcagccacagtctggatggcggttgtccactcctccctgcaggaggtcaggtgaggctgcaggcctgtaccagatcaggagctccaccccacgtctttcacccacccgccagcctcacaagcgtggttccacagctgtcggggttcccagagacagccctgaggaggccaccacttgacctggtctggccacatacactcagggtcacgaagccctcttggacgtgggggacacccaggcttagccccccagcaggactctgtccccacaaccggactccaacccccagcaggactccgccccccagcaggactccgccccccccaagcaggactccgcctcccaagcaggactccgccccccaaggaggactggccctctccaccgggtttttctttttttgagacggagtcttgctctatcgccctggctggagtgcagtggtaaaatctcggctcctgcagcctctgcctctcgggttcaagcgattcttgtgcctcagcctcccaagtagccgggattacaggtgtgcaccaccacacccagctaagttttatatttttagtagagacgggggtttcaccatgttggcaggctagtctcaaactcctggtctcaagtgatctgcgcacctcggcctcccaaagtgccgagattatagacgtgagccactgcacccggtccctagccagtttttatctccagcctcagtttccccacccaaaccccacaggcaggactgggccagtttccaaactgggctctgaggagggcctgggagcactggggagtgaggatggctacaggcagaggtgccagcaccccgccatccccgtgtccctcctaagcgctggggctgcccaagtgcctggcctggccgccacagcccacgtaccgctcctcaggagtctccacatggaaggtgcgttcgatgacagtggtccactgcaggcagcggatgatgaaggtgttgggccggggccgctccgtcttcatcagctggcactctgcgggcaggcagagcctctgtctgcgtgcatccccctgcccctcccagggccctcaccacagcccccgctgcaccagccagctccccttgcataccacccaccaggtcctgggaagccccatctcttcctctctccaagcctcagtttctcgcctcacagagtggggctaggacccctgttccagctcagacactctactccaggctgaggcagccacacagggcatctggcccggcgtcaggtcaaacccccaccatcgtccactcctacagtccttccttcagtctctgagccccgccgtgcgccaggcctcagaggatgaggggtatggagatcccacagaggggctggcatgaggggggcaccccagaaacctgcttgtcccacctagtgtagaaatgtcctgcttttttcccaacctcaccctgagtacctgggaaatacagccacctggagcacacccacacctggggcacacccacacctggggcacaggcacacctggggcacagccacacctggggcacaggcacacctggggcacagccacacctggggcacacatacatctggggcacacacacactggaggcaaagccacacctggggcacacgcacacctgaggcacacacctggggcacacgcacacctgggacacagccacactggaatacacagacatctagaacacatctagacacctagccacatctggggcacacgaacacctggggcacacgcacacctggggcacagccacacctggggcacaagcacacctggggaacacatacctggggcacagccacacctacagcacgtacaccctgagggctgtgggaacgtgcggggccctgagaggtgtgagtgagtggagtgtgtagccgctggggctccgtggcaggctctggcccagcctgtgcaaagcaggaggaggctgaggggccagtggggggcctctgacattccagcatcgaggccctggcaaccacaagggggcctggccaggcagcaaggaagctgtcttccaggcctgggggccaggagggggctcgggaccagcctggtggggagggtggcctgtgtcaacacaggccagagaagtggaaaccggtgtgaagccccggcacacccacctcccactcgctcctggatggtccgatctgccccagtatgcaatccccagggccagagtctcgagcccactgccccggaaccgttccccggagaaaagccccggacagaggcccagcacagcccctggcccctgcccagctctgctccttggccaggcgctccaggccactcacctatggcctaatctgaaggccccagccttgccagctgctcaggcaacacctccagctggtacccacccgtgtgcctctccagagagctccccacctcgttccttcccaatgcctcggcctggcgagcacacccacagcacccacccccagcaaggccctgtcccaggtgccaccaggcacgctgctggcacccagcctctccctgatccctgaagcccccagccccaaccgaggagacactggggagggtgtgggacaagtcacagtgagtctcctgcatggttacgaggctgtcaggagacaggggtgtctgccttcctggtctcccctcacccctggggtgccctactctatcaggctgccctgctactgctggcttgaggctggaagagccagggaaggagacctcggcttacaggaaccaggtcctggtaaaccccaccccaaccccagcccctcagcctggggctttgcagggcaaggcctctgcccctcccaactagaagcttcagggcacggtttgctggccacagaccacctagcagccagggtgccagactgaccccacctccccttatacgtgcaggcaccaagggtgggagtccttccctgcccagcctggggacggattccctgcatttaacctcctcccagaccctggaccagaacctgggggtccagcaagttcaagggagtcggaggaccgcaggcctcaaagaaaggagggcagagctacttggaggggaggggccgatgcagcacatggggatggaacctaaggccagcccctggtgggcacctcgctctgcaccacagacctgcctgagacagatcccagaggcctgcagttacccagccctgccacatacagatggcccacaactgggccctaattagccactcagtcacacctgcatgcccaacccgtgtctctggctgccacaggcagagctgggctccaggacagggacacagaaaatggggaccatgctgggaggcccacgtgtccccagcctcccacctagcagggcgcctgggtctccatgccagggttcccgtctgacatgggtagggtcgcacctgcccccgctacaggtaaggaataaagccacagcagggcggagcagggagcgtcacatgtctctcatctctgtgggatgctccggccaaggtcccccgctggcctttctgcacctgcccctccatgggcaaggaggcagcctcacagaggggaagcaaaggctctgccatggggtctggaggctgagagcctgtgcagggagaggcacgagctcttcctcgagtgatggaggcttcagagctggagaccccaatggactcttgccccctcacccaaggggtttcccaaggagaggccctgatgggctctatctaacccccttggaggaggggcccccggggcagctgtccaccctgagactgggctctgctgccacttgtccggaccctccagcttccagagcatgggcaccagggaactgctccagggtcagccagccttgggactcggcccagagacccccgcccagccagcctcggcctcaggactctgcccagaaacccctgcccagccggcctcggcctcgggactcagcccagagaccccggcccagccagcctcggcctcgggactcggaccagagacccccgcccagccagcctcaggactcagctcggagacccctgcccagccagcctcggcctcgggacttggaccagagacccctgcccagccagcctcggccttaggactcagcctggagactcccacccagccagcctcagctttgggactcagcccggagacccctgcccagccagcctcgggactcggcccagagacccccacccagccagtgcttgttgcttgccagcccaggacttggaggctccaggggacccccatcgtggggcctggtgggcaaagagggctccagccaaccccccaaatctgaatcccgagaggccaaggggatacttacgcgccacagagaagttgttgaggggagcctcacgttggtccacatcctgcggccgctccttgtagccaatgaaggtgccatcattcttgaggaggaagtagcgtggccgccaggtcttgatgtactcccctacagacgtgcgggtggtgagagccacgcacactctacccgtcagaccctcgccaggcagccaggcaggaactgggtgtgccaggacagatgtgcctgggatgcctgagtcccagggggcaggcgcggtacgggagctgtttcttagggccagcgacagaaacggccctgggtcaacgggaaggcagactcgccccaccacagcgcccctctcagaagagccaccccgagctgtgtctgaaaacgggctgggccagctggacgcaggggatggagtaccatggacaggaggctgggaagaggtctgggccagtctgcacagccttcctggaggaggcagccctaaaccagccagtccccagcaggcaccagcagcagctcgggccccagctatggccacaggggctgcggggctgacagcattccccaatcaaccagggtcggccaggtggcgacagcaggtgacagtggcttgtgtgggctgcccagcatggccgccccccccgccccgccgccacccaccaggaggatggagcatggcgtccacagttagaggtcagcaccactcagactgagggccgggctcgcgggacaggactgcccactgccgtgggatcgcactccctgtctaggggcctggagcaccgtcttggggactgccgatgaagccagacacggaggtggcccagccagctgggcaggggccccagggcacagagggtgccaagtccccaggctgagacccacactcaggccctgccgccgtcggccctgccgcgtcccacccgtgggtcattcaggtacacgggaacattctccctcaagttttgcagcatcagccgtacgcaggcgttcacacttcagaatcagagcagctgtcctcggtgatagcccagcaagtaccatttttcatactgacactcggaaaaaaatgttccacttacattttgccaagcaaggagtttgaacaacagggaacttactaattaggcaactgcttcatctgaggggtcactgggcaggggttagggagggggccagggtaaggggttggggtccctgagctctggggcctgggttttcatgccacactgagccccagacagggacacctggagggatgtgggggacaagcaattgtcccatcaccagaccacccaccacccagtcctgctgggtcttcgtggtgagcccagacgcgtccagccctccctggtgcacagggaagtcccagcagggcagcagccccaggggagctcagaggacatgggtcatgggcatcccagcaggcattctactttccagggagccacgggggagttctttaatagaggtgagccaccaaggctcgacacatggccaccccccggccaggtgacctctccctcctaccccggccccagctgcccaatgcccttcccaccagcaccacggggcgtggtctccacaagaccagccctctctctgcccaagccagggctgctggggggatgctggtggagggtggggacaccccacccagcagggcctgagtgtgggaagaggctgttgtcaggtctggggtggaccaggaaggggacagccacagcccactcatagctgcctgacacctctggaggacggccaacacccagttgcagggaggatgatccagggcccagaatctgcccctgtgcccaagagcactcatcaggagaccccacccactccgcaagccctccatgcccctgccagtgggctgccgagcaggcgtggtcctgccacccttgggtgccggctcctgtccctgacctgggatctcgcacacccccgagtgtgcacatacacgcacatacgtgccacgcagctccaccccgcctcccacgtcccctcccccagccacagggcccctgcaggtgcagcgggcaggcaggggcgctcagtgagagcagagcaggctcagggggctgcatgcagcccaccccacccgtcccccatcctgggccaccccgctgctcacgcccacccgcctgcatgccagtctggagctgtcggcccctgatggagtgcctcccatcctgccagctgccactccccgggacgctaactgagcgggaagactgatgagcgcccaggcccggcacccctgaaacccatcttatccaccaactgctgccagcccccaccgtgcccagcatggccccgtgctgcccccgagcacgcagctcccgtgcccaaccccagccttgcccctgaccctgctgccacaagcccagccccaggttctgtgagctgcatctggggggttctgggagctggatctgggggtgcgggaggggcaggcccaggggcggcgcttaccaggcgtggggggtgggagaggacaggtgcccagccccgagcattcctggggagtcctgggatgggcagaggcccaaatgggccctgggctttcagtgccttcccctcgcctggccccacagacccagggaacagacggcgatcagggcctaccccaggagacgggtgtgagtgaaggggcctcacgtggcctttgtcttcggcatcccagcccagcacacagacccctccaggggaggagcaggatccccagggacccggggtaaggggtccagagacacacagttctctttcttcatctctcgcctagagggtcagctagaggatcacttgggggggtgccagctgcagccagggccgtggcgcgcatcttaacgagttcagcccagacaggatgctgggtgggcggccagccccgacagcagatgcggcagggccccactactccctgatccaggactggggtgacacaggacggggcaggtggaggagacagccacccggggcccagcatcactgtcctcatggccacaggacgcctgcaggcctgcacctgcctactccgggtccctcaggagggtgggagcacagacacatcagccagggctgccctcccagacccctcacacaaagagaccaacccacatggagtcttctccttcactatcctgagggtccccaggggaactggaacctgtcatccaggacttaacttgagttccccaccctgttgtggtcctcagatgccccccactcgaggcaggagtacagtccacttgaagagtggcctctcaatccctgacaccccaggaaaagtgccctgcattgctgggggaactggaaccaggcagtagggacctcgtcctccacaccgaccatgggaagcacccgccacagaggggccttccatctccccaccatcagccagctggcatccccccaccccaccccagtcacccccccaacaccaccccacccacctgcctgcacagctgagggcaccaaacacagagtgggcacagacccccaggttgccacgccaggccctcactccagacgggtacaggcaggcaacaaatggggaggccagggcacgccccaccccacacacagccagagtcatctcctgccagcagccactcccaagggcaatggagaccgcccagcattcaggcccagggggcctcttcagtccctaactctcacacccccatgctgggctcaagaacccccaagtccccacccgctgcacatgtttcagacccgggacctggagcaggcagggtcccagtgcaaccccggcctgggcctcagggtctggcagggaagacggctaggtgccccttcagaaatgtcagcaagtccggatgggggaccccacaccactgccagaagacctgagtggggggccgagtggaggacggcactggggactggtcccaccttcctgccccatggctggtcccctgggcaagggggaagcagcagctccggtcccaccctcctgccccatggccggttccctcggcagcggggaagcagcagttccagtctcaccctcctgctggccccctgggcagtgggaggcagcagctccggtcccacccttcagggttctctcaaggccagccctgggccaggtgggagccaccctgacccttaaccctgtgacactgcacctatccaagaccaggtcctgtgaagccacaagggcaggggctcctgtgcctgatgaaacccgtaaccctccccaccagccagcacatccatggcccagggctccaggcatgggaggtggctgccctcggtggggggtaggcagttggccagactcctgtccctgcccggggggacagcggagaccaggctccctcgactcctcctgcacctcctgggccccacacaaccccagccctggtccctctggcatcccgatgtcccgggtggccctccggcaggagtgaccttccatccccaaccccgctcatccccaggaaggggctggagcacccccagggaaagagggttccttcccagaagtcctcctggaccaaataccggggttctgagaggaagctgctcctgcctggcctcccccaacccaccccaccaccaccacggggaccacatggacagtcacaggcagcccaccctctccacgcctcacacacgtgtcccaggccacactgtgggtcaggccccccaaagcggcacccacttagacatgggggccaggacccacgcgccatgggcaggactgggtgggcccctgagggccagctggtggccctccacgtcccgggactgaccacctcctgagccaccaggtgtgtcagcccccctaggccaccacgtcctcagctccctgaacattctctcaaagtccccagttctcaggaaactgctggataaacacttcgcagagacggtggtggcagcggctggcagggtgccaggcggcaccgagctgcttctccacagcaaagtgagcccagcaggccctgggagcgggcgccagctgacagcggccaccgtggtccccactgccgacacatccatcgccccgacagctgccgggggcccatttaccttctccagcacattgagcagacggctccgctgacggcagcccatgaggggcccgcaacccaccctccccgcctgccaggagaccgcacagctcaccgcgaagggcccggcctgccaggcctctgcccgggcccgggagtacacacccctttaccagcagccctcgaaccctgtaaacaaccaggctggggtgggggcaggggaggggccacacaacggaggccagctgaccccacttggctggagcccccaggtctgtgggtgaaatacatccactgctcctcccggcacaagcccttctgagggggcacaagtggccagtctgcacaaggagaggtgtctgttcccgccaggcagaggactggcgctccacctgcctgggcctcgcccagcccaggacccattctgctctcccagaaagcccaccaggcaggcagggcgggcagggctcatcatgcccatcagctccctgggaaaacggagacttaggggaggtgaccctcagaggcagatcatgaccagagagaccccaggtcctgccgccaaggcaggggttgtaacttgacacaaactgcaaattcttcacctccttccgctccaccatggagcaggcctcagcccgacacacacaccccgggaggaacatggtgcgggcaggcggcaccaccatgaccccgtccacctcgctgaggcacagccggaggcgctggggcctctcttcctgccactccagggaagcacctgggtctcagctttccattctcctggggctctactgggtggggtactgggcctccctggtgctgcccctgacagaccacctgggcctggatgtcctcccccacaggcactgcccgtcacccacccctcgggccggcaaaggcaccccacctgccacacacccatccatcgcagagcccagcacatcccaagaccctgtccctgtccctgtcccccacctcatttttggtctgccccaaacaagccccacccatgtcatggcccaccctgcctactcaggacccctgcagatgaggctgcagcccctccctggcgcctcctactctgcccccgcccactctccccataacttgcagcaggctttgccaagtgccctccacccagtgggttcccagggccctcaccctcgctccctgcgtgggaggaagctgggcatggggacagcacacagtgcctgctgcgagggagggctggccacagtgtcccacgtgtagacactgccctcgggaaaggaagtgggcacgggcacaggctccttccggggctcggccgggggcacgcagccatgcccacagcccctccctcctcccgtctctcttgggcagggcccctggcggttgaagggctccagtgctggcctctcaatccctgacaccccaggaaaagtgccctgcattgctgggggaactggaaccaggcagtagggacctcgtcctccacaccgaccatgggaagcacccgccacagaggggccttccatctccccaccatcttgtttctgccccaacttggagccacgcctggggcaggagggcccccagagcacggccagctgtggagggtgctccttctgatcccccggcctgctgggacattgtggccctgacccccgtggcctcaccccacacctcaccaagcttgtgcagctcagcgtctccgcgccctacacctggctgctgtgcccctggccccagtctgtggggaggccagccagaccctggccagccgaagggcctctctgcattctccaggcccagggagcagccacctccccgccaggcctgcccagggggtgtctccacccctgagctggacaaccagctgagggcctgggcaggtgggcccgccaggttacagggtatgggtggggtctgcagtcaccgggcccgcctggggggtgtgtgagcccaaacacagcgccccaaggatcccaccccaaagcccgcaacattggcagcagagtcacccatgaactcccaaccccctcaattccaacgtttctgaaatccaaacctatcattccttaaggttcaaggaaaacacacctaaaggcggcatggcagggaagggaactcccgttggagatgaggaagtaaggggcctagggttcgcctaacagccccatcctggcctggagccccagggccctctgccaacctgcccggggccccagcgctgggctgggggaaccttctcctgaggccatgggactaggcacaatggtccaagcagacagaagcagcaggcagctgcccacccagggtggcctggggagcaggcccagagccacagccacagccaccagtctcagctatgggagggcccgagggcagggtgctggccccaagccgggccgggtgtgcccaggcagaggggacgccagcgggggccgcgccagttccctccgctcagcctcgtgcaggacttctaggaacccggcctgatgcaacccggccaggcttctcctgagagtggaaggtgtacgggggtctaggccccagcacaggaatcattccacccacattctgtccactctcctgggcctcagtttcccttcccggagtccagccccccacagggcatccctgcccagagagggccagtgaccaagaaacacacaggaagaagagctgtccactcaggagccaccaggcgtgggggctaaggtccagggctggggccagcagtgacccctcacccccactcaaggccacctcggcttcctcttttgttgtttttgaagtgagaactcaacaagctcccaaaacaggaacctccctgatgctggcggcctccaccacagccatgccatgacctccaccagcctgtgcctcctgcccctctcccgggtaggcccagggctgttgggacccccactctctgcccagccctcccaccaggagccagcacacttgcctccccatctctgtccctggcctgcccacgggggccgttccagaccctcaacgctcccccaggggaggcagagcttggcactaaccagcccagggcccgcgggtctcacactgaagccacctagacgcagcctggggttgaccctcacctgacagcctgggaaaaactgaggcccaggaggcacaggcagccctggcctggagcccaaaggttcccacaggctgaggggagagtctgcgggctccctccctcagggtcctgctgggcccctcatcctggcggggtaatgagcagcctccatctgcacacaaacaattagccctgcggggccctccgcagcagctgctctctggagtgggctcagagtcccccacagacctcttctcaagggtgtttactcagcaaagccaaggcctcctccaggatgaaggggagtggcctgtaccctctgaggtcccccacctcacgcagggaccccaggaccagctggatggctgagcagcagctggggatgcagtgaggttctatgtcgctcaccaaagcgaagtaacacactggggtaggaaccactctctccctgcctcagtgcccccccgcagggacagccagtgccaggacttcaaggcggggagagggggtgggaaggaggcccagcctaggcacctgcttggggtcagagaccagcctccatactccccaccgggacgcctggggctaactcagcaggagtggtgagggggctgccctgaggcctggactggggggtctatgccaggcatgggcccggggtagggcatggcaaggactcagatgtccggagactggaccctccgtgagccgcatggacacacggtcccgtgtcacccgggcccggccaggcacccagatccgtggcttggacacgctgcccacacactcaggagcgtctgccgcgtaacccacgcgccccaggcagcttccctcgacccccgcccactcggccttggcctgctgggtcacagcctgccgaaggcagccaggcctgcagctcttccccggcccctctcggacagcgaccagcctgagggagtccaggtggtgcccctgcggccggcacccactcctggcctaggcccagccctttctcgagagcccagagcacctcatcctgggtcccagcatcccggccacccgcctcggccctctcctgacccacttggtccagccatgtggacggggggacgctcaggaagacagccgcgagtggacaaaaacaggctccaggccggggctgcaccagggcagctctccacggggctaggctgcagccaggctggtgcacggccccaggagtactggggcaagcgggcaaggtgagcaagctgtttggggaaagtacctcaaaagagccacacagcctctggccaaagcctggcacggagctatcaaaggaaggaaaactgcaggctggaggccgagttcagccagacctgcgccctggcccaggattgattttttaaaattgtcagccttcaaaaatcaggagacttcacacaacagaacaaatctttgaaaatgcaaacgtctgagcaacactgagcccaccagaccaccaatggccagagctgagctgggctgcttatccagtgagacagccgaaacaggaggggacatctggccccctgtccctataggccccaccagcctcctcactagctcctgcccttaacagcctaagctcaccctccaggaaccatctccctgttagatgtgcagacccagaggcctcgcctgggtccagccacaggtccacacaggcctgcagccggaactcctgtgtccccatgcccggtcccttctgtccctgaagctcctctgactcagagcacacacatcagaacaacagaaagcagcctgggccacttcccagagatgacgctcacctcccaaggagcaggagaaggagcctgcagacactgccaccccacccctcacacacagggcatacccgtcccctctcatctcaatgaccacatcacccctgaaggcaccatcacgccacgtgtggccagcccaagtagccgtggtgggactgtcacctggggattcagctgagaaccaaagtgccccaggccacggtcgtggggagtcccggcaaaggggacaggtgcgggccagcctctgagacaagcaccctgacctgcaggagcaaggctgggggggagtggaacagggcgtctgcaaggggctgcggccgggcctggaggacagtcactgcgtccctccctccctccccacccccagccaggcctgagcactgtgaagcacgggtggggtcagcccagcacagccctgctagggacaggaaggcagctagtacctctaaccagtgttgcgggtggggctggccctgccaggagggtggcacagcacatctgcaagacacacaggggaccccagggacgggagtggcgaaatgcggcaggccccggaggacaggctttcctccgcaaggagcggccggccatgcgggtggacgccacctgctctcggcaacaagaggggctatgcctgccaagggcatatgtcatatccacgccacctcccatcctcagcgcccactacactggggatggaggaggaagagccgggggtagaggtacaggaccctctctcctggcctgaggctaggggccagatgacagagcccagaggctgctgaggctggccggaccccaactcagggccgcccacaagccattctccactccaccaggtctctctcccaccaccgctccctggtgtagatggggaaactgaggcccaaggagctcaatgaccttgctcttggaaagggtcatggcgatagagtggctaaccagggttcaaactcagctctctggacgccccactgggcctgatgtcctgtccctgccaggcccctcctgaaggcacgacatcagcagcagcctgaaaatcacctggcctcgggggagcactcctgcctaggcccagctggctgatgggtgccccagtaactggggcctgggcccctgggcagtcaaggccctggcatctcctgggtcagcccgagatccaacagtctatcaacaaacacacatttgccaaggataaagaagcagcggccccaggcagcagactatgtgacacagagaggaacagggccagggtcggggcagggggtccctgacaccaaagagggctgtgaggtgaggagaggacctccaggcacaggtggcaggactcctggggaacaagcaggggacagcacacggggaggggatggagaaggcaggatgcggcaggaggccttggggggaagcagagccagaagctccccaaggaccacaggcgtctgcagcctccttgtcttcatctcgaggccccgcgtgccatcactggtagctgcccactcaaacactccaaacacacagccagccacacccctgattcccccagcatctcatctcggtcactccttcaccccacccccaggctcctgtggctccttaggcctgctcttctgtgagctcctatacatcccacaatgccccatcttgtgacacctacttttgccacacctccctgtctgctccagctgtgtttggggtctccccactaccagatgtgaaacccatctgctagagggtgtacgtaaagccggggggctgctggcatgagatcactagaacttaggagggaacaagtctggaaaaagaagtcaggagagggcggaccgattccgcctggggcagaagagagtgacttggccagaggacctggacctgaacaggaagcccaccctagcaggacagaggagcaaaacagccacccagactccaccgcaccccgctgagcaacggagggtgggtgaggcagaagggcctgcacagggttggaaggggtggggctatgtccccagctcccatcccacccagctgctggccaggcccctcgggcagcacctcctccataggctgcaaggccaaatgagtgaggagggggacacaggggctgggggacttggctcagccagctctgcagctccaaggcaaacatgccctgtgcccaggcggtacggattccccccacccccaaagctcaggcctgaagcaggcaccaggccaagccaagcagccctgccctgccctcaggagcccttgggcagtgccctgggccgccagcgtgccagaccctggaacagcccagtgtcctcgctgccttccaggaaagccaggagagaggctggcagcagctcccccgcctgccagggcccacaccaggaagccactcagatggccggccctgcacagggcctcatcctcctggcctccccgaggccgtgccctccatgccatgggaagacatggggcccaggacactcaccctaggccagcccaggagccccaggggaggcagcccctcccacccagcagggcacaggcactcacagaccctggggctactacccccatctctccctccccaggcccagccctggcagcgggtactaacctcgtttgtgcagccaaccctccttcacaatagccacgtcgctcatggtgcccgaggctcccgcgacgctcacgcgctcctctcaggctggcgctccccgagcccagctggcctggccacagcctctgggagaagcaaaggaagctgaatgtgaggccacgcctggctaagggcagctcctcgccctgggtgagccagagacccactgcacgtgcctgggggctccacccgcacctgccttcccaggtgggctgccatccctctaagctctctgacccccatctgcccgcctgccttccctctccccaaaacactcagggctgccaagtgtcaaatccatgtaattgaacacagttccctggacctgggcctctccttattctaggcttagagcctccagcccctgccaccaccacccgcaacagccaggccctgagagctgctgccttgctcacctccccattcccacctcccccagccgttggacaaatcacccccatccccaaaaggccttcccagcctccctaacctgatgcaccagctgacaggctgcctcctccaggcagcccctttgacttctttgacccaggctggctcggccttccctaagcccctggtgacagatggccccgtttgctctccctgtccatggtgttcctacccatggatcctgggacagggcacagggctcctccctgctccccagactaggaaagcaaagaaattcaaacatgaggaagacaggaccaggatgcaggccactggcgcaaacgggagtccagagccctccagcgcaagcccaaaaacctcctgggagaaaccccaggcccctcctaaaccacagcgcccctgccggtctgaatctggttcattcatttggccaacatgtaccgggcgtctcaggttttgccaggcccagtgctgggcgctggagacaaagagaggttcagacaagtccgtcagtgaggagcacccagtccagggtggttacagacccataattacagcagtcgggaggcagcaagtaagtgggggagcactggacaggcccccgccctgcagcggcccaccagccaaccctcacctgagcacactttatccattgatcctgcatggcttcctcatttcccctctgatggatgaactcctaggcatccctcaaaacccagttcccacatcaccaactacaggcatccccagaaagagcacttcgcatgctcttcctgtgagcagtcctctgctacccttccagatgggccttcctgaggggaggagggtcctctctgggacctccaggccaggcagagacccctgacgacctctgtggaatggatcccaacatgggtctttccacagccagcttagacgctctccccccaggccacctttctggcctcccgaggcaagggctggacacccacaaagggttgctttgcactgattgtcttaagctacacttagaatggcaggaaggcccactgccttgtgtctaatgccaggacagggaagaccacaccttacccaaagagggaaatgccccaagtacttagcaggatggaaagcaggccagactcgaggaaggcaccgcaggactccgagggcagggctccgagccgcgcacgcctcaggcacagggggctctgacgacactgagtgggcgtggcctggaggcagagggctggactcaaagacctctggatgtccccccacccccacacgggcctgagcccctccaaggcctgctgctgacagagtcagacagctgtccagagccatgtgtaaaaatacatctgtgctcacacagggtggtgtacgtctgcacagaaacgtatacaccaggccagcacagggctgcctgtgggggcggagggaccccgacttcccacagcctccgtacctgccgcctgcctttaccataagcacatattcttgctactattattaagtcacaacttaaaaaaaaatactctgttttcgaaagggctcctccatctgcctccagaaccctggtgtatgagaagtctacacagctcccgggagaggcaaccggacccccaccaacggactccgtccgcccttcgctcggatgagggactcaaagcagtcaagaagtggccacctggagcaaggccgagagacccaggagtgaatgtggggcggcctctggctgcagagcaggggcccaagctcacccgctgaccaaggcagcactcagaggccgtcccgacaggaccaagctcgctagcgccccaggatactcaatctaaggggcaagccccagctgccctccaagccttggcctctgggatgggcgggcaggacctccagggcccacccaagacaggaagcagttccggggcccaggagggtcacagtcctttgtggctagcctgggtaccccgccaccacgtacaacttttcgtccgtgggaaacgaagtctccttccggggccctcccacaaacttgaaggccggccgcggcgagtctttctccaaccccggggcacctccgccggctgcctcgctggcccagcgcccggggagccccacggcccgcaggggcaccccgagccccagctccaggcccggcggcgtcccttctctcgggtcccggcctcgcccggcggagcggcctccccaaggtcatgagggaggctggggccggcagcctgcacccccggcgcccggcgtggggccgccctcccttggccgggcccgcgcgccccgcgccctccccgcccaggcccgctcggccacttcctgctcccgctcctccattctggcggcgccgcggctcgcgccccggcccgaccggccgcgaacaaagcggcccggcccgcggggaggaaatccaggcccgggcggccacggcgggcggggactcaccgggccgccgcgtccgggcgcgagcgcgggcctagccgggccgcggcctccggcgcccgccgctccgcatccccgcgggccggcgctgggcggggccgggctggaggccgcggcgggcgggggcgctgctcggggccgggcctcgcgtgccgccgccgctcggtgcccggtgcccagcgctcggtgctcggccgcctgctcccgtcttcgggccgcgctgcgtgcgctgggccagccgcctgccgcgctcggtcctgccgccgccgccggcccgccctctccccgccccgcgcccgccccgcgcccggagccgcccgcccacatccgcctccgccgcccggggcgtccccaccgcgcggccggcggcgagggcggagcgcgctcggggagcgcgcggccgggctgaggggcagctcccgacgacctggggcctgggctgggccgctaacggagcccggccaccagccagcccgtcccggggccacgccctctctggcctcagtttccccgtctgtaaagtgacccggcgcttctgggctcgctctgccgtgaccctagcagaaggggcccgagacaggtcagggacgaatcccggacttctgcctccgcgcgcggggcgggggtggcttaggttgactttcaggctgccccactctggggggcgtggagggggcggccaagagtgacctaaaaggcccaatcccaagaccttgtgcctctgggggaagtgcgggaggatgccaggacaggaggtcagttggaggtgggcctccaaggagcaggaaggctccgaggggagtcaaccattcacctaggtactggcagctacactcacaaaagggggactttgctggggagtgggagaagaggggcacaccttgcctggctcccaccttgagctgggagcagacaccagacagaggaggagcggtgtctagggtgggctgtgacagctgacagcccagagccctccctgctgggtggacttggtcagcccggacacccagtccgaagtccactgggaggcagatggcccgggtatggaatgagtaagtgggacacagacccctttctcctggacactcacaggagagtgcaggtgactgccaccccgaccccttcctagccagaagttcctccgacaactgcccctcccccattccagaggcccacagttgataataacccttttgtgaaagacagactcttgtgagttaccttcctgaggctgctaagtattggggttgggggagcatttttattttcagccagagtgagttcagctggcagcaggggagggggtgggaggagatgcagacagaggcagcaggttcggcccagtgctcaggacagagtctgcagccaaaactcgggcttcatccctgcctcttggggctgaccaagagaaggactctctccccctgcatgagggcactcgctcctcagacaggggactccccattcctgcctctcgcctgagcacctctgctccctcccagctcagactttgtaaccccaggaagggcccacctccagggggccaagtcagaggcccagtggtctgcgccgcttgggtgggatacctgacacaagggttgcccccagagcctgggcgtctggtgtctgtctctcacccagcaaacctgcaccatgagccacctggggctccctctgggactgtcccacctgcccactgctccccgaggaagagttcctggtatctgtccaccatcctgggctctgccatgcaaggatggaggaaggaattcagggaggaagcagagggtaagagggccatgagacaaggccagcaagtggccgaggcttggggatgtgggagggagcagggcaccctctcatggaagaggcagtgacattgcgggctgttcttgaagtggttggacctcttgcttattttgcactggctgtctccaaggaggcctcccagtcttcccagcctggtgccctggcatctgctggtgcctgcaacccactgtgggccccacactccagtcctgtcttcaccttggcatgaactgccctcccccaagacggggatctcccagtgggcagggccatctccctctcctccagcgtcccagagggaaagcagagtcctctcttcaagaacaccccctcccaccccagacagaatggtcaggagagaacccagccccacggctgctgctgggactgctgaggtgctctgtggccagatgtttccgacaaaaactgctgcaccagggaagggcccgacggctgcctcctcccagagctcaggggcctcctgccctgtcaccttctgcagctgctggccgggggcaggactcgagggccctgggctgtgtaggtcccagcagcagctgcagggcggggcctcagggcagctcccaggccagatggccgcctgagtctgcagaggttctgcctgaaccaccaccgccgcgacagtggctgtgtgacggtgtcctgtcattcctgcacttgagacccagccagtcacaggggctctgaggactacaggctggccaggatcccagcaccaactctgggcggtctctgcctggaacagccccccttccctgatcggtgtggggcaggagggacttgaacccagacatcccgacctgagagggataaggagcttctctcccactgtcccctccccttcatctagcccattcctagctgggccctccttccaggtcctaccctaggctcctgaaggcagcatcctgaccctccctgtgtaccacaacccccattaagtgtccaggctctctctgtcccgccagccaggcagggcaggctagggtgcttgctcccagcctgcagtggggagctgtcagcctgttgcccagagccccagtgtggcaggccacccctacttgctctgaaggttcaggggctgggggtgtgggcaggcagggctggaatgttgccacagaggagtcaggattagggatggtgggaccatcgtaatcactcacagaagcaaccgtcacacattcactcaacaaacatttactgaacacccacttgcgtcctgccaacttttaagcaccaagtgaccaaacagccccttccctttcagaaggtgctggaatatcccacaatcacaggacacccggaatgggctggaaaggagggtatgcagcagaagggactgcgagggaacttagcgaaggtgggcaggaatggccaccctgactaaggagtggactttcagcagagacagggatgaagagaaaccagtgaagggttctttggggaagaacattccagagcctgagagcttgctgagtgccaggccctgtcgttaatgttcacgaagaccccgggatgcactctgactcccattttgcagatgaggattactgaggttcaaagaggttaaaggtttggtcgtgctcaaggttgggaggggccggggcagggctgtgatccaggcagggcaggaagggagcagtcacatctgagttcacccttaacttacttgaattcagctattcctgctggtggctggggcaaggcagatgattatttaaatgcgtggagagaggggagttgaccttcctcaggaaggggtccttagggtggatggccggcggcagtgggagccaggcctctgccgtccctaagctagtctcagtggctgtaagtgcagtgtcattccaggggtccaagctgcagttgccaggtttaggaaataaagatgcagtccatccggtgaaacaaggaatgatattttagtataacaacgaggccttccttcccagacttcagatcccactgtgggctccactcctcctgcacacacatacctggccgggtcctgtcctttgtgatccagcccctcttccagcaccacccccaccccactgcttggccttgactggggtgactcctccactacattctccatttcccggactccaaggcagagaagaatgagaccggctgaattcaaatcgtggttcagtgacttactgcctgatacatggctctgggtaccttacctaaactctctcaccaaaaaggtatgaaaataagagcgtctagttaatgggactgttgtgaagatgatccggtggtctagagtaccttcaaacctgctcagtcaagggcagcccaggttgtgcccctgggaaaaggctccatctgcctgggagggaccctaaccccgccaaacacactctctacttctctggcgattccctctcccacaaccaggcgtccccctcacatcttctcaatgcttctttgccctagaacactttcccccactcctccctacccccactcccatgccagcccctgtccggagtctcctcctctttgaacacgttcctgcctaccctgggctctggagggcttccgactgtctctgttatggcgtttgtccccccgtgccaccatgtctgctgggaggtgcccgttttccgtgcctctctgcgctgggtcccccatagacgctgggctggggtctgtggagagggtggaagtccccgttctggactctaggatcgacatcctgcttgaatgtttggaagagggtcccagctgaattaaattcaaaaagaggctttcaaggaagaaggaggtgtcatctttgcaaaattaacgacccccaatccacgcaacccctacgccatcccaaggccggcgccctgcgaggtggcgggaggccagggtcccgggtttaccctcgggtgactgcccaacgcgggctgggatacaagcggaccctcggaagggttccttttgcagactggcgcagtaaggaccccatgccgggaaaggttgggaggtgggggacccaggccaaagcgccaagtatcgcgagagaccccctgcccccgcgcagtgccctaaacccccctcacaccccagcgcccctgctggctgcgcgcggggcccggccgggtggggcggacagggaagggggggcgagggtgacctcagcggttccgccgctccgggaagtcgctcggcccgccccctccggcccccgccccgagtttcgctctctctggggcggggcgagcggcgggcggcgctgggccagccaagttggagcgcgccccgcccggcgccctcgccgtccccgcgccctccccgccggggcgcgctgcccgcagctccacgcgcgccagggccgccctggggagggcgcgcgcgcgagcggcgaccggagaggagctcggggcggcggaggtgagcgctgggggtgggctcccggctctgcccgccccgcccgcccgccggccctctccccgctccccgcggccgcgctgccataaatggggccggcggcggcggcatctggtgggccgggcggcagctggaggcggcgcggaggcgtggggcgggtggcggcgcagccacccgggcgtcggggacgccgcgagcgggcggccgcccgggagtgaagttcaggagcgcccgggcggggacgcgcgcaggtttgcgcggctccggctcctgcgcctgagtcccgggacccgcccccgcggcggagctgctactgtttactttcgatcgagtttttcctgctcggggcaggtgcccgcggcggctctggacgggaggttgcgcgcgtcactcccgcgccgctctttccgcgctgcctgcagccgggaagggcgcttcgtgggcgcctccaggcgcgctgacgggcgtcccgtttgtgcccaggtgatgacggcggcggcatggagttccctgagcacggcggacggctgctgggccgcctgagacagcagcgcgagctgggcttcctatgcgactgcaccgtgctggtgggcgacgcgcgcttcccggcccaccgtgccgtgctggccgcgtgcagcgtctacttccatctcttctacagggaccggcccgcgggcagtcgcgacacggtgcggctcaacggcgacatcgtcacggcgcccgccttcggccgcctactggacttcatgtacgagggccgcctggacctgcgcagcctgcctgtggaggacgtcctggcagccgccagctacctgcacatgtatgacatcgtcaaggtctgcaagggcaggctccaggagaaggatcgaagtctggacccggggaaccctgcccctggggcagaacctgctcagccaccgtgcccctggcctgtctggaccgcggacctctgcccagctgcccgaaaggccaagctccccccgtttggggtcaaggctgccctccctcctcgagcatctgggcctcctccctgccaggtcccagaagagtcagaccaggccctggacctgtcgttgaagtctggcccaaggcaggagcgggtccacccaccgtgcgtcctccagacacccctctgcagccagaggcagccaggggcccagccactggtgaaggacgaacgggactcactgtccgaacaggaggagagcagcagctctaggagcccccacagtcccccgaagccacctcctgttcctgcagccaagggcctggtggtgggcttgcagccgctgcccctcagcggagagggcagccgggagctggagcttggtgcagggcgactggcgagtgaggacgagctggggcctggtgggcccctctgcatctgcccgttgtgcagcaagctgtttcccagctcccacgtgctgcagctgcacctcagtgcccacttccgtgagcgagacagcacccgggcccggctctcacccgacggcgtggcacccacctgcccgctctgtgggaagaccttctcgtgcacatacacactgaagaggcacgagcggacacactcgggtgagaagccctatacgtgtgtgcagtgtggcaaaagttttcagtactcccacaacctgagccggcacaccgtagtgcacactcgagagaagccgcatgcctgccggtggtgtgagcgccgtttcacgcagtccggggacctctaccgccacgtccgcaagtttcactgtggcctcgtcaagtcccttctggtgtgatgcatccctgtgggtcctgagggtggggtggaagggaagggatgggccctcccaggtgggacacagcatggggtgtgaagcctgaccaggtggaggtccctgcttgggccagatggctccaccctcctggcagagagaatgctgcctcttcctggaacttggcctcagactcggtaacttgggcagccttcctcccaccttgcctctcctttcccctcactctccaactcattccggcccccaggctgtgccctgcctaggctgtgacactatcttcctctcccgtcccctccagccaagttctgaggggtgtccaaccagcacctggctctgcccccgtttctccgtgtgagatggcacatccatctcccggcccgggactttcctgaccacctctctggcaggcttggggaggtcttcatgagcctggccccacgctaggtgaattattcacatgtcagaaaagttgttggtgtgcgtcccaatggggcgctgggagggaacaggacactcctggggagcggcagcaggaacccctgccaggaaggcctggggcacagtgagtgccagcaggggccatctgggcacagctggtgtctcggggtgggggggggggtgcagccccagcagggatcctaaggcagcaggagtagagccagctagaagctgagtggctgtggcatcattgtcactcgggtgggacgtgggtccatgagagcgtgcaattatgaccacactgtaactttgagcagagaaagtgggaatttggaactggattctctttagagccaggaagagcctcctgaggcggccagatgtctgctggtggccgcccagccacatgcttgtctgcctgagtgcaggtctaggaagcctctgggcatcccccagggtggggtctgggccgctgagctgtgtgctgctgctgggccaccgtgggccttaccttgacggtcactctgcctgctagggggtttccctggagctgtgggcatttccgtgcactgactgagcagaggcaagggctgccctgtccgccaggggcagggtttgcgggccttcctttccccacggcgaggcatgggtgaaagtggccatggcggcagggttaggggcaggtgaggagtgggagtcgcagcaccctaggggcctccatccgcagccttgggagactgacgctcctcgaacatgaatagaatgtggagaccacaacccccacacatgtcgttggttcaggtcgccctgctttgcctgcctaatggagcacatcttgctgccagaacctcactggcctctgggggtcggcaggtgcagagccacctggacgcctggagaccacctgggatgtttcctctgtgactgggaatggccttgacaacagagtccagccaagtctacgttattttctcatctcctgacaacactggatgtcatatttattagtcagcctggtctggagtgaaagaccgtccctagcgcatctcccacgcgccctgggctcctggtgtgctgggtgccagcctgggagcccagcgcttctgggtgatgccccagggctcagaggccctggatggctttggtctcgagacagctgggggaggggccctgcttctgattgtcctgggccccagcccccacctctgcaagggatcggtgtgatgtgctccataatcgggtggggggtgtgtgtgtgtgtgtgtgtgtgtgtatgtatgcatgcgtctggcacatggcaaggcccaagccaacccggcaccccgtagatgggcagctacactgccacccaagcacggagatgtggccgcggcactgggtcccccagtgggtcccatgggggaagaacttccctttgctggggtgggcagcctgccctgagctatcaacactggatttgttgtcttctgcacagctactgtgaagataacgtaaggagaagtggtcagttttcattttataactgacacagttgggacaaaatatatacgtgtacatatatttaagacactaattgtgtgggagagtttagtagaggcctgtgcagacacaaggcaaacagcgtcagcagcgtgggggtctcctgggccagctcggcacctgtgggtgctctgaccctgggggtggggacagctccgtgctaaccccagcagacagttgttggtgcacagtgtctaggaggcgtgggaatgggtgctgtcttcctcttttcacatcatggcgacagtaataaagcccacctccagtggaaacggcagtgactattcctgaggacgggtgggaacaggtgtcccagatgccaccacgtgctcatgctggtggatgggggaggctgggacagggctgaggtggcaccccctctttccccaggtttgtccccaactgccagcgtttgggggaggggagtccagggaggcagatctgtcagggaggcggagcacacaggccagcttgggcagggcagtccacgggggtttcttgccctggggaaggaggctggaccctggaggaaacctgtgaacctggggatgccatggccctccccactaccctacgcccttggcctcttgttggtgggagaaggcacagaaatttctagagccctgtgcaggctgggctgggctctgggttgatgaggctggggtgggcaattccacgcctcctcctctgccctgctccctccagaggccttgcagggggtcattagccctgagccctccctggcgggagcacggccttcctttccagaccaaatggggcagggcctctacatgtgctgtaagcgtcaacacagtgccctcttgacttgcgaagagccagggtaagccccaggcccaggacagggtggggatggtgctggccagacagtcctcaaagtcaggctgagctggtgtgcaagggcctgcccctcttgggtcagctcctgccgccttcccagtcctgaccccaaatgcaggtccttccttctgggaggtggtgctggctcctcccctaccccctcccacacccaccgtgcctcctgctgagtttggaccagtgccctgtcctgcagggaggccctctcatgttcccagttgggcccatgactcagcccaggccttctcaacccagaggaggaggctgttgctatgctaaccatgcaggaaaggaggatggtctgctgtcccctagggcgcatggggcttcctggggcccctccagcctgcccagctctgccacactgtgctcacactcagctgactgctagagctgtcgtggaagctttcagtcccactcctggccagggtgggcctcctggcaccctccttggaggccatccagccggcttccttggctggatggtaaactgaggcacatggaagggaccagtacttgtccatggtcccagagccagttggtggcaaatccaggacttccttccacaaactccaggaaacctcaagctgtttacccacagtgctgggcacagggcaccaatgctgtcagaggcacggtggcaggttggggcagcaaggacgaggccagagggaaggagagggtcagactctgcggaggaggtatccctggaggctccccaggaagggtgacctctcaggagcctgcgagtggacaacacagacacaggcaccaggcaggggctggccccccacagaggcccgatcatgtcagcccaggtgcgtggacgccaccctggggaggctgccttgcaagtgggaagcaggtgagtcggcagccttggcccttcccttctgccacctccccagctcctgcccactcccacacacacctggtcttacctttcccagtgttcctgaatggtgctgagtccttcccggtgtgggaggctccactccacagacacccctggagagccggtaacaaacaaacccggtgcagacatggctccaatcctggctgtcccagctctcaggggtgaactccaagcccacagaggctctgccctggttttctatgacttctttcatccccacctcagtcccatcttcaatgaacacatcccacgctgtcatcatggtcatcatcaccatcaccgccccctccatggaaccacaactgtcacctccaccattacctttacctccgccatcagtatcatctccaccaccatcacctccactatcacatcacctccaccaccatcacctccacccccaccatcacctccacctctaccaccatcacctccaccatcatctccacctccaccatcatcacctccacctccagcaccattgcttccacttccatcaccattacctccaccatcatcaccttcatctctacctccatcttcaccatcaccatcacctccaccttcaccaccaccaccacctttatggaagatccctaaagaaactgagccaactctaggtcggcttccaggctgaggaagtagggcttgattatgttcaagctgagaagtggttggagaaaggggtaatatctgccctcctcactcagtggagcttcagtatctgcacttcccttttctgtagccttcaagttccaggatttttatttttattttttgagacatggtcttgtgtcgcccaggctggtcttgaactcctggactcaagtgaccctccccactcagcctcctgagtagctaggattctaggcatgagccatggaacctgctagttccagggtattttctgtttccctgcacctcctccctctcgccactacccttccatatacagaagaagaaaagtctgcatctctgtgaaagtaggtctgtacctctctgcacgcacacccactggcacctctgaacacacagcacagaaggaaggccgcccctgcaagtcccaggaattcggaattccatggcacacagggccaccggtgcctgtcccgtcagccacctgtcctgtgctcataaccatgtcactccctttcttcagcctcagcattctcgcctgtgaaatgggaatggcagacaaccgttgatgggtgaatagggtaacatccacactaagtgttggcagtgttgctgctgacaaatgtaacacctgcctgcctccctctggggccattgccaggtcagaagggaaccaagggtgaggagcctttgacaacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacacagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacagagcacccccagactccccaggataacaaggccgtacacagcacccccagactccccaggataacaaggccgtacacagcacccccagactccccaggataacaaggccgtacagagcacccccagcctccctggggcgccaggtgtgcttgggcattgctggtctgtggacctttgcaatccggccctggcctggctctgttcccctgctctgggcagcctcttgctcccctccccctcccactttccctcaacaccccttcacctccagctgttgtggaggatggtggggtacaccacagcagtgaggagtccagggacagcagcctggagggctaggccactcccaacacgggctggcagcagcagaagatgctgcctctggagcctgtgccagagcctgtggctgaggcggagagggtggccgttcagaaaggtcccaggccacggaggactgtcccctgccaggcaggaatgattgagcaccaaggctgctgctggcccagctatagccctggtatcggaggtggcagtggatctgggggagagccagggactcacctccctctgtggaaccctcctggttttgttttcactaattttagcagaagtctgagtctgaagtcaagacatccctttctttctttctttttttttttttttttttttgagacggagtctcattctgttacccaggctggagtgcagtggcgccatctcggctcactgcaagctccacctcccaggttcacgccattctcctgcctcagcctcccgagtagctgggactacaggtgcctgccaccacagctggctaattttctgtatttttagtagggatggagtttcactgtgttaaccaggatggtctcaatctcctgacctcgtgatctgccctcctcggcctcccaaagtgctgggattacaggcgtgagccaccgcgcccagcccaagacatccctttctttgctttctgaagcagacgctggggtatgttttttgtttctttattggctgtagtagttggctctggctgtcataataaggtaccacagacagagacagggtggcttgaacaacagacacttattgtctcacaggtttcaaggtatctgcagcgttgcttcttcctgagtcctatctcctcagcttgtaaagggcggtcttctctctgcagcctcacgtggtcttccctgtgtgtgtgtcctaatctcctcttcttcttcttttttttttttttttttgagacggagtttcgctcttgttgtccaggctggagtgcaatggtgcgatcttggctcatcgcaacctccatctcccaggttcgagcgattctcctgcctcagcctcccaagtagctgagattacggcacccactaccatgcccagctaattttgtattttcagtagagacggggtttcaccatgttggtcaggctggtctcgaacttccggcctcaggtgatccacccgcctcggcctcccagagtgttgggatgacaggcgtgagccacggtgcctggccctaatctcctcttcttataaggacacaagtcctatgggattaaggcctaccctaatgacctcattttaccttcatcacctctttaaaggctctatctccaaatacaggcacattctgagggactggtagttaggacctcaatgtacgaatttggctggggacaaaattcagtccagaaccctgaatgtttcagaagaacatggaggcccaaggacgctgggctggagccagaggcccagatcccatcctggctctgccagttctgggcaagccactgcagttttctcatcagtaaaatttgttgatgtttccatttttgtcccacaatattccaggtacacccacggacacttgggtacagtcagggggtacagcctcacccacaaagaaaacccaggtaactccattgcctaggccctcccagtagcgcccttccctggctgtcaccccacccctgcatccccagagcagaccggggtgtgggacagtccaggtcccctttgtgcttgttctcctggacactcagctgcccccgctgctgtcccatgcactgctcccctgcagaagtccgcctgcaccaccaacaggtcgggaaggaaggtgggggcatccctgaccccttcccgcttacccaggcccagctctccagaggctcacaccctcctcctctctgcggggctctcgacccacccctgtctcccccatattttctcaaggctgcagctttgggcaccccatctccttcatctcccatcccacgcgagccccccactcctgggtctgtggcctttcccaggtcatctccagaggccgcggctcccctggaatgtgagcttcaggcatcctcactcatgacacaagctgctattttcctgtttacctaatcaagcaggtaatttctctatacagtaattccttcatttcgtggttttccaattcttgaccttgccaccttcacgagtctgtctcctgccctctcctgcctgcctctcgactcagtgccttggccgtcgttagattgaccccaagcccctgcctcgagccctcccctccttttctatcaaactacttcccaagacccaacctggatgaacccacacattcccttcactgcacaggtcacagaaaaggaagggcaagcatctccacaccatctataataaatataatttaaacaagtaaactcgccccacagggagcaatggtggagcagcctgggtggactgatcccccatggataacaaagatagattctgaacaaaaatagacatgttaaaaaaactcctggaaggcactggagagcgggtggagacaggcggaagctggagaggaggcttcccttgaaaacaaactgcggcgggtgaggtctctgtttgtggcagcagatctgatagactttgcacaaaggaagttacacaaatggctaataaacacctgaaaaagtgctcaacatcatcagtcacagggaaatgcgactcaaaacccaccgaggggctgggcgtggtggctcacacctgtaatcccgcacttcaggaggccgaggtggacagaccacctgtgatcaggagtttgagaccagcccgaccaacaccgtctctactaaaaatacaaaaattagtcgggcgtggtggcgtgcacctgtaatcccagctactcgggaggctgaggcagaagaatcgcttgaacctgggaggtggaggttgcagtgagctgggatcatgccacagcactccagcctgaatgacagagcgagacagtgtcttgaaaacaacaaaaacacaaaacaaaacacaccaaggccaatcatggtggctcatgcctataatcccaacactttgggaggcccaggtgggaggactgcttgagcccaggagttcaagaccagcctggccaacatagtgagaccctgtctccacaaaaagtaaaaaattagctgggtgtggtggtgcataccgatggtcccagctactcgggaggctgaagtgggaagactgcttgagcctgggggatcaaggatacagcgagccatgattgtgccactgcactccagcctgggtaacagagagagaccttgtcacaaaacaaaagacaaacaaaaaagtcccacaacaagataccactacacgccagctctgaagactgacaacaccaagcactgttaacgtgttaacacgcacctgccacttgacctgaagattctacccccaggtgtcatccagaaaagaagtgaaaggtgtaaccacaaaggatgtgtcctctgatgctcataggagctttctccaacccctgtgcccacccacaggagaacagatagaccaactgcagaatattcgcacaacaggatcttatgcgtggatgaaagagaggagctggcggtgcacccgatgttgatgaagctccctgagctgatggagagaagcctgctgcaagattgcccactggtgagtcctcgcagaggcagaactcatccacggcagaaaaagaggggaccagcagctgcctcagggcaagatcatgagcagggactgggagggagggacacaaaggaacttctagggtgatggatacgcttagatttttattgggggggggggtgcggctacacaggtgcagccattttcagaatttacagttaagattcatgcattttggccaggcgtggccatgcctgtaatcccagcactttgggaggccgaggtgagcagatcacctgaggtcaggggtttgagatcaggctggccaaaatggcgaaaccccgcctctactgaaaatacaaaaattagctgggcatgtgcctataatcccacctactcgggaggttgaggcaggagaatcgcctgaacctgggaggtggaggttgcagtgagccgagatcgtgccgctgcactccagcctgggtgacacagtgacgctccatctcaaaaaaaaagaaaaaagaggccgggcacagtggctcacacctgtaactccagcactttgagaggccgaggcgggaggatcacgaggtcaggagtacaagaccagcctgaccaagaaggtgaaactccatctctactaaaaatacaaaaattagtaggctggacgcggtggttcatgcctgtaatccccgcactttgagaggctgaagtgggcgcatcacgaggtcaggagatcgagaccatcctggttaacatggtgaaaccccgtctctactaaaaatacaaaaaaattagccaggcgtggtggtgggcgcctgtagtcccagctacttaggaggctgaggcaggagaatggcgtgaacccgggaggtggagcttgcagtgagctgagatcgcgccactgcactccagcctgggcgacagagcgagactccgtctcaaaaaaaaaaaaaaaaaaaaaaaaaaaacaaacaacaaaaaactttccttaataaaatgttcataagaaaaaatatagataccattcggtatcagactggcaaagataaacactttgtgtcttagttcatggtgctgttacaaaataccagactgggtggcttaaacaacagaaatgtgtctcccagttcggaaggatggcatgtccaagataggggtgccagcagctttggtgtctggtggggacagccctcttgttgtgccctcacattgcaaagagagcaagctccagtctcctccttttcccgtaagaacatcagtgcctccaccctcatgacctcacctgaacccaacgacctcccaaaggtcccgtctccaaatatcatcgcattggatagtaagatttcctgtgaattttggggggacgtgaacatgcagtccataactttgaaacatacattactgggggagctatgggacaacagcaccctctactacattactggtaaggtataaatgggcacacacctaattcagatggcaatttgatcactgctgtccacattataattacataagtgttttgacccagcagttctggaaattctatcccataaacttgcacataagcaatacgatctcggtataagggtatttgttggagtattgttcagtacagcaaagcactggaaaaggctcaatgtccatgggcagggggccagctaataaatcatggtccatccattgagcagaatactatagtcacaaaaacgaaggcactcttttgcagcctttgggaggtcattaggtttagacggggtcctgagtataaaagagtgtgaagaatagggagtaggattgtaccctgtcctcccgtggtgtaaagagaagggaaactggatgcacatgagcacagtatgcgttttcacatgtacgaaatacttctggacagatcaaaagaggtttggttgcctgtggggagggaactcggtggctggaaaacgagagagggtaacttttaaacttttgaaccatgttaccaatcactaattatcaattcaatggattagcttaaaataaaattcaaaattgcttccttgatcccttacctccttccacttttctgccctttccggtcagcgttctcacatgactggccacttcagtgtactttctctttccttttttcctaagtattgttttaatctttatcctttgtcattaaaaaaatagacattgagactccctgtggcctgtgttccctgcctaccctgtacctccatccccactccatttccctgccttcaaggaaccactattagtttcttgtgtattctccagtgtttcttttcgcaactataagcaaatattttcccccattaccacccaaaaagcagcataccatgtatgttgttctgcaccttgcttttttcacttaaaaatagattgtaggccaggtgcgatggctcacacctgtaatcccagcactttgggaggccaaggcaggcagatcacctgaggtcaggagttcgagaccagactggccaacatggcaaaatcccgtctctactaaaaaatagaaaaattagccgggcatggtggcagcgcctgtagtcccagctactcgggaggcggaggcaggataatcgcttgcagctgggaggtggaggttgcagtgagccgagatcacgccgttggactccagcctgggcaacagagtgagactccgtcaaaaaaaaaaaaaaaaaaaggagattgtagacatctttccatatcatataggaacttttttttttttttcttgaggtggagtcactctgtcgcccaggctggagtgcagtggcaccgtatcggctcactgcaacctcgtttcatgggttcaggcaattctcttgcctcagcctcctgagtagctgggattacaggcgcccaacaccacaccggctaatttttatatttttagtagagacggggtttcaccatgttggccaggctggtctcgaactcctgacctcaggtgatccacccgcctcggcctcccaaagtgctggaattacaggcgtgagccaccgcgccctgccaagcaacgtcacttattacccctgctgacttgggagcaaatgtcacatataaattcccccacgtgcggaggtgtttccctttccttgctgtgtctgcattcgacagcagccacgctaagcggctggaccaaatggagcatcataacgtgttattttattttatgattttattttatgttttttgagacagagtctcgctcctcccgtccacctgccggcgctcctggggcttcgggccacggctgtctcctccgggagcggcggcgctgtaggaagcctggtcctctccctcagcggtcacagccatcgctcgcgtacgcccccggactgacgcctcccgccgggagccctcttcgaatcccgcctgcgcaactcccacgccacagccctgggccatccctgctcccgcgcagccccggccgcctgcctcctacctcgcctccccaaggccccagcgcgccggggcttccctgtcccgggcgcctgctcgtggcggcgggcgggctccttgtccggctcttaagggccggcgccggctcctgggcctcccctccttcccatcgcggcctgctcctcccacccgccttctccgagctgatgccaaggccggacggacgcgacaaaggcctgctgccgaacgtgacctgtccgcagagtagacagacgggccccctgaccgccagactgaggagacccggcgggcgggagcggatgggcgcgcctgcgcaccccctcccggcgctcgccagtcacgtggggccgcgagtggcgccgctgccggaagcgccccccaaggaaacgcaagcagtggcggagcggggttccgcctgggccgggctctagcgccggcgctgcgcgggagtcatcgcgtgccgacttccgtgttgtcgctctcccctcccaaaagcgcggccgcgaggacgggcgctgccagcgatttcctcgcctttgtgtcgcggggctgtccgctgcgcgttacttggtgcgatacgcgcattcggcggtgatcccgagccccacgcgaacctccctgtgtccttgctagtgcctggcgccgtcactgacgctgaggcgtgaacacggagtcggcccagaggggctgttctcccggacgccgaggccaccccacgcggccgcagggccgggcagaggggaactgcagggaggcgcgggccgcatccctcccggaggtctgcgagcttcttgaggcctcacgcccccttttgagccccgctgctgccctgtggcgctgcttctccatccctgcgggtgaccatcgacgcgttccccttgctcgcttcttggttacgggccaggggatactcctgcccgaccctcggcattgcccaagggagtttgcacttcccactgtgctctgccaagcctctgtggagaggagccctccacctgcctgaccgggcccagctttggggaagaccttcttggttttgtctgctggctggactgaccctggccctcagcccaggtgaggcgaccagcggcatgatgcccgggtggaacacggatttctctccagggtggccgaagaatggtttagaagcagcagtgggatgagggagaatcccgaccccgtctcaaaaggtgaagatacgtcaggtctgggggaaaaatatccctactctagagggctaagagagcttggtttggtgcaaatctgagaatccctcaacactttaatttctttaatcctgctaacagttaacaacttcctacaggctgacacctcaggaataagctccttcacctgcgttccctctgtttcctctattctttcctccaatccttaatttttttttttttagatggagtctcactcttgcccaggctggagtgcagtggcatgatcccggctcactgcaacctccacctctcgggttcaagcaattctgcatcagcctctcgagtagctgggattacaggcgcctgccaccacacccggctaatttttgtaattttagtagagacagggtttcaccatgttggccaggctggtcttgaactactaacctcaagtgattcacccacctcagcctcccaaagtgctgggatcagaggctttttttttccttttgagatggagtttcactctgttgcccaggctggagtgcagtggcgtgatctcggctcactgcaatctccgcctcctgggttccagtgattctcatgtctcagcttcccaagtacaagtagtacttcccaagtaactacaagtgccacttgtatttttagtagagatggaattctgccatgttggtcaaactggtctggaactcctggcctcaagtgatccgcccaccctggcctcccaaaggggattacaggcatgagctaccacaccagcctcctccaatcctttctaaaaagcaagtttaaccatgtcactcatttgcttaaaatctaggccaggtgtggtggctcacatgtataatcccagcactttgggaggctgaggcaggaggattgcttgagctcaggagttggagaccagccagggtgggcaacattgtgagcccccatctctaaaaaataaataaataaaaactttgttaactataggatggatggatacgtagatggataatgtatcagaagcacttttggcttcacagcagaaactccaagtgtggtgatttgaaccaatagggatttatttttctcccataacaggaatcctggaggtagatgtgactggcattacttcagcagcccagtgctgtaagggccagcaattgcagggacaggctttgcaattctgtgactttccctcatggtcacaaaaggattgccacagctccagacatcacaccatgttctggctgtaagaatggggaaatgatagttacagagatgtttatctctttattatgaaagcaaaattctcagaggctccccagtaggcttctatgtacatcgtacatggctgagcagtgccatgatctgtcagtctgtcgcctgcatgctggagaaggaagacagccatggtgtcattagtctgagtccaaggcccgagggcaggagaagatggccatcccagctcaaacagaagcaaattcttcttccacctttttgtccttttcaggccctcagattggacagtgctcacccacactggtgtgggtgggtcttctgtacgcagtttactatactaattcaagtgccaacttcttccagaaacgccctcacagacacacccagaaatcacatttaccagctatctgggcacccccttgcccagtcaagttgacataaaattaaccatccaccatgtgacaactgaggcagagctcgaagtgctgcagcttcaagctgaggaaagcaggactgtgaccccacaccagatgctgctaggagagcagcgagggaggggcctcctctcagccttcagaggaagcgcagccctgtggcaccttgccatccggcctccagagctgtgtgaatgcatttctgccatttgtagcatgcaatttgtggtcctttgttacggcagtggaaccccagcgcagcccccgaccacagtgtctgggcaagtgggagggagggggtagacaagcaaccagatcccacagttgggttttgcttagtgattccaaagagagacccaaccaagggcccaggcttctacccctgggctttcaaggaagtgacagaagctacacagcttggccaggcgcggtggctcacgcctataatcccagcactttgggaggccaaggcagatgtttgagaccagcctggccaacgtggtgaaaccccatctcagccaaacatgcaaaaatcagccgggtgtggtggcacatgcctgtgatcccagctactcaggaggctgaggcaggagaatcacttgaaccagaggcagaggttacagtgagccaagattgcacccctgtattccagcccaggtgactgagcgagagtcctataagctacacagctctggcagcctcatgtcataccctctcctgtcctacctacaagaggggagggaattcagagcacatatcctgataggcaaaatgcagtgattcccacccctgtcacccctgaagcagcgagggtgtgcatttgaaatgcttgcaggtgaggactctggcatctcaccccccagctgggagccagccaagctacattccctgcagacagtcctgctgtctccctgggagcagagcgatccttggggctgggcttattgtccccgaaggtgggctgtccagatgaacgtggagacgatgcccaccaccttgggtatttccgaatgtgggagcccatgagagcagcaggcaccaaactagtaaggaggcaggcagggtggcaggcctggggcgagaacgccctgggtggggcctgcagaaactggagctctctccttcgaactcatttagaggtgcaggcaggggtcagggagtagaccaggggccgaggtgcccggaggccagccatgtagggccgtgaggctggtgaggtttgagagtcagggaccctgaccttcacgccctttctcagggccctgggagggaccccagaaatgtacttgcagagtcatgtgacataatttacataccttaaataaatacacatatctctacatttctctccataccatctgtccatctatctacagtctgccagggctgccaaaacaaaatactacagcctgggcagcttaaacaatggatttttttctttttttgaggcaaggtcttactctgttgcccaggctggaatgcaggggtgcgatctcggctcactgcaacctctgtctcctgggttcaagtgattctcccacctcaccctccccagtagctgggactacaggtgcccaccaccatgctcggctagtttttgtatttttggtagagacccaaaatacaaaaatacaaatttttttcactatgttggccaggctggtcttgaactcctgacctcaagtgatccacctgcctcggcctcccaaagtgctgggattacaggcgtgagccaccatggccggccgacaatggaactttatttctcacagttctggcggccggaagtctgaaaaggggtgtcagcaggcttgggttctccagaggccccctccttggcttgtagacgctgccttctccctgtgtcttcacgttgtcttccctgtgtgtgtcctgatctcttatgagggtatccgtcagatgggattagggacctcacactctagtgaccttatttaaagactccatctcgaaatacagtcacattttgagggataggggttaggacttcaacatatgagttggtgggggcagggacacaatttagccaaaagtaaacaaagaaaacatatttctatattaaaatatacattgtgtgtgtgtgtgtgtgtgtgtgtgtgtgtgtgtatccttgtaccttaaagaggagcttaaagaatgtgcctgttgggccctgcaaaccttcatgtgcctctgcctggatcccagcagagcgagcaccccgtgggcgctgcggggcacgtttggctgcagaggcagcgcctgagcagggaggggtggcgagcaaggccctagccgcctcctgcctttcagtctcctgccagcagctcccactggcggcttcctgcaggaactggcgggaagggggtgatgtcccaggcagagcacagcactgggcggccgatggaggttcatggcacagcccacgtttgcactctgcgtcctgtcctcggtgactgtccttccctaagagaaagaatttctaaccccaaacggaagaaaccacagcggcacttcccacagaaatcggagctgtgttgtgagccactagtaatccctccttagaggtggcagggaagaggatcaaaggaaatggtaaattaacctgcaatacgctgcgtccgggaatagaagctcctgctgcggctggcccactcctcatccctgcaccatggaggctctcccagaggcatgtcaaaaccccagcctgacgaccaagctctgtccactgcccaccaccaacagccaccacttgagcctagatgtgtgcacgcagcggcggcgtccacccaggaggcagaccccaggaagaggcctgccgtctgggaagcaggctcaggcctgtgtgggcagcaacctagacggaaggggctaggtgctgaggggccatgtcccttgagctggaggagggcacagcaaggaactctgcagcatggacctcaggacagagctcctgggtcggggcattgccggcctgcaacgcaggagcgggtcgggggcccgcactggtgagtacagctccagcgttggtgtgctagggccactgtaaggaggtgcctccaacggggcgtgaacagcagcagcgtgtggtcccagttctggaggctccagctgtccacagggctggttgggtctgaggcagttgtggggaacctggcctctcctccactctcgtggggtttgcaggccatctttgctgttccttggctggtggaggcagcgcctcaatctctgcccgaatcttcacatggtattctccctgcgagctgtgtccaaatttcccgtctttataaggacacagtcacacaggatcaggggcccacactcccgggatgactcaccctaacttgatggatcacatctgcaaagaccctatttccaaacaaggtcacattctgaggccctgggggttaggccttcaacatatgaattcgaggggacacaattcgacccgtaacagcttctgtctccccacacatccgatgtgcttctccctctgccacgcttaggctggggtctctaccaggcacctcgacccgagtcctcactcaggccggctctgagcctcacagctctgtctgtgggagctgccctagttttccacggacctttattaggtgacatgggaatatcgagcagtgccccagaatccctgggttttgacacagtgcttcctcctcacctgaggcagcattcccaccctcctgcagggatctctccgaagagattcctctgcagagatctctggcccgcggagctcccttctccagcggtcagctcggcagtgagcggccccacatggccagagggcatctctgctcctgtgtttgggaagcagacccacgttccccagaggaccgggagccaggactgccactcctgcgaccccaccttaccagagtgggaaagaaaaatccctccatagccgattagctgtcacggccactctgtgtaaggactgcagaggcgtggcaaggccgtgactggcgtccgtccacagaagccctctcacaggcatggccacctccagttcggcattctggcggtggggaaacggcctcctaggtcggtcccaggttagaagcctgttctgccccccacaggcctgcatctcagtgttaaggggtgcagtctccccgctgcaaccattccaccagtctgttaggcctcctgcttctaggtgaagggcgtggagtgagaccagtggaactgatggacacaagcttatcgccacactggttttcctctgaaacaaggccctggattacaagtgtcatttgtggaatcccaaggcagcgaaggaggccaaggatggcatgctggcgggagaagcctgcgaggacccgtccctttgaggatccatccctgcaaggactggctctcgacaaaaggcacgccgtgtgctctgcctgcttcctggaggctggctgccctccccacagggggtggtgccacatcagggctcagacaccatcctcgctgttggaaagatgggcgcccagctgtccatgctgctggaagggtctggtgggggtgaataggctacggagcctgtgtggccaccatgcctgtggcctcagccactttgtgcaaaggactgcagaggcgtggcaaggccatgatgtgtccgtccaccgaaggcctccctggttttgagcccctcctctgcagggaatgcttccagcattttcatggattacaaatgtcttagcccctgccctttcaagcagttccttagctcccctccccagtccacagagccatctcctgcctgtgagttaggcctaatcaacgtaaatctgtcctccaggccctcccttccctccagatgaggtgcgcaaccagtggtgctgctggacgtttgaaaatacaaaaggccgggcgtggtggctcatgcctgtaatcccagaattttgtgaggccgaggcgggtggatcccaaggtcaggagttcaagaccagcctggccaagatggtaaaaccctgtgtctactaaaaatacaaaaatcagccaggcgtggtgacgggcacctgtaatcccatctactcaggaggctgaggcaggagaatcgcttgaacctgggaggtggaagtttcagtgagccgaggtggtgccagtgcactccagcctgggtgacagagcgagactcctgtctcaaaaaaaaaaaaaaaaagaaaaagaagaagaagaatacaaaaattagctgggcatgggggcacgtgcctatagtcccaactattcactgggaggttgtattagtccattttcatgctgctgataaagacgtatttgagactgggcaatttacaaaagaaagaggtttattggatttgcagttccatgtggctggggaggcctcacaatcatggcagaaggggaatggcacatctcacatggtgacagacaagagagagaaggaacttatgcagggaaattcctccttataaaaccatcagatctcatgagacttattcagaatcacgagaacagcatgggaaagacctgtccccatgattcaattacccactgggtccctcccacaacacatgggaattcaagatgagatttgggtggcgacacagccaaaccataccagaggctgaggtgggaggattgcttgaacccaggaggcaaggttgcagtgagccaagatcatgccactgcactccagcctgagtgacagagcgagacccctatctcaaacccccccccaaaaaacagatacaggtggatgattggatgggtcagggatggatgaatggttggatgggtggaaggatggatacagggtgggtggattgttggatagatggtgggataaatattcgggtggtgtatggttggatggatggtaggatggtggatggtggataattggctggatggatagtaggatggatggatgttggatggatggatgaacagtggggtggtagatgggtagataaatggttggatggacagtaggatggtgggtggttggatggatggattgatggatggatggatggatggagggttagatgaatgcatattggctggatgatagaatggtggatggatagatgggtggtaggatggtagatgtttaggtaaatggttagatgggtagtagaatggtgaatggttggatggatagattaatggatggatggtaagatggtggatggttggatgaatgtttggatggatcgtaggctggtggatggttgcatggttgggtgggtggatgtatggttggatggtgaatggttggatgaattgatggatggatggtaggataggtgaatggttggatggatagggatgattggatggatggattgatggtggactgatggatggatagatggttggtagatgataggttggatggacagttgaatggttggatggattgatggatggttggttgggtggatggatggatggttggacagatggttgaatagatggtatgatggggttaaggacagatgcataggtggtggaaagatggatgtttaaagatggttggctaggaagataattggatggatggaggatcccccagggttgctacctgagcaaactctgggaggtttggaaatcttgatcacaggggtctgtgggcctgtcctgtggatgagaagtcaagactggagaggctttgacctgggctggttttagggataggggccactgtgaggacagagatgcagaggcacagacaaggaactgggtggaggtgcactctgcaggatttctggtgtctgatggagatggttatttgtggactccagatgattctagaagtccccaagactcttctgggtgggattcatgaaggcaggtggcaggttccccagcttaaaagccaatagaaaagtaaagaatcgggccgggcacggtggctcacgcctgtaatcccagcactttgggaggccaaggcgggcagattacgaggtcaggagatagagaccgtcctggctatcacggtgaaaccccatctctactaaaaatacaaaaaaattagccaggcgtggtggtgggtgcttgtagtcccagctactcaggaggctgaggcaggagaatggcgggacccgggaggcggagcttgcagtgagccgagatggtgccactgcactccagcctgggcgacagagtcagactccgtctcttaaggaaagaaaagaatcggaatgacagataccggcagtctgaggattggcggagatggcctcgctgactgggaatatttgagcagaggcaggaaatggctggggcggagggactggcaggagcagaagcctgatgtggggcttggggcgtgctggggcgtagcgaagtggcaggagatcccggagcaccggcagggaggggagccagagggagaggaaggtgtggaggccttatggagctctcctggggtcttggatgttcactccgagtgcgatgggagctgcaggaaggtttgatccccggagagaccagatcgggcttgagctctgaccgcaacccctggcgctggttggagggcacacgggcaaggcggtggtgggagcgctgcggcagtgcaagaccacagagcagggggatatgcggggggtgggctgggagggctaggtggggcgtctgacgaggctggggaactcctgttcttaagctcaggccggggtgagcactgtccctaggagggtgtggccaatcctcgccctcaaggcactgcggcatgaatgaagcgctttaaagggagttcccaaaatgaaatccctaagcgaaaggtctggtccttctgggaagcggagcagactgcgacagctggcgttggagcggggggcggtcccaagtcatcctcaggccacccgtggccagccccaagctctctgcggcgaggagcgctagccccagagcctggcgtcctgctggggaggcgcctttcccgcggcgctgggcgccctgggcatccgggaggagcacccgtcccgccctctccccgcgcccggctccgcactccccgccagccctgcgccccgctccccgcgcgccccctggcggcaaacttcgcaatggctcccgccgcgctctgcttttcggggttgccggaggggcggggctgccggaggggcggggctgccggagggggcggggctgccggagggggcggggctgccggaggggcggggctcgagtgggaatgcaacccttggacacggtggatcctgggaatctaaccttccgtcccggggctgatgagctccagccctgccccaggaactgtgctgggggcccctggggatggggacgcaagctcagagggcggagacctcgggcgccccggcttcgtccgcaaggcgagacgggccgcaggggactgctagggtctgcaggggggtctgcgggggtgagggggcgggtgggctcggaggatggccccgggctcccagggaagctggaagggcgtcgggggaggtgacggcgcggagacctcggactctcagtcctgcaggggccgcggacacaggtggggaggagtgggggagtttttccctgggagaaatgggaagcgtcgaaggattttaaggagtgcggctggtcgggtttgcattcggggaggtcgctttgtctcttgagtggagaatgaggaggtggcaacagcaggggagtcaccgggaggctgctcgggtccagctcaaaaacgccaggcccgcccccgccccgcaggtccgcgggaaggaaggaaaaggcgttggggatgcgtaggaggcagaggccttggtggtcgatccggtgtggagtggggcaggggctgcgaggagggcgcccaggactggtatcagtgaacagtgacggtggggcagggcggtgaccttagcaccagcgcttcggtgggggggaggaagcacctgagccgcggagaaaggcctgcgtgaggtgggcacaggctggcgttgaagccctggggtggactcacgtccaggggagggcggtgcttcacacgtcccaggcactgtcttgtgtggccccaagtgctgtctgaatctctcctgcgtcttgggccccagcaccaacagccgtcgccctggagccaggcagcagccttaagcttccctgggaggctgactggctgggagcagggaggtcccatcggggaagtaggggcgtgcagggggcttggcgcctgcagtcctggaggggcagggcagatgataaggctaagtacctcctgtcctttgctcagccagccactaggaggaggccgcagagaagaagccgccaggggctgggggaggccagggacggggcagggaggaggggctgggctgaatgcaggtgccccaggagctgcgggctctccttccacaggttcgtgtctggtacacggctggagaaggcagggagggtgggaggagcctggcttggagagaaagggctggccggagacaccagagtgctcagggcaggggcgggagaggtggtccctcaggcctcagtggcagaggcatggggatccagggctgagagtgagtctgtggttcatggggttaccagaaaggggtcctgatccagatcccaagagagggttcttagatctcacgcaagaaagaattcagggcgagtccacaaagtaaagcgaaagcaaatttattaagaaattagaggaataaaagaatggccactccatagagcgggccagagggctgctgggtgaccatttttatggttttatttttattatatgataaacaaagggtgtattattcatgactctcctttttagaccataaggggtaacttcctgatgttgccatggcatttgtaaactctcatggtgctggtgggagtgtagcagtgaggacgaccagtggtcactctttttttttttttttttgagacagagtctcgctgtgtcgcccaggctggagtgcagtgacacgatcttggctcactgcaggctccgtctcccgggttcacacctttctcctgcctcagcctcacgcctgtaatcccagcactttgggaggccaaggcaggcggatcacgaggtcaggagattgtgaccatcctggctaacacgtgaaaccccgtctctactaaaaattcaaaaaattagccaggcgtggtagcgggtgcctgtggtcccagctactcgggaggctgaggcaggagaatggcatgaccctgggaggcagagcttgcagtgagctgagatcgcgccactgcactccagcctgggcgacagagggagactccatctcaaaaaaaaaaaaaaaattttaaaagaccaggtgcagtggctcacgcctgtagtcccagcactttgggaggccatggtgagtggattgcttgagcccaggaggcagaggttgcagtgagctgagatggggccactgcactccagcctgggtgacaaaacaagaccctgtctcaaaaaataaaatatttaagcttattttgtgtgtgctatggtttgaatgtttgtgtccatccaaaattcatatattggaacttaagttgcaaagtgatggtattaagaggtagggcctttgggaggtgaccagggcagggcggacgggattagtgctcttacacaagggcttgaggcagcgggttcttttctttaggccttttggccccttcctctatgtgagggcacagcaagagggtgtaatccctcccagacaccacatctgctggccttgacctaggacttccccgcccctaaaactgtgaggaatacatttttagtatttataaattactcagtctgtggtattttatttatttatttgagatggagaccagcctgggcaacatagtgacacctcatttctttaaaaacaacaacaaaaaaattaagggaaaatcagccaggcatggtggcatgggcctgtagtcccagccactggggaggctacagtgggaggatcccttgggttgggcctgggagtccgggccatgatgatatcactgcactctagcctgggtgacacagcaagaccttgtctcaattaaaaaaaaagaaaagaaaagaaaagaaaggcatagatctttactgcaagacgcccacagaatgctgtctacatgccatgcctctaattcctcttctttcattctctttttaaaaacttttaagattgagatataattcacataccataaaattcatctttttttttttttgagtcttgctctgtcgcccaggctggagtgcagtggcgcagtctcagttcaccgcaacctctgccttccaggttcaagcaattctcctgcctcagcctcctgagtagctaggattacaggcgtgcgccaccacacccagctaatttttgtatttttagtagagatggggtttcaccatattggccaggctggtctcagtctcatgaccttgtgtctgcctgcctcatcctcccaaagtgctgggattacaggtgtgagcaaccgcacccagccttttaatttctttaaatgacgtttaatagtgttcagtgttggctgggcacagtggctcacgcctgtaatcccagcactttgggaggccgagatgggcagatcacgaggtcaggagatagagaccatcctggctgctacggtgaaaccccgtctctacttaaaaaaaaagaaaaaaaaattagccaggtgtggtggggtggcgggcgcctgtagtccctgctactcgggaggctgaggcaggagaattgcttgaacctgggaggcagagcttgcagtgagccaagatcgcgccgctgcactccagcctgggtgagagagccagactccgtcgcaaaaaaaaaaaaaaaaaaaaaaaaaaaaaatatatatatatatttggtagaattcaccagtggagccaaaagggctaaggttttctttatagagaggttatttttttgtttttgttttgttttgtttgtcactaatttaatcttcttactttaattttctccagagaatactttttcttttttctttttttttgagacagagtctcaccctgtcgcccaggctggaggacaatggcgttatcttggctctctccaacctcccaggttcaaacaattctcctgcctcagcctcctgagtagctgggattacaggcacctgccaccatgcccagctaatttttgtatttttagtagagatgaggtttccccatgttggccaggctggtttcaaactcctgatctcgtgatccgcctgccttggcctcccaaagtgctgggattacaattgtgagccaccgaacccggccgagaatagtttttcttaagtccttaaggactcagctccttacatgagctttgatggtggttgtggggcagcacagacaggtctaaatccaggtagggttgtttggtccttgcaggctgcacgacatggattcctgactgccttgctgtgaatcgcacaactcacacagcagtgtagcgtcacgtgcagcttgggaagcacgtaggctttgaagatgcttgtttcagaaacgttactgactgctgtggcctctactgcttcaaatgatgaatttgttaacagccttgtctttggacacagtttgtgcagcaaataggctgcacatggccatggccctttttggcacaaccagtgttccttcttttctttgtcatcttgaaggcacagacccaagagagttatctttttacttcttaaagtcctattcagctttttaaaatttcttcttggattagtttcattagtttgtgacttttcggaaatgtgtcagtttcatatagactatctcatttattggcctccagttattccgagcatatcatcccttctatttcctgaaggtcagtcctactgtacctactttcattcctgattttattaatctaaggcttttctattttttttttttgtaggtcagtacaacttaaggtttgtcaatcttattgattttatcaaagaattcacttttggtttcactgatttttctctattttttattctccatttttatttatttatttatttatttttgagatggagtcttgctctgtcacccaggctggagtgcagtggcacgatctcagctcactgcaacctccacctcccgggttcaagtgattctcctgcctcagcctcccgagtagctgggattacaggcgcctgccaccacgcccggctaatttttgtatttttagtagagacgggggtttcaccatcttggccaggctggtctcgaactcctgacctcgtgatccgctcgccttggcctcccaaagtgctgggattgtaggcatgagccaccatgcctggcttgttctccattttatttatttccactgtcacctttgttatttcctttcttctttctgctttgggtttagtttgctttttctctagtttcttttcttttttttttttttttttgagacagagtctcgctctgtcgcccaggctaaagtgcagtggcacaatcttggctcactgcaagctccgcctcccgggttcacgccattctcctgcctcagcctcccaagtagctgggactacaggtgcacgccgccacgcccagctaattttttatatttttggtagaggtggggtttcaccatgttagccaggatgatctcgatttcctgacctcgtgatccacccgcctcggcctcccaaagtgcgggatacaggcctaagccaccacgcctggtctaaatttccctatttagccactttagctacatccataagttttggtatgttatgcccccactcgctttcatatcaaagtactttaaattttttcttgacattttttatttgactcattggttatttagaattgtgttgtttaatcgtcacctatttgtgaatttctcaaatttccttctgttattgattcctaattttattacattatgattggagaacacactttgcatgacttcagtccttttaggtttattgaggtgttttttttggcctaacatatagtctatccttgagaaccttccatatgctcttgagaagaatatggattctgatattgttgtgtggaccattttttcaagatctgttaggtttagtttagttgatttatagtgttgttgaagttgtctacttcctcgttatcttctgttagttgttctatccattattgaaagtgaggtattgaaatctccaactaggcctgcgtgtggcagctcacgcctataatcccagcactttgggaggccaaggtgggcggatcacctgatgtcaggagtttgagaccagcccagccaacatcgtgaaaccccatctctactaaaatacaaaaattagcccggtgtggtggcaggcatctgtaatcccagctacctgagaggttaaggcaggagaacggcttgagcctgggaggcagaggttgcagtgagccaagatggcaccactgcactccagcctgggagatttagcaagactctgtctcaaaaaaaaaaaaaaaaaaaggaaggaagaaatctccaattaatttgaattatctatttctcccttcaattttgtcagttttttttttttgtttttttttttttttagacagagtctcgctctgtcgcccaggctggagtgtagtggcaccaccttggctcacttcaacctctgcctcccgggttcaagtgattctcctgcctcagcctcctgagtagctgggataacagacaggtgccaccaagcctggctaattttttatatttttagtagagaccgggtttcactgtgttagccaggagggtctcgatctcctgacctcgtgatctgcccgcctcagcctcccaaagtgctgagattacaggcatgagccaccgtgcccagccagtgcatatgtgtttctagttattatatcttccttatggatcaccctcttatcattataacacatccttctttgtctctaacaataatttttgtcttaatatctatattttctaatattagtagaggaactccacctctctttgagttgctgtttgaatgttatatcttttcctgtcattttactttgttttttggacggagtctcgctctgtcgcccgggctggagtgcagtggtgcaatcttggctccctgcaagctctgcctcccaggttcacgccattctcctgcctcagcctcccgagtagctgggactacaggtgcccgccaccacgcccagctaatttttgtatttttagtagagacggggtttcaccgtgttagccaggatagtctcgatctcctgacctcatgatccgcccgcctcggcctcccaaattgctggtattacaggcatgagccaccgcgcccggcctcctgtcattttacttttaagatattgtgtctgaatctaaactgtgtctctagtagccatcatgttttatacctagcagatatagttggattatgttttttaaatctattctgccaatctttttcttttaattagtgtttaatatattaatatttactataattaccagtggtgggattgaggtctgccattgtgctatttgttttctctctgtcttgcctgttttgttcctcctctattcctccatattgcttcttttgtgttaaatatatattctctaatgtgccatttaattctttttttttttttttttttgagacagagtctcgctctgttgcccaggctggagtgcagtgacacaatcttggctcactgcaagctccacctcccaggttcatgcaattcttctgcttcagcctcccgagtagctgggactacaggtgggtgccaccacccctggctaatttttttttgtatttttagtagagacgggttttctccatattggttaggctggtctcgaactcctgacctcgtgatccacctgccttggcctcccaaagtgctgggattacaggcgtgagccaccacggccagcctccatttaattcttttgtcatttcttttgctatatatattttcaaatttatgttttattgaggtaaaatttacataacataaattttgcccaggcgtggtgggtcacgcctgtaatcccagcactttgggaggccaaggtgggctgatcacctgaggtcaggagttcaagaccagcctggccaacatggtgaaaccccgtccctcctaaaaaatacaaaaaaaattagccaggcgtggtggcgagcgcctgtaaccccagctacttgggagattgaggcagggggaattgcttaaacccaggaggtggaggctgtagtgagctgagattgtgccactgcaccgtggcctgggcgacagagcgagactccatctcaaaaccaaacaaacaaacaaaaatttaccactataaccgttttaagtgtacaatttagtggcattaagtacatccacaatgttatgtaatcatcaccactatttccagaacttttttgtcatcccaaattctgtgcccattaagcaataagtccctctccctcccttccctctaggcctggtaacctctattctagtttctgtctctataaacttgcctattccagatgtgtcatataagtggaatcatataatattggaactttaatgtctggcttatttcacttagtagaatgttttcaaattctcccatattgtagcatgcctcagaacttcattccttcttatggctgaagcatattccatttatgtgtttagaccacattttgtttattcttttatctgttgatggatacttggcttgtttccacatttggctattgtaaataatgcgttatgaacatcggtgagcaagtatctgtgtgattcctccttttcagttctttttttgtttctttgttttttgagacggagtcttgctctgtagcccaggctggagtgcagtggccccatctcggctcactgcaagctccgcctcccaggttcacgccattctcctgcctcagcctcccatgtagctgggactacaggtgcccgccaccacgtccggctaattttttgtattttttagtagagacggggtttcacgtgttagccaggatggtctcgatctcctgacctcgtgatccgctcgcctcgcaaagtgctgggattacaggcatgagccactgtgcccggccaagggttttaatttcttactacccttaccagcatttgttattttgcttcttttgaaaaaattatagccatcccaatgggtgtgacatggtatttcattgtggttttattttgcatctccctagtgactgatgatgttgaacattttttgtgtgtgcttgttgaccatttatctgtcttctttggggaaaggtccattcaagtactttgtttatttgtaaattaggttgtttagggagtttttgtttcggagttacagcaattctaatatgctgcatattaatatcctatcagatataggatttgcaaatatctcattttgtgagttgccattctactctttttttttttttcaggcttaattcactttacttctcttgtataaaaaccctatgttgtagccacagcaggagcctgggtccactgcacggagactctggtgtgggtcttgacgaggtggtcagtgaattcctgatagggagacttggtgaatacagtctccttccagaggttgggggtcaggtagctgtaggtcttagagatggcatcaaaggtggccttggcgaagttgcccagggtggcagtgcagccccgggctgaggtgtagcagtcatcgataccagccatcatgagcagcttcttgggcacaggtgcggagacgatgccagtgcccccgtgtgcagggatgaggcgcgccggcacagagccgcagcggcctgtcaccttgcaagggacggtgtggggcttgccgatcttgttcccccagtagcctctgtgcacagggacaatggagagcttggccaggatgatggccccacggatggcggtggccacctccttggagcacttaacacccagaccgacgtggccattgtagtctccgatagcaaagaacgccttgaacctggtgcgctggccggcacgggtctgcttctgcaccagcataatcttcaaaacctcatccttgagagaggcccccaggaaaacgtcaatgatctcagattccttaatgggcagggaaaagagatagatctcctccagggacttgatcttcatctccttgaccaagcggcccagcttggtgacaggcatccactccttatcctcagccttgcctccgcgagctccgcagccttggccctggccccgtccacggccgcgaccccggccccggatgccactgccgaaacctccgcggaaggcaccacggttccccatcccagggccaccagggcctccggcaccccccccccccccccctgcaccggcgtcatccgccatttggtgttttctcagacaagaagcgccattctactctttttaaaaattctttttattgttttttaaatttttttattatactttaagttccagggtacatgtgcacaacgtgcaggtttgatacataggtatacatgtgccatgttggtgtgctgcacccatcaactcgtcatttacattaggtatttctcctaatgctatctatccccctccagccccccaacccccaacaggccccagtgtgtgatgttcctcgccttgtgttcaagtgatctcattgttcaattcccacctatgagtgagaacatgtggtgtttggttttctgtccttgtgatagtttgctgagaatgatggtttccagcttcattcatgtccctgtaaaggaaatgaactcatcctcttttatggctgcatagtattccatggtgtatatgtgccacattttcttaatccagtctatcattgatggatatttgggttggttccaagtctttgctattgtgaatagtaccacaataaacatacgtgtgcatgtgtctttatagtaacatgatttataatcctttgggtatatacccagtaatgggatcactgggtcaaatggtatttctagttctagatccttgaggaatcaccacactgtcttccacaatggttgaactagtttacactcccaccaacagtgtaaaagtgtttctatttctccacatcctctccagcacctgttgtgtcctgactttttaatgatcaccattctaactggtgtgagatggtatctcattgtggttttgatttgcatttctctgatggccagtgatggtgagcattttttcatgtgtctgttggctgcataaatgtcttcttttgagaagtgtctgttgatatcctttgcccactttttaatggggttatttgtttttttcttgtaaatttgtttgagttctttgtagattctggatattagccctttgtcatatgggtagattgcaaaaattttctcccattctgtaggttgcctgttcacactgatggtagtttcttttgccatgcagaagctctttagtttaattagatcccatctgtctagtttggcttttgttgccattgcttttggtgttttagtcatgaagtccttgcccatgcctatgtcctgaatggtactgcctaggtgttcttctagggtttttatggttttaggtctaacatttaagtctttaatccatcttgaattaatttttgtgtaaggtgtaaggaacggatccagtttcagctttctacatatggctagccagttttcccagcaccatttattaaatagggaatcctttccccaatgcttgtttttctcaggtttgtcaaagatcagatagttgtagatatgcggcgttatttctgagggctctgttctgttccattggtctatatatctgttttggtaccagtaccatgctgttttggttactgtagccttgtagtatagtttgaagtcaggtagcgtgatgcctccagctttgttctttttaattaggattgtcttggcaatgcaggctcttttctggttccatatgaactttaaagtagttttttccaattctgtaaagaaagtcattggtagcttgatggggatggcattgaatctataaattactttgggcaatatggccattttcatgatattgattcttcctatccatgagcatggaatattcttccatttgtttgtgtcctcttttatttcgttgagcagtggtttgtagttctccttgaagaggtccttcacatcccttgtaagttggattcctaggtattttattctctttgtagcagttgtgaatgggagttcacttatgatttgactctctgtttgtctgttaatgatgtataggaatgcttgtgatttttgcacatcgatttggtatccagagactttgctgaagttgcttatcagcttaaggagattttgggctgagatgatggggttttctaaatatacaatcatgtcatctgcaaacagggacaatttgacttcctcatttcctaattgaataccctttatttctttctcttgcctgattgccctggccagaacttccaacactatgttgaataggagtggtaagacagggcatccttgtcttgtgccggttttcaaagggaatgcttccagtttttgcccattcagtatgatattggttgtgggtttgtcataaatagctgttactattttgagatacattccatcaatacctagtttattgagagtttttagcatgaagggctgttgaattttgttgaaggtcttttctgcatctattgagttaatcatgtggtttttgtcattggttctatttatctgatggattacgtttattgatttgcgtatgttgaaccagccttgcatcccagggatgaagctatcctgattgtggtggataagctttttgatgtgctgctggattcgggtattttattgacgattttcgcatcgatgttcatcagggatattggtctaaaattctatttttttgttgttgtgtctctgccaggctttggtatcaggatgatgttggcctcataaaatgagttagggaggattccctctttttctattgattggaatagtttcagaaagaatggtaccagctcctctttgtacctctggtagaattcggctgtgaatctgtctggtcctggacttttttcggttaatagactattaattattgcctcaatttcagagcctgttattggtctattcagagattcaacttcttcctggtttagtcttgggagggtttatgtgtccagacggagtctcccttgttgcccaggctggagtgtagtggcatgatctcggctcactgcaacctctgcctcccgggttcaagcaattctcctgcctcagcttcccgtgtagctgggattacaaggcatgtgccaccacacccagctaatttttgtatttttagtagagacagggtttcaccatgttggtcaggctggtctcaaactcctgacctcgtgatccacccgcctcggcctcccaaagtgctaggattacaggcgtgagccactgcaccaggccttattctactctttaaaaaaaaatctttttagagacagggtctcattctgttgcccagggtggagtgcagtggtgcaatcttggctcactgcaacctctgcctcccagtttcaagccaattctcctgcctcagcctcctgagtagctggaattacaggcgcgttgccaccacacctggctaatttttgtatttttggtagagacagggtttcaccatgttggccaggctggtctcggactcctgacctcaggcgatccacccacctcagcctcccaaagtgctgggattacaggcgtgagccactgtgcctggccaagtttcgtagttttagctcttacgtttaggttttttgatccatttttgagtacatttttgtatatagcataaggttaggatccaacatcattcttttgtgtatggatatccagttttcctagcaccatttgttgaacagactgtcctaccccccattaaatggtcttggcaactttgccaaaaatcatttaaccaaatatgcgagggcttatttctagattctctagtctactccattggtctatatgtcactccttatgccaataccacattgttttaattactgtagctttgtagtaagttttgaagtgaagacatgtgagtcctgcaactttatctttcttttttacaaacgattttgactatttgtggtctcttgcaattccatatgagtttgaggatcagcttttctatttctgaaaaagtaaaaatggctgttggaattattttttatttttttggagatggagttttgctcttgtcccccaggctggagtgcagtggcgcgatctcagctcactgtaacctctgcctcctgggttcaagcaattctcccgcctcagcctcctgagtagctggaattacaggtgcctgccaccatgcccagctaatttttgtatttttagtagagatggggttgcgccatgttggccaggctggtctccaactcctgacctcaggtgatctgcctgcctcggcctcctaaagtactaggatcacaggcatgagccaccacatccggcccaggctattggaatttttacagagactgaggtgaatctgtagatcattttgggtagtagtgacatcttaacaatgtttcgtcccccatccatgaatatgaagtatctttccatttatttctctctttaattgttttccgcaatgctttgtagttttcagcatctaagtctttcacctccttggttagatttattcctaagtacttaattatcttagatgctatcgcatgcagatggagttgttttcttaattttcttttctttcctggattattttttatcttagtacctgccactacctaacattttaaatatatttatttgtctctttctgtctcatttactgaataaatcttccataaggtctaaagatttttatttgcttattgccttagtctaggatctgaaaacagtgtcaggcacatggtctagtatgtatttgttgagtgcactaatgatgaaggaacaatttactaatttagcattctctttatttatgatttttttcttttgccattataaaaaaatgcgtcagggattgctgggtcaatgtccatttgccttcttaattgtgtttgcagttgagaggctgcttcccaaggtgattgttgtaatgattttcatttccgccatcagcaaatgagggtccctggggccctcacacctctgggagcactaggtgctaggttgtcttctgtgtctgacacctgggggtagatccctgtgtgagcagtgctttagctgacacttccctgatggctagtgaattagaacttcttcaaatgtttgttaaccatttcatattgctcttctatgaattgcttatttataacctttgctcatttttctatttcattcccttctttccttccttccttcctttcttccttccttcctccttcccttcctccctccctccttcctccccttcctccctccctccctccttccctccttcctccccttcctccctccctcccttactcccttctttccttccttccttctcctctctttctttctttttgacagggtcttgttctgtcacccaggctggagtgcagtggcacgatcatggctcactgcacctcaaccacccaggctctagcaatcctcccatctcagacccccaaatagctggggactaagggtatgtgccatcgcgcctggctaatttttgtattttttgtagagacagagtttcgccatgttgtctaggctagaactagtctcaaactcctggactcaagcgatctgcccacctcagccttccagagtgctaggattacaggcgtgagccattgcgcctggccacacttttcttttttgttcttttcttggctgttcttcagcatttattcttccatatacactttaagatagttttagtcattgaaaagatctggggttctacctggtattgctttcttttgtccagatattgctccatatcattccatgttttcttcctataggttctgtgccttccttagtgattttcttaagctttttatatttctttgtcgctcttctggatgggatagatttcccattgcctttgccagaagctcattattggaatggaaagaaagattgatcattgagcatacttcttctcttctcaatttaccagattattttattaaggccagcagtttttacttgagtctcttagatcgttcaggtgttcaagcatatcatcatcaagaagaagagcttggccaggtgccgtggctcacacatataatcccagcagtttgggcagcggatacaggaggatcacttgagcctaggagtttgagaccaatctgggcaacatagtaagaccctcatctctataaaaaaatgtaaaaataaaaaaagaaggggaagctctgtaatccttttttaccaatgtttacgccaattatttcacttttattatgtgcacaagtgggtggctaccttctcctctgtaccatctgttattgggggctgggggctcccgcctttccctgtgctgtggaataagtgcattgggtcagacctgtctgttctctgcaggtaagcagagccctgctctcctcctcctccccactgcctttgctcatggcctcggccgggccctgctggaaacaccaggtgctcgctcccagcagaggtttgaacctctgtccctgcaagcttgggggttggggtcctggcagatgaggtaccaggaggccctttgggggaggcccaggctctttgactgatggtctgcgggtgtgagcccccaagttctaggcctgggggccgaaaggaagaagcttcgaggaagagtcaagcaggccaccttgggcatacgtgctgtcaccccgggatgcccgcccagcgcgccaagccccccacgctcacctgtaagtgcaggtggtgctggaggccaggccggggccctgcaggggcaggcacacagtggggctccgtcgccgcagcgccccggcggcctcctcctggccgctggccctcccctaaggcttcctcatcctaaacagcaagtgaagccaaacgaaaaccctgtctctcccgccgttccctccctcctggcctccgtcccccgggctcgcctgccccgccgcccggcggaccggtcccttcctgctttccctggcgggtgctttccgctgctctgttacccggagccaggacgcgcatatattcccagaatccgcgctcagtgcgttcggtcccccgggacacctgttctctgcacaggcgcgtctgggcgcagcgggggcagacacgcgttcccgggcagcgactccggaaggcccgagggagtaaatctggccctcccggttcagcacaaagctcccctggccgcctttcaaaaccgaccgcctcccaactctccgcggacacgagtggcggctgcctcccctcccctcccctagggccgcgcacgcctcccgcagggtctcagtgcctcctgggcgggggataattcctgtccccaccggtgtcctgtactcgcggggtcccgggtgtaagttctgggtcccgggctggctccctggtgagcaaagccgcatcgctcgaattccagaaacccttctcgccgagcgcctgcctggctgctgaaagcctggagactgcgctctcggaggtggatttcggaactcaggagagaagaatgagacgctccctagtacccctagtcccccaggggtgggaggggactgtatctcaaaataagattctgcaactcgacttttataggggaaaccaggcacgcatttcaaaatcttctcatccgtccccacctccttgcgccgcttttccgcgcctcctgtgccacggaagctgccctctgctcctgctgtttccagcccggcagcccccagacaggatctagcttggcccagccgggccctgcttcctctgcctggggtcctcaggccatgcaagtgaggaaacccaggctcagaggggccacgtaactcttcccaaatcaccagcaagcctggtgcagccacggtggcgcgcattcgcccactcggagaccgagaggcaggttttctgcctgcacagcctcccgcccaaggccagacctgctggaggcccaggccctggagatggctgtcttcagggagactctttatgtcacgctcattcactccctagcgcctctttctggcaacggatgtgtccagcgttcaggtctcttaacttacggtctccgtttttccaagtttggaaatcagctcagagcagagcgggcaaagaggggctttcactggtgctcagagctcacctgcgaaggagggaccacagcctccgggatgcagcgccctggctgcctactgctggctggctggcccctcccctgcagattcctcctcacccagccccgcacaggctgagggcttcactaaccagaaccatagtgtgacaaatgcacactggggggttacggaggaagagcagagttggggtcagaaggcatttaccctgagaaaaaagggcacatggcacacaacccatgaagggaagggagaggaacagcatgtgcaaaagctcagagttcagagtggtggcctggagcttagctggagtcaaaggtgatggtgggaggtgagggtctggtgcaggtggttctcccaagctgggctgagctgtatgacttgaccctgaggggcatgcgggccaggctgtgttttgtggggaggcaggagccaggacacagattgggggaaaggggtaaaggagcctggtccctgcggccgcctgcttacctaggacctcaggacttggggaataagtggccatcctttggaatgctctcaagggatctcagataaggggaggcagaagagtgttctggagaaagcagggcccatccttctccaccccaccaccctctccccatgtccctggagctggctcctctcccacaagccaggcctggccagcccctggtatctcaccctgccaaagagctatgtagtggcagttccacaccctgtgcccctcccccaccccacccacagtgaggaccccctggtgttggggacactccgggtctgtgggatttctccagaagcagactcagacagggattggcacccacactgaaaagttaacatagtctaaatatgtgtgtccctcccaagttcacatgtgatggtggtattagggggtagggcctttgggaggtgattaggtcatgagagcacagcccttaggaatggcaatagtacctttataaaaatggcccaagagagatccctcatccctcccaccatgtgaggacacagtgagaagccccatctatggaccaggaagcagccctccccagacactgctggggccttgatcttggactccacagcctccagaacaatgagaataaatttctgttgtttgtaagttgtgcagtctgtggtttttgtcatagcaatgccagaaggtggtggatgagtaagatggggatggagaggtagctatggtaggcaactggagtataacctccaggggaattttgggaaaaatgtaaaacatgcagagctaggaggaagagagctggggtatttatacaccaactccttccagcctgtggttgagaactctccgaggtgtcaaatccccacctccagtcctgagcagaaccagagggaccttcccttcccaggatttagcctctaggtgatgagatgtcgctgctggtgggtgacaggcaggacagctgagggaagggccccaggaatctggccaccagccaagtctgctgtagtgcatttgtgctctgaagcccaatgcagtcaatagatgactaataacagccaaatgagagatttgccctttttggcccaaaaatgtgattgagctctttatttttcagcgttttccagaaagacagaaccagcaggatataagaaagggggtttattaggggagctggctcacaggctcacagaggtgaggtcctctgacaggtggtctgcaagctggagaccagagcatggctcagtccaacttccagagcctcagaactagggaagccagccaggttcagggaagccagctcaggcccaagagttcccaaaaggccgctagtgcgagtcccagagttcaaaagcagaagagccaatgtacaaaagcaggaggagaaaaagcactcctctccaaaaggtagagaggaacagcagagagagagtgaatcccccttcttctgcccatttgttccagctgggcccccagccgatgggatggtgttctgcccacactaaggaccggtcttcctctctcaggccactgactcacaagtcctcccagacacaccgagatacaatgcttcaccagccatctaggcatccctcaatccagctcagttgacccctaaaattaaccatcataagctccctagagggacaggttgggggaggaggacacttcaaggtctaggtctatgcagaagtttcccagaccatttgagaacacaacagttgaaaaccaaacacgaaaatcagggctctactccagcctgagaaacagagcgaggctctgtctcttaaaaaaaaaaaaagaaagaaagaaagaaagagagagagagagagaaaaagaaaaaccagggccagaagcgggggctcacacctgtaatcttagcattttgggaggatcacttgaggtcaggagttcaagaccagcctggccaacatggcaaaaccccatctctaataaaaatacaaaaattagccaggtgtggtggtgggtgcctgtaattacagctactcaggaggctgaggcacgagaatctcttgaactcaggagatggaggttgcagtgagctgagatctcaccccactgcactccagcctgggtgacagaacgagactctgtttcaaaaaaaaagagggccaggcgcggtggctcacgcctgtaatcccagccctttgggaggccgaggtgggcagatcacgagatcaggagatcgagaccatcctggctaatgcggtgaaaccccgtctctactaaaaatacaaaaaattacctggacatggtggcgggcgcctgtagtcccagctactggggaggctgaggtaggagaatggcgtgaacccgggaggcggagcttgcagggagccgagatggtgccactgcactccagcctgggtgacagagcaagactccggctcaaaaacaacaacaacaacaacaacaacttgtggtttaaatatattgtatctctaccggtattttgtccatttagtctatcagttaccgagagagatgttttaaaatttcccacagtagttgtggatttgctgctacttttttagttctatcagattttgttttctatgtttcagcgctgtgttattaggtgtctacagatttatgattgttagatcttcctattcaattgacccttttataattgtgaaatggttttatcgtcactgcaacctccgcctcccgggttcaagtgattctcctgcctcagccgcccgagtagctgggactacaggtgcccgccaccacacccagctaatgttttgtatttttagtagagacggggtttcaacacgttggccaggatggtctcaatctcttgacctcatgatctgcctgccacggcctcccaaagtgttgggattagaggcacaagccaccacgcccggccaatattactaaatatcaagtcaatgttcacttttccaattgttttgtaaacgtttgtttgaattggaacccagttttgccactttgtgactggttgataagtcaggtcttcttaatccacacttttcttattcgtcctttcttcccctctagcaaaggaaaccaggctgttcccctgtagctcaccagcctggattttgccagctgtgccccctgctactgtttaacatgcatctgtgcctctgcattccctgtaagctggtagtttgtattgaggagttggactccatttcttaacttctggctactgacagcttcctttttttttttttttttttttgagacggagtctcgctctgtctgtcgcccaggctggagtgcagtggctccatctcggctcactgcaagctccgcctcccgggttcacgccattcttctgcctcagcctcctgagtagctgggactacaagcacccaccaccacgcctggctaatttttttgtatttttagtagagatggggtttcaccgtgttagccaagatggtcttgatctcctcaccttgtgatccgcccgcctcggcctcccaaagtgctgggattacaggtgtgagccaccacacccggcctaaaaatccaagttttaggcaccagctactagtgcagtagccacgtgtggttagagcctccagttctttacagtctcattgtgtggcccaggctggagtgcagtggcacagtcatacatagttcactgcagccttgaactgcctggctcaagggatcccccgactcagcctccagagtagctgggactacagctgcacaccaccacatcccactaattttattattttctgtagagatgaggtctcacagccaggtatggtggctcatgcctgtaatcctagcactttgggaggccaaggcagttggatcatttgaggtcaggagttgattgtgccactgcactccagcctgggtgacagagtgagatcctgtctcaaaaaaaaaaaaaagaaaaaaaaaagattaaaaatgagatgaggtctcggggtctcactatgtctcccaggcttgtctcaagctcctagactcaagcgatcctcccacctcggcctccctaagtactgagattacaggcatgagccactgtgcctggcccgtgtgtgagaaattgagtaggggtgggaaggtttatttggtttctagcttgctggagtgtcacattccaaggaccttacctgaaaggctgagtgtttttacagggtcccttctccttgatgcctggactccaattcctttctccataacaccatcagacagctaaagctttaatttcatgggctttcagctgccattttctgcttgactttgtaacctcctacccaaaacagcttagagattggcaaatatcttaatgggaaaagaggcacagaagattgaatggtagcttccaatgccaatatttgcctccccaggcctgtgagaatcccagaagctctgagctgccactttctgcttggtctctaagtacctgccaggctcatctcaatgtgattcccttttctcaggttctcagtccctcaagtcctggctgccttggttgctctccaatgccttcaaacagctgttatgttgttgctgttgttttgagacagagtcttgctctgtcgcccaggctggaatgcaatggctcgatctcggctcaatgcaagctccacctcctgggttcacaccgttttcccgcctcagcctcccaagtacctgggagtacaggcacctgccaccacgcctggctaattttttgtatttttagtagagacggggttccaccatgttggtcatgctggtcttgaactcctgacctcgtgatccacccgcctcagcctcccaaagtgctgggattacaggcgtgagccaccgtgcccggcctgttgttgtttttaaactagtttttagagttgcttttggtgtctgatacttgttatttaccacagccacaagtaggtgtttttgctttgtgggaagctttatttttgagagcatagaggttcctgattactataaagaattaaatggggccgggcgcggtggctcacgcctgtgctccgagcactttgggaggccgaggcaggcagatcacctgaggtcaggagttcgagaccagcctgaccaacacggagaaaccccgtctctactaaaaatacaaaattagccaggtgttgtggtgcatgcccgtaatcccagctacttgggaagctgaggcaggagaatcgcttggacctgggaggtggaggttacagtgagccaagatcacgccattgtactccagcctaggcaacaagaaagaaactccgtttcaaaaaaaaaaaaaaaagaattaaatggcctaataaatgataatgagtacttatagatttgcctggtagacaggaagaatgatctactggatgatttgattgatataagaaattattaaaattagggccaggcatggtggctcacacctgtaatttcagcactttgtgggctaaggcaggaggatctattgaggtcaggagttcaagaccagcctgggtaacatagcaagacctcatctctacaaaaaaactttaaaattagccaggcacaggccaggtgtggtggctcacacctgtaatcccagcactttgggaggcagaggcaggtggatcacctgaggtcaggagttggagaccagcctggccaacttgaaaaccccatctctactaaatatacaaaattagccgggcgtggtggtgcacgcctgtaatctcagctactcgggaggctgaggcaggagaatcacttgaacctgggaggcggaagttgcagtgaaccaagatcatgccattgcactcctgcctggacaacaagaatgaaactccatctcaaaaaaaaaaaaaaaaaagtacaaagactgcatgtgcatgagtgaaaaaacacaaggggaaatgtagtgatatgaaaggaatataaaatctgacacatgaaacaaatagttctatctgtgttgttttggataaaatgaaaaggcatttcgcttactaaaaaggtgatatttcaatattctaagaagactttgattaggaatatagcagaagacttttctgcaactatccatcaaaagatcagattctggccaggcgcggtggctggcacctgtaatcctagcactttgggaggctgaggcgggtggattgcctgagctcaggagtttgagaccagtctgggcaacacagtgaaaccttgtttctactaaagatgcaaaaaattagccaggcgtggtggtgggcacctgtagtcccaggtactcaggaggctgaggcaggagaatcgcttgaacctgggaggcgaaggttgcagtgagccaagatcacgccactgcactccagcctgggtgacagagcaagactctgtctcaaaaaaaaaaaaaaaaaaaaaaagatcagatttcatctccctgaatatagaagggatgttatcttaccagccctggcaggccactacgcatatgtgcatacgttaccatgtctgtgaggcattgcaaggaatacatttttttagccactcaacacctgtagatgtcaccgtctcggcagccaacaggaagaccccatctccagccgctgttttccactatgaccctcagcgagtgttttccacatttaaccacgtgggacccacggctctggggatggctttgtgccatcttgtgtttcttcagaccctgcctgagtttcaggagaatttgcgtgaccatgggaaaggctactgggctgtccaaatgctaccgtctctcaggcacctgacctcgggcatctgctcccttctgccgcttcctgagggaactctcggaaaccccgcagcaggcctcactcaggagaggctgagggaagagatgggcagtgccaccagaggcccctctgagaggcgtttcaacagcttcacctgtgctgacaaagcagccgtggtcagcaccgccgttaaggcggccatcagtggcggctggcatgcagcgtgtacacgaattaacacatcaaacagaaaaactgccaaaagcagtaaagcgaataaggatggctgggtgctcctcactcctccaatgccagtgccccatcccctctcagtgccttcgttcacctctgactcctgtgtccacagtgacgttccaaagaagagccccacagagtggacacacagaaagtcctactcacgtcgaatgtgtcatcctctgcccttccttcctaggctcaccctggccatgagatgtgcatggctgctggaatgggcattgcacaacgattctcgagagctcagggccgccgtgagtgttctctgggtttctggcacatggtggaggaggtttaaaggagccttctctaacttcaccatccttagagaaaagacacctcattgggtggctcctggctccatggtcagtggctttgactgcaggggtggaggtgtggggggggtggaccaacacatttttatttaaaaaaaaatatatgtatatctcacaaaatagacttttttccatagaaaaaaaaattttttttttgagatggagtttcactcttgttgtccaggctggagtgcagtggtgcgatctcagctcaccgcaacctctgcctcccgggttcaagcaattctcctgcctcagcctcccgagtagctgggactacaggcatgcgccaccacgcgcagctaattttgtatctttagtagagatggggtttatccatgttggtcaggctggtcttgcactcctgaccttagatgatccgcccgcctcagcctcccaaaatgctgggattacaggagtgagccaccgtgcccagctcatagaaatatttattaccagtattccaaagaacagtacttggagaaagcatatctaagcacgtgtgcagggcgaggtacagtggttcacacctgtaatcccagcactttgggagactgaagcaggaggatcgtttgaggccgggaattcaataacagcctgggcaacatactgaggccccatatttacaaaaatttaaaaaattagctggcgtggcagagtgcacctgtagtcccaggtacttgggagggtgaggtgggaggatcacttgcagccaggattttgaggctgcagtgagctatgattgcacctgcacttcagccggggtgacagagcaacagcttgtctctaaaataaataaaaacatcctctgctacatgggtgattcagctgtaactaacagaacatccaacccaaagtagcttaaacaacatcgtttaagtttgttagcttgatccacttcgtaagattaagaagtctatggctctgggtccagttcagctgtggcagggatcttggtcagcttgtctgctctgctcctggtcttctcttagtctcaagatggctctgcagtcccaagaatcatgtcctcacccagcagaggcggtgagtagagacagagaatgtcttacctcacatcaactctttaacaggaggacggcattcctagaagcgcccttccccacacactgtcccctgcaacagcacacttcccctcatatctccttggccccaaattagttatgtgcccttgctcagtcctggacctggccccttccccgagatcaagagatcaccacagatggctgaaagcccctggttctgttggaaagaacaaggaggaaaggctttgaggcaggtggtccgcagggcccgtcatgctggagagctgatctgtaggtgagcaaaaaaaattccattttccctgatgaaccgcagagaaaggattcccgctgaagtagaaaggagatgaccacctcagtcctcttcctcatcttgttcaccatgggtcctgcagagcttagggggtgtgtgggtgctgggtggtaaagatccaggacctgggcagagatgggatccgccctcagcgcagggttatgacagtactctccgaaactccactcgattgctcttctgcctcctcatcattgtcctactctgcaccatgggacacagagcactgccccagagccggcagtcaggagcagtggagggaggaatggagggggcagtggagggatgaatggagtgagggagtggagggatgaatggaggggataggggagggatgaatgtagggggcagtggagggatgaacggagggggcagtggagggatgaacggagggggcagtggagggaggaatggagggggcagtggagggaggaatggagggggcagtggagggataaatggagggggcagtggagggatgaatggagggagtggagggatgaatggaggggataggggagggatgaacggagggggcagtggagggatgaacggagggggcagtggagggaggaatggagggggcagtggagggatggagggggcagtggagggatgaatggagggggccatggaaggatgaatggagtgagggagtggagggatgaatggaggggataggggagggatgaatgtagggggcagtggagggatgaacggagggggcagtggagggaggaatggagggggcagtggaggaatggagggggcagtggaggaatgaatggagggggaagtggaggtatgaatggagtgagggagtggaaggatgaatgtaaggagtaggggagggatgaatgtaggggcgagtggagggatgaatgtaggggggagtggagggatgaatggaggggggaatggagggatggagtggggagtggaggggtgaatggggggagtggagaggtgaatggagaggggactggaggttgaagggaggggggagtggagggtgaatggaggggggagtggaggggtgaatggaggggggagtggaggggtgaatggaggggggagtggaggggtgaatggaggtgggagtggaggggtgaatggaggggggagtggaggggtgaatgtaggggggagtggaggggtgaatggaggggggagtggagggatgaatggaggggggtttggaggggtgaatggagggagagtggaggtgaatggagcggggagtggagggatgaacgcagggttctgtggaaggatgaatttagggggtagtggaaggatgaatggaggggggagtggaagggtgaatgggggggagtggaggggtgaaaggagcagggagtggagggtgaagggaggggagagtggaggggtgaatggaggggggtttggaggggtgaatggagggagagtggaggtgaatggagcggggagtggagggatgaacgcagggttctgtggaaggatgaatttagggggtagtggaaggatgaatggaggggggagtggaagggtgaatggaggggggagtggaggggtgaatggagcagggagtggagggatgaatggagcggggagtggagggatgaacgcagagttccactgaaagatgaatttagggggtagaggagggatgaatgcggcgggacagtggtggcttaaatgcagtgggtgggggtgctggtgtgtgtctgggaagggtactgtgctctctgctctttgtagccacgtgtcagggtgctttctaagaagggtgcaggcagacactgttttcttcaggagagaagctccgaatgggacgtagggaacacagccccggagccaggaagcactgagctgctcccagccaggccctggagggttggcatcattcgagagctgaggagtgtcccccacccctcagctgcacttgggtctcagctgggatgaactggatgtggacacagtgctgggcaggcgattatcttcatgggcctgggcgctcctgctgttgtggataattatcttggcagtaaggctgggtccagtagtcggggtctcagaagggaaagcagggaagcctgggagagcagccagggagaggggaggcctgaggggagggcctgcctgggccactttccctctttgagtcctgtttcagccccaggtgcacaggctgagaaagaccagtcccaccagggcctctcgctgggggccacaggggcccaggctacagatgacttctgtcctctcctgggctggacaggcccgcacagacctgggccgccacacagaggacacttgtagaacgggggagccgctctgctccagcacctgctcctggaggaagcagagcttgtcctcacctccaggaaggccctgttcctggccgcaggtgatctcagctaacccgtggctcccgctcacttgcccagctgtgcaagcctaggcagaagaaggcaggaagagtgggtgtcagggcctgactgtggggacctgcatgtcttttgtggtctgtcatggtgggtcgccagtgggaagcctccttttcccactagagccaatgccccagttccagggctctgcgggtggcttgaagctttcactgcctgagactagcagctaagtacagaagcgcaaatgcaaaggggcatcagggttcccacggtctttgctcgctgtggaaagcggggacgggcgctgacgcaggccaactcctacatcttcaccagagccctggaccaaatcctgcagaacgtaggttcagcagacagcagacctgaacccgtgtccctgagggtggtcacaatctcagccccaggtggaggctgctgaatgccgtggctgcaaagcagggcgctggggctggggggtcagctgttggggggagggagccctctgacccgccctgcacccctttttccctccctcctctcacccccttgttcccagaagggggcacctacaccttctacctctagctccaggcacccactccggcctgccaggccccaaaaccttggcatccttgtccttaagcccaagggacccgctaggcattcccttggcgccaccacattgcgtagggggccccatgccctcccccccgaccctctctcccctacacagtactgcgaattttgtaattgttagtacagctagtgtcctcatttaaaaccttctagcagtaccaggctatagtggaaacaaaatcccctcccccgacaccccaaattcacactcctgctgggagttgtgggaagtgcctgtctccccgctcctcccatcccagtctctcatgaaaacgtctgacaggtgaaaataccatcttccggtagggccaatttgctcatccctgattacggcggaggttcagcatcttgcagtcagcagccattggggcttcctttgtgcagcgtgtccggcggcctggccctttcctcgttgactgatagtagccctttgttgggagaatcggccctttgttaaccactgagttatcatgggttctccccagtttgttgcacatcctttgattttaaatatgtggtctaggcaaaatgttgccatttgtaatttaattaaatttttcaacaatgttccctgtggcttctgcttttttgttgtgctcagaaaagccttccggatcctgagatcattaaatagtctcctgtgttttttccaaattatgtttgtggttttgggtttttgcatttctatttccgctccataaggaatttatttccgtgtgaagagtgggatcaggatccaacgtcatgtttttccagacaccaaggccgcccagttgctccaccaccctttattattattttattattatttttattttttttgagatggagtttcgctcgttgcccagactgaagtacaatggcgtaatctaggctcactgcaatctctgcctcccaggttcaagcgattctcctgcctcagcctcccaagtagctgggattacaggcatgcgccaccacatccagctaattttgtcctttttttttagtagagacagagtttcaccatgctggccaggccagtctcaaactcctgacctcaggtgatccacctgcctcggcctccaaagtgctggttataggcatgagccaccgtgcctggccacacccttttttaaatgacatcctttccctcatggatttatttatttattaattaatttattttttgagacagagtctcgctttgttgctcaggctggagagaagtggcacgatcttggctcactgcaacctccgcttccaggttcaagtgattctcccacctcagccacctcagtagctgggattacagccacccaccaccatgcccagctattttttgtatttttagtagagacagggtttccccatgttagttaggctggtctcgaactgctgacctcaggtgatccacccgcctcggcctcccaaagtgctgggattacgggcgtgagccactgcgcccggcccctcgtggattttaaatgccccattaatcatatgctaaatgatcacacagacctgctctgatgtgtgtgtccagtcaactgcccatagcaagatgttctatgatggattctactctctggcagggctaaagcccccttttttatttttcagaattttataggcttttcattctttttttattgtagtaaaatatatgtaacataaaaactactatgtttgccatttttaagtgaacagttgagtgacatcaagtgcattcacattgttgtacaaccatcaccatcctccatttccaccgtccatctctactgtccattaccaccatttatccccaccctccatcaccacccaccatctccaccctccatctccaccgtctatcaccaccctccatcaccaccttccatctccacccttcgtccaccctccatctccatctccaccatccatcaccactctccatcaccaccctccatcaccaccctccatctccaccctccatcaccacccaccatttccacgctccatctccaccatccatcaccaccgtccatcaccaccctccatttccactgtccattaccaccatttatctccaccctgtatcaccactcaccatctccaccctccatccaccctccatctccatcttccatttccaccgtccatcgccaccattcatctccaccttctatcaccactcaccatctccaccctccatcacccaccatttccaccctccatctccaccatccatcacaaccattcatctctgctgtccatcaccaccctccatttccaccctgcatctccaccctccatttccaccctgcatctccaccctccatcaccaccctccatctccaccctccatcaccaccctccatcgccaccctccatcaccaacctccatcgccaccctccatcaccaccctgcatctccaccctccatcaccaccctccatctccaccctccatcaccaccttccatctccacccttcgtccaccctccatctccaccgtccatcaccaccattcatctccacccttcatccaccctccatctccatcctccatcaccacccaccatttccaccctccatctccaccatccatcacaaccattcatctctgctatccatcaccaccctccatttccaccctgcatctccaccctccatcaccaccttccatctccatcctccatctccaccgtccatcgccaccattcatctccaccatccatcaccaccctccatcaccaccttccatctccacccttcatccaccctccatctccatcctccatctccaccatccatcaccaccattcatctccaccctccatcaccaccctccatctccaccctccatctccatcctccatcaccacccaccatttccacgctccatctccaccatccatcaccaccattcatctccgctgtccatctccaccatccatcactaccatccatcaccactctccatttcgactgtccatctccactgtccattaccaccatttatctccaccctccatcaccactcaccatctccaccctccatccaccctccatctccatcctccatcaccaccatccatcaccaccctccatcactatcttccatctccacccttcatccaccctccatctccatcctccatctccatcgtccatcaccaccattcatctccaccatccatcaccactctccatcaccaccctccatctccatcctccatcaccacccaccatttccatgctccatctccaccatccatcactaccattcatctccgctgtccatcaccaccctccatttccaccctgcatctccaccctccatttccgctgtccatctccactgtccattaccaccatttatctccaccctctatcaccactcaccatctccaccctccatccaccctccatctccatcctccatcaccacccaccatttccaccctccatctccaccatccatcacaaccattcatctctactgtccatcaccaccctccatttccaccctgcatctccaccctccatctccacccttcatcaccaccatttatctccaccatccatcaccaccctccatcatcacccaccatctccaccctccatcaccaccctctatcaccaccatctatctccaccctccatccaccctccatctccatcctccatcaccaccaactatttttaccctccatctccaccatccatcaccaccctccatctccaccccccatcaccaccctccatcaccaacctccttcaccacccaccatctccaccctccatctccactgtccatcactaccctccaccctccatcaccaccctccatctccaccctccatcaccgccatccatcaccaccctccatctccacccttcaactccactatccatgtccaccatccatcaccaccctctatctccactgtccatgtccaccatccatcaccaccctctatctccactgtccatcaccaccctctatctccagcgtccatgtccactgtccatcaccaccttctatctccactgtccatcaccaccttctatctccactgtccatcaccactctctatctccactgtccatgtccactgtacatcactaccctccatctccactgtccacgtccaccgtccatcactaccctccacctccactgcccatgtccaccatccatcactaccctctgtctccactgtccatgtccaccgtccgtcactaccctctgtctccactgtccatgtccaccatccatcactaccctccgtctccactgtccatgtccaccgtccatcactaccctctatctccaccgtccatcaccaccctctgtctccactgtccatgtccaccatccatcaccaccctctatctccactgtccatgtccaccgtccatcaccaccctctatctccactgtccatgtccaccgtccatcaccaccctctatctccactatccatgtccaccgtctatcactaccctctatctccactgtccatgtccactgtccatcaccaccctctatctccactgtccatgtccaccgcccatcaccaccctctatctccactgtccatcaccaccctctatctccagggtccatcaccaccctctgtctccactgtccatgtccactgttcatcacccccggtctccactgtccatgtccaccgtccatcaccaccctgtatctccactgtccatgtccattgtccatcaccccctctgtctccactgtccatgtccactgtccatcaccaccctctatctccaccgtccatcaccaccctctatctccactgaccatcaccaccctctatctccactgtccatcaccaccctctatctccactgtccgtgtccaccgtccatcaccaccctctatctccaccgtctgtgtccaccgtccatcaccaccctctgtccccaccgtccatgtccactgtccatgtccaccgtctatcaccaccctctatctccactgtccatgtccaccatccatcaccaccctctatctccactgtccatgtccactgtccatcactaccctctatctccactgttcatcaccaccctctatctccactgtccatcaccaccctctatctccactgtccatcaccaccctctatctccactgtccatcaccaccctttatctccactgtccatgtccactgtccatcaccaccctctatctccactgtccatcactaccctctgtctccactatccatgtccactgtccatcaccaccctctatctccactgtccatcaccaccctctatctccactgtccatgtccactgtccatcaccaccctctatctccactgtccatcaccaccctctatctccactgtccatcaccgccctctatctccaccatccatcactactctctatcttcactgtccatgtccaccagccatcaccaccctctatctccactgtccacgtccgctgtccacatccaatatccatttataccatccatcaccaccatccatgtccattgcccatctccaatgtccatcatcaccacccatcaccaccatccatctccagaacttttacctcttcccaaatttcaagtctgtattcattaaacagtcactccccatgctcctcctgtcagctactatctctatgaaagtgactactctagggacctcacataagtgggattgtatggtacgtgttcttctgtgactggcttatttaactcagcataggatcctcagggtccatccaagttgcagccagtactggaatttctttcctttttaagactgaatactattccattttgtgtgtgtgtatctcagtgcagcagggctctgatacccccgctcctcaccaagactggtttgccaggactgcatctgcccagtcccagcgggtgggaggtgggatctcactgtggttttgctttgcatttcctggaggatgctggacatttcccatgtacttgttgaccagtgtgtgtcttctatggagacgtgtctattcattctcctggcacctttagtttcctaagggctttggaatcatcatggagctacttttactggggatcattcaatatatggatcaatttgggggcattggggactcactccttcttggttttcctttcctggtctcctctgtgggttcctggcttggtttgagttgtcctctctacccctccaattccctacccccactctgtggctccaagcattgcccacacttgccccccggctcggtcctgggctcccaaatgccacgggacgactggcccaagtgtgctcaggtctctccacctctcaactgccgacctccacagctgcagctgctctcctggcctagcttcccagccaagtgacagccacgcgcactgaccagtgcaggcagagcactgggcaccaggcttgcctccccctccctgtcgagaaagtcaagcgtcctggcaaaagaaagaaaagcacaaatagagaaaatgacttttgtgaagggtcatttaccaaggtgtgaacaaggagcaggccaagccaagaaggtagagaagccctgggtagggcaggaaaggatgggcagggctggggcctctgagggacacgtctggctccagctgggaggaagcctgggaaattcctaagctcacctggaagcaggtgtggtggggccggaggggcagacccagaacaaccagtccctccctgccacctacccacccacacaattgggcagccagttcgtgcccactcttcctcccaaatttccttctctctccttcctctgcttccacccccccccccccccgccctccagcccagggcctgtggttggatgcctggttgctccctccaggcatgttttgccatccactgactttgacacccggagctctctctttcaaaccctcatcggagcagatctcagccagcatcaactcacattatccttgggaagaaatacaggcacccggatcacctggctgcaggtccctcccctggcctccctcctccccaaccttgcaatccaagctcctgccggagggtctttcctgggagccagcccggagtgctcactgccctgctctctccctaggcaagtgagttcccaccaggtgcttggggtggggctcccgccatactcaagggcgcctcttgactccctctgaactcgcaatcccgccccagggtccggcacaagggctctgctggggctgagatccgtgaaggcagatgcggagaggcgccgctggattgcgagcaggcccaggtgcggggccaggtgggcgttgtcgcagccgggaacgcccagccgctccagctgcccacaggacaaagcccagggttccccggccgggcgcacgccttccacattctccctcacctccacgccttcgctcactgcgttccccaacacctggaatgcagcaatgcccttcgggcacgctgccccgcccccacgttgatcccgtcccctagcttggctccagggacaccggatacgcctattgtagcacccggcaaggagcgagcagtccgcgggaacttacccaggaaccccgagcgcctccgtagttcccaaccccacccccacccctcggccaggtcaggtccactgtgggcgtccaggtaagacggcgtcgatgcccaccaccatcgcccccagctcagcccagagcgcccggggtcagaggtggagatgtcggacatacgcccagtctggccaggctcgggagggaaaatctgggagcggcctctggaactcaccctgactccttcaccgtccgctcctctttttggcttccggggccaaaggttggggactcgaggcgcggctggagcctacagctcctggagcgtagttaagcgttaacccgctggccctgggccagggcgcggggctgctgtgcgcacccggttccgcccgtcgagctggggccggaccgggaggcgaagcggggggcgctgccgagacgggagggcatggggtctgcgccgggtgcgagatgagccggggaggccagcggggcctgggcggtgggggaaggtgggcctggggcaggggcgggatggcggctcgccaagcctctgccgaccggaccacgcgcggggctaccggggcgggctcacctggcggccgcggacccgccctaacctggtttccggcggggcggcgcggggtgcggcgcggccgggcgggggcggggcgggcgggggcgtgcccggggcggggcgttccgggggcggggctgagcctcccgcagacgtcagggacccgcgcgcgaggccgccggcggccgctctgccgtgggctcggcccgggctgccacgagcgtgcgggcctcgccgggcatgtcctaggcggcggccccgcccagcgctcggccgggcgggcgggcgggcgcgagggcagggaccgagccgggccgagctggggaacaagccggggaccaagccggggaccaagccggggactaaggcgagccggagaccgagcccgaacagcaggtaggacgcgccggcccagcgctggccgcggcccgggcctcccatcgcccgcacctgcacggctgtggggtctcacggggcgcggggtcccggccgaggccggacaaaggcgcgggggttgggggccgcccggcgcacctggtcaggcgggtccccgccgccgcggaggcggccctggtctgcgccaggccgggaggagccgccccgtttctacgcggcctgcggagggggcggcaagcctgggcacccgggtccccgccccggcaccggctcggccatggccgcccccggagagcgctgattcagaaggcgccgctccctcccccgccgggcccggccgcctccctcctggcctggtctctcctcccgcggtccctccctccgtcttcctcctcctcccctctctcctcatttcccttcgccgccgtctccccgctgtccctgcctctcccggcctgtgcgctccttccaccgccggcctgccccgcccggctcgctgcccttccctgccctgggcctagccacctttccccgcctcacctctgactgtggcccttccggccggggcggctgaggggacaagtttggggcgtttattattcttcctcctagcaacgatggccagcccagccccgaggcagccgaaggccgttttggagcgtcgcgggctcccaggccttttcagggtgggcggccggggcagtgggtggcctggctctggcacagcggcaccaccaggctctggggctcggcttcatttcgccttaaacagggaccgtggactcctcagggcgggccgcggcaggtgatggcagagggtgaggcctaggagggctggctgggggccggaggtgcaatggtggggtaggccctgcccgatagagcaccctgtggtctcccccagcagccctagggagggtggggctgtagaggcctcctggaggctttgctgtctggggctgcagggtcatcgaagtgccagccccttggcctccagtgcctgcctgtctggctggagctgggtgcgtggcttaggaagggcagggcccccagagtgagagggtcctggctgcctggagctgccttctcctggtgaggatttttctacatcttcccacctccctgcccaaggtgagggtttaccatggggcacgtggtcacttgggcattcatgctagctggagctgggtgttggttttccctgctgctcaccgaagggagctgagatctggtgaagagcctcaaagctgaagaccttgggcgtgggcactgggcaaagtagggacaaggagccactcactcctctgcctggcaccctcatgtggtgtggccctgccctcaggatgcactcagcccggcagcctccccttctcctctgctccactgggcctcagctgctgtcatccctgtcctgggttattgtcctcacttcttgactggcctcctgagtcacagccccatgtccactcaggagctctggggccggcctcacaggtatgtgacttggagacccccacagagcccttgcttggaccccgcatgtggcatcttgctcagctctccttctcagtttttgaataagggtaccgcgttttctttttgtgctgggccctgcagtgatggagccagtgctgggccctttagggacttcatccccttccaggactagccacaggactcccaggggtatgtgaggccctccatccctctgccctgtccctctgccctggtggcaccagctgttccctctgcctggaatgcagtcccacaagcgttcatgggctcacttccacccctgtcctgctgagcctggaggctgcctcccagtgagcccccatccccgccctgcctctgtgttccctgtatccctctttgcaccttctcataagccgtttctgttctctgtgcctgccccctgctgaagggagccccaggattctgagactctgtgtcttggtcacagctggcttagcccaggccgcctagcccatagcagcactcaggatgtgctgggcagtggggtggagtgcccaggacatgtgtgctggcatgctccgggcttgcagggtgcatgctggctgggtatagggctgcccagggttgggtcttggggtgacatcagccctggccattactcaggctgtccccgttacctcccaggctgccacggggctccctgcctgtctacaccagcccctcagaccaccccctctttgttgatgtcactgggactatgggcaccaaagcctcacttccctcttgggcactgaaggggctgcctgatgctgtccttgcaccatgcccaccaaaggacatttggcctcctctcggtggtggacatattgctgactcagggcccctgtctccagctctgtccctgctgcccctcaccccaggccctgcctggggctcagtctcagagtgtcctgctggggggagtgggtcctcttgttcagtgtatgtcttggggtgggtctggtgctgtggacctggcatcatggggaccctgatgggctatgctgggtcctacccatgagctgctcctgatgggtcacgtggatgtggggtcacttacaggcagtgcagccagtgtccccatgaacttcaacccctgacacctggaagatagaggagatgaggtgtgctggggcctggaggataagggagaaccaggcagcctttgccagggatggacgtgatgggaaaggccggtcacgagggcaaaggcctggcagtgggactcgggaccatacccagggagggcgggtggcctgatgaggctggagcccagcttctccggaagctgccagcttcccttagagggtcaggatctgggctgggccttggatgtgtccagggggctaagaaccaggccagggagccccactctaacaatcccctcttccccagggccagacgggcccagccagcaccaagatgagtgccacgtcctggttcctggtgagcagcagcggcgcccgccaccggctccctcgggagctcatcttcgtggggcgtgaggagtgtgagctcatgctacaggtttgcagggagcgcttggggccaggagggtagggggtagacagtctgtccctgtggaggccaggaaggtgcccaccccacttgctgcaggccaccctggcgaggaggccgccatgcagcccaggctgggcctcttaacttgggtcccggatgcaccgagggctctggggctcccgtgggtgcgtgcaggggtgtgtgtgtgctcacaggctcgggtccctgccccgtacgtatccctgtctctgacaggagggggcttaggcttttgtcaggttctcaaagttgttggggtccctagaagcgtgagttggcgtccttttgcagagagggagctgaggctgggctttggaaggtcctggaaagccggtctgtccatattcttgttgtctgggggccccgtctatgctgtgagtgctgcctgagcgggggtcccagtatcttggtcccagctgcaccctggtgaaggctagtgccttttggcggcctccaggcatgaggggttcttctcagggcatgagagcctgccgagcaccggcactgacaatcggaagtttctctggccctggtttgaggtctgagtttggctttgtggggcttgcgatctggctgtttgagaacaaagagcaggggtggtgagctaaccccataggcccatcctggcctgatgtccttcctctaccccgtgtgcctgtgaacgagttgggctccctgtcctggctcatcccccagcgtggcacgtgggcccctgacccaggtggatggcactgtccagtctagccgaggggcctgcaggtgcagggagctgccctgcccactcagacgttgcctcctggatgcaacgtgctactgccgcacatgcccgggccatgccaggctctgacgaggtgggcaggcctcaggctgtggtgaggggtcctggccatgtgcacattccctggggcagacagtgtttgtctgcctctacccagggcagccccacccgatattgctgcatgtgtcctgctgtggcgggaaggtttgtgtcccctgcaattcggaggttgaagcttcatttccagcgtggtagcttcaagagatggggcctttgggaggtgagcagggcgtgaggctttgcccttgggaatgggatcagggaccttaaaaagaggccagaggaagctggctcaccccttctgcccagtggggacgcagcattcaagataccatccttgaagcagagacagggccctctccagacaccaaattggccggcgcctagatctcgggcttccagcctccagaaccgtgagcaatacatttgtgccatttccacattactcaggaattttgttacagcagctgggatggactaagtccagacatcccagcttctccccaggcgtcctctgatcctcttgagtctggacccagcaggtctctcaccttgtggttggttgttccggctctgaagttctttaatctggaacattctctcccttttttctcttttctttatgcctttggtagcgggagagagtcggtggctgggggcaggagtcggcaaatgttttctacaagggcctggtaaagattttaggttttatggaccacaaagtatccactgcagcccaggcctgtggccgtggtgaggggcagccagggagcgagcgtgggcgaccgaggtgggcgcggcagcacctgcacttcatttatggatgttgaagtatcaatttcccataattttcatgtgtcatgaaatagccttttgatgattttcaatcatttaaaagtgtaaagatcattcttagttctcaagccatctaaagacaggcggcaggccataggccacgccccacataccccactgcctcatggggccgcagctgtatttggcgggttgctcccatggtctgcgtacaggggtggcatcagtgatggccgcgctgctctacctagggtggctaggagggcttcttggaggcggcggcactttggagcctctggaagaagccagagtcagcctgcaggcaggggactggtgtgggtgctcttcctgccccacccctgcaccaggcctgctctgcctgcttctccctggggtaggggaaaagtgctgggggcagggtgctcagggtgagtttggggtccgattccgagtttctgcacctgtcagtggagccctgagcaggtcgggagtgttgggggcttcccagctctcctcagtggccgcccctggcctgggtgggcctgcatttctacccctcgctgttgtgggtggtgtcaccattgtaagatgtatctccatggggaaactgaggctcagggaggccttgcaggtgtggcgagtgtgggaaggctgtctgcctcccggtgcccctgcagcggcctcctacctgcccaccgctgccccctgccggcctctgtcacccctcactccctgtgcacctgccctagaggcttctcacccccaccctacagccccatgtccagccccttggcccctctgttgcccccacctgaggatgtttgcacctgccgcccctccctgcagcaacttccttggcacctgcgccaggacccccgccctctcagctcatgctcaggggcctcagtggccctttccgaacgctgctgcttccccgaggccctatccacctctgctcagatgatccacatgctgcctggagcctgctctgtcctcggcttccagcctcctactggatatggctgctgcactggggcctctcagaggcatcccaagctcggtggctgaaccaaacctgtcaccctccgtcccttccacccggggtccccgccagggtccccttccctctgctcagtgccacccccacccccaccccacgcacagacaggaatgcaggcctccactggacccagcctctccccacacctgccctggctctccggacccggctcacaccgaccttcctgccctggaacctccacaccctgtcccagcgccccctccacagtccttgctttcggcgccacatctttccactgggcagggtgtcaagcagagaccctgccctcccttggcatccactgcagagaggggccagcaaggtgtccagggtccagtcctgtgtaaagaaggtggtactggggactgggcggtcagcagacacctgcctatgttgtgctgaggcccaaggagccgcagcagcaggagttggggccggtgaggagggggaggctgtgggaggacagagctgagctggggctacggggatgggacatggaggggagacaagcagagtgggcggcccgaggcctgggctttcactaggcaagaggggcggtagcttggaccacagcaggtagacgggtaggggagttgtgttccaggcagagctgccacccacgtgctgtcccacggaccacgctgtccagggccctgcctctgctccccacagtgtccttgtgcccagtgcaagcctggcacagagctggtgcccagcgaacaggcgttaaatgacgcaggaacgtggacccaggcaggacttcctgctgtggctgtcactcctgtggtggcccaggctgtggtccagggtgtgcgtgtgtgcgtcgtgtgtgtgcgtgtgtgtgccgtgtgtgtgcgtgtgtgccgcgtgtgtgtgcgtgtgtgtgctgtgtgtgtgccgtgggtgtgcgtgtgtgtaccatgggtgtgccgtgcgtgtgtgcgtgtgtgtgccatgtgtgtgcgtgtgggtgtgccgtgtgtgtgccgcgtgtgtgtgccatgggtgtgcgtgtgtgccgtgggtgtgcgtgggtgtgcgtgtgtgtgcgtgtgtgtgccgcgtgtgtgtgccatgggtgtgcatgtgtgccgtgggtgtgcgtgggtgtgccgtgggtgtgccgtgcgtgtgtgcgtgtgtgtgccatgtgtgtgcgtgtgggtgtgccgtgtgtgtgcgtgtgtgccgtgtgtgtgtgcgtgtgtaagtgtgcatgtgcatacatgtgcatgtctgtaggtgcacacatctgtgtgtgttgtgtgcatgtgtgtgctgcatgtctgtggggaggtgtcctccgtgagagcgtgtgacagctgggatttgcactcttgcgtgctgccccagagaccacagcctgggcaggccctgaccttctgtgccccgtgcatcgagccggtctgctgcgggtgcctgtggccgccaatggggaactcgggtgagctggcaggagggtgtgcccagagccctggctgctgctactgccactcagcacagctgggccaggctgttgccccagagggcgtcagacgtgaactttgggaacatctttattctgttttaaagtgagcacaaattattagacactttccccaaaatccatgtgtttggggcgtcttccggccatgccacacatctgtgtttgcctggctgtttctgcaccgagttccgtccacagcccgggtttctgttgttttaagtcttgagccctgggccgggggccacttctcattggtggctggaggctcggccaagtgaggggctgcttctggttggagaggggagtttctggaagggggttccccatgtgtctccagcgcttcctgcagtctggggaggggcttggcaggagcaggtctggtgagaaagccctggccgggggtggaggctcagtcctgggagtgggcggggcagctgggctcggggtgttaacagggtcctgcggggggactctgtgctgagtcaaaggagccggaagctggtgtgggccgggtggggtggggaaggtgggtgcaggcaggggagggggcttggactgaaggtgagacccaggcctgggcaaggatgcggtgtgcccagagctggcagagtcatctgcctgaagcctgactgtggcctgggtggggtaaggaaggtttggagaggctttggggcctgcgggaaagggggctgtggagagagaggctgaccgagggctgccgagaggaagaccagtgttgctggagcctgtggtggagaggggcttggtgggtgaaccctccagggaaggcctggggcagggctcagaggacctggaaggtgtgcagagttgtgtccagcaggagctctcgaggcccagcgggtctgaggctaggggagcagcagggaggcgtccaggctggaaacccctccagggtttccactcctcagcagagatgacatccaagtcacccgccctcagccacctcagccctttccagaggggacaggggcagtagctccttccttcatgcccctgctggaccccatcccctggggaggtctcatgctggcagggagggcccgagcccggccccaggcctcagtgcttcctttctctgagacagcagcaggtccccctggccccgtggagcccatgtgtcgggcgggctgaggtggggatgctgccctgtgcacaggacagggtgcgggagtaggtgagccccaaccccctgagggagatccaggcctcccagcttccaggctgcactctcaggcagggatcctggggcctggccctcagggctgcccacggggcagttagtggcctgaggtgtctccagcagccatcctagagttggggagggggtctcaggacgggcttcttggaggaggtgagtgctgggggtcgcctgtgtctggaggccttcagggacaggtaggaagtccaatggaggaggtgatgtctggcatcacccaccctggccaggatcctcccccaacccctccggcagagactgccactggggtggccaggagccacgtagctgtgggtgccagcttcggagaaggaatttgaacagggtggacctggaggtgggtggtggctatcaaggtcagacccactctcagagacctgtggctttggctggcaggggagctggcaccaggagccccaccaggatccgccttcccagggagggcatgtggggcaggaggagccgctcacctggtttctgggaaaccacgggctgtgtctgggcaggcagctcagggatggctgcacccaggaccctactctcccctttaaacctccctggcacccctgcccacttcctggggggacccagggtcctgacaggaggggtgggctcctcgccaccctccactgtagtccctgcccccggtcctccactgcagtcctcccctcagtcctccactgcagtcctccccctggtcctccactgcagtaccccccaacccccacccccggtcctcctctgcagcgcaaccaccgtggcttgagccaggcacccagggcttctgagtgcccactgctgggtggcagtggcactagcgtgaggctggctctcaggcctgctggccaccacgagccccacccagctgcagcttccctgccctggcacctctgcagaggcctcagtcaagctgggccatcagagcccttgcccccaactagcccctgctgtgtgatctcctctctgagttaggaaggaggccctgccctgagggtttctagcccttgcccaggggtgctggggaaggccccacactggtgtttcatgacggtgccctgtggtggggcagtgatggccagctgccagggtggcctgcacgtggcaggctaagagtgaccagcctgaggggcccaggctctcacctgggagactgagaagccgtgctggcactcaggagggacttccagctcctagtcgtgtgggttgcaggccgtcctgtcccagggctgggggacttccttcaggcccattgctgcctgtggaagctggcctggtgtcttgtgggtgtgctgcctggatggtccctaggtggtggcgagggtcacacgctgtctgggccaggactcggtgacttccctgggtcggctggttctgctggcctttcctggggctggatccccaggcctgtggctcctgaggtttgggggcaggagggatggagccaccacccagagccccaggcagcacagggtgctgtgtggagtggaggccgggtgggcagcagccgtgcttgcagcgctgtgtggagttgggggccgggtgggcagcagctgtgctcgcagtgctgtgtggagtggaggccgagtgggcagcagccgtgctcgcagcgcttaagcaagtagaaagtgactcgcctctgcctccgtctccccatgccccagtggggcagtgatgggggcttggctgtggccttatgattggacgaccgggcttgaccttgtgagggcactagggcacctgtcctccgggggggtggtcctgggtgggctagtggcccagaaagggtcggcagcacttggagtgggagcaccaaaggtgtggacactggctgagagttgtgtgtgttcctgtggggctgggccaggagtgggggagggctccctgagacaagccccctcaccgccagcctggctgccgccacctgaccttgggagggagcagcgtgtgccagatgaccagagggctcccagcactcccacggcccagcggggagcatctctggggagggcggtcatgaggggaggcctggggcagcagcagagggtgggggacgtggccctggcatcttggcgaatcctgctctggagacagggtgggcacagctctgtggtcagaggcctgggggccactgctggtgttgtgctggggcaggggatggagcaggggtgcctctgcctcttgggtgtcacctcctcccctggagcacctgagggctggctgtgtgtctctccagtcccgcagcgtggacaagcagcatgccgtcatcaactacgaccaggacagggacgagcactgggtgaaggacctgggcagcctcaatggggtaagtgtgagaggccctggcctggccttttaacagctcgacccttcagccctggcccctccctctcagttctggctcctcccccagtcatagcccctccctctcagccctggcccctccctctcagttctgcctcctcccccagccatagcccctccttctcagccctggcccctccttctcagctctggctcctcccccagccctggcccctccctctcagccctggcccctcccccagccctggctcctctccaaaatctggcccctctcccagatcgggccccatccccaactacagaggcccccaggcctccccagaaggctccccctggcagggtctcaggccgccaaggatcaggctgctctcagggagagtggaccctgcagatgggaagggaagcactaggctggggaatggggcccctgaaatggaaggagctatgcttgggtacccagtctgggtatgggtggagccatgtgatcctttcttctgtaagttgggggtggcaggggcaggaaggtaacccggagggaacccctggctgcaagagcagggttggggggtcaggtgaaaggaatggggtatggggtggaagcaggcaggaaggctggaggcccctctctgggggcgtgtgtctgtccctgaggtccctgtctggatgtctctgtctgttgctgcgcttggcggactccagcttgtcctgggacactctatctttactgcactctgcagtcctgagctggggggccctagcagcccctcagcagcccctcaaggagctccggccagggggtctcaggctgctggggtctgtcctgagctccctcctcccgcagcatgcctgtctgatgaagcggctgtccctgaatggctgcacagcaagtggccgctcctctgcctgtgtggactgcgtcacccacatgggctttgagagggtccccggggttgttggcctgggttgcatggcaccgtcccagtccgtgctcctgggccctgcatggttggctacttctgaggcctgtgatgcccacagacctgcctcccacctgcctgtgggactggtgcatcaacactcctgccagtaggcagcctggaggggggtatcagaccctctgaggcctgacccttggccaagggccaccacagggcaggcctgcctcgactgttcccaagggctcatggggccaaggtgggggctggggccagcacgaggctgtatgggtgagaggaagcatctcttggagtccacttcacaaagatgctcaaagagttctgttctggagggttccatcatggtccctgcagtgctgggtgggccccagtgtctgggtgcccctgccatggctgtggaacttggggctggtgcctgggacagtgctgcacaggccatcactcgccgtgggttccagagagttggtgcccccgcggccctgcccactgccacccacctgctcagccccaccaccctgcggccctgcccacagccacccacccgcgcagctccccccccccccccgccacctgttttcctgcagacgtttgtgaatgacatgcgcatcccggaccagaagtacgtcacgctgaagctcaacgatgtcatccgcttcggctacgatatcctgcccctgagcgtccctcctcctgggcttcttctcagtccccaggaccacagtcaccctgttactccagaagcagggctgtcactgctggggttgctgggtaacagagcaccaaggatgaccctagggctgggctccacctgctgatggagcaccccaaggaatgccagtccctgcagcccggccccccgtggacaccctggccacgggtacctgctgcttgcccacccacccagcctgaggtcacatggggcctggggaactggtgaccactccctaggaccccgagtcctggcccgaccttgggactgtctgagcacatgggtgggcatggctgtgcctccccgggaagaaagaggcccctcctctgcctgcctcgatgggcccttgagctggcacacctgttgctgggcgtggacttcagcgctgggctcctggctcttctgctctgtgttcgccttaacacgtgtccacattccaacatgtatgtgctggagcgtgtgcagcaccgagtcccggaggaggcactcaaggttagtgctggccaagcccgggtggctcagccacgagggctcagccccccatcctccccaccatgctcccgctgccatctccccagcaaacactcaccaggcctctggggcgccctgttcaggctgcgggtgccatgagtcaggccagcctgtcctgccctgccagatggcccagtccggcaggtgggaaggtagtcattacccccagcctgctgcagtgacaggtggcgggggcaccgggacgcgggtgccactgttgtggatgcagcagcatccgggctctgggaggggcctgggaggagccgggctgcatggtcagcctgctggagctcctgggctttcggagctgcatcgctgggcactggcggatttagctgtggctcacagaacaaatggctcattgggtgagctgggtggccagagcccaggaagctgctggggtcaccctgcaggagagtgcagcggggctgaggcgggggccagcagcctccctgggagcagagggccccgttcagagggccaggagggtatagagcccctgagccccccagcatctttttgggagtgtctctcaggttaagtagctttggggtctcataaggggctttagattctctgacattacagttatttggagtcttcgaagctgaagggattaagagtctctagacagagtgtttagggtctctgaggctggggaatttggtctctctgtgagtgagatatttagggttccttaggctcgggggatttgaggatctacgtgttagaggatttggcgttcctctgggtgaagggatttgaggtctctgaagctgaggtgctttggggtctcatgcccaggggattaagttcgctccaggttaacggatttgagtccttcaaggtggcaggatttggggtcacttcaggctgagaggatttgttgcttcttagggtgaggggatctgaggtctcctgggctgaaatctgaaggtcttaggctgagggtttataagggttttacgctgcacgaccaaggccccccgagttcctgtcagtctctccgatctcctcccgcactgcccgccctggccgggtgccctctcggagcccctcaggaggtaacagctgcccccagcacattgatgaggccgccagcagggggtggccagaggcaggaaggaagggtgctggaggccgacggtggcagccttcaggggtgggcatccttgcgtgccctttccccggtgtgctggcgacacgcacagccggggcccctgtggggggcgtgagggtcctaggtgggaacggcatctcctcgccctcacttgttcatgtgggagttgtggagcacagattcagggccctgttcagagctccccgggagccctttggggccagggcgcttagcccgttcctcggatgatctccgagcagcctggggtcccccagcctgcaaggggcagggcctaagggagtcaggttctgtctgatggcacaagcggccctgctgcccatcccagggcccccactctgatgatcgcagcctgctctgtcctgccccacccaagcaggcccctgctttccctggaagctgcccctccccaggcttgagctggaccccgagccgtgttacctgggcaggctgaggctctgtctgctcttttggggagcattagggagagcttgtgacatgcaaagtcatagctgggccctctggatggagaggagaggctgggcccaccctggtgggttcctcctgaggctgggcccagtacctcaccccgcctggcctgcccacagcatgaaaagtacaccagccagctgcaggtgagcgtgaagggtttggcgcccaagaggagcgaggcactgccggaacacacaccatactgcgaggcctcgaaccccaggccggagaagggggaccggagaccaggaacaggtaggcccaggcagtgcggatggggtgagcacacagggccactgccaggccctctgccccgcacctgcctctctgcaccccttaaccctctgcatgcatataccatgtacacccatacccctcaccctttgcacacacctacccttgcacatgcacacccctcacccattgtgcacacctacccttgcacacccacattcctcacccattgcacacacctacccgtgcatgcctgcacccctcacttctgtacacacctacccatgcatgcctgcatcttcgttatacacaccctactcatgcacacccacaccactcacccctgtgcacacctacccatacatgcccatagctctcactgctgtgcacagacctatcatgcacacccatactgctcacccctgtgcactcacacccccacccctgtacacacatctacctgtgcacacccacatccctcacctcttaccccacacacacagctacccatgcacacccacactgctcacccctgtgcacacctacctgtgcacgcctgcaccccttgagcccacagttcttgtggggttggtgggccaccagctgggcaccctctgtccccagtggtgagaggcaggtgatgggggggtgaggctatgctccctagtatcaggcatttggactggattctgcagaccgagccagcagggctcaggggttggtggtttctgatgaaacctgatttgcgcctttggcagtcagtgcagcgggtaggcagaagtctgggaggaggacagctgcacgagggtccgcgtgggtccggtgggcacaaagggaagggaaggagcgagagtgagaaagtgcctggtggggtgtggaggggtcggggtggggtatccaagcctgaggccccagacttgagttctggttagacaggggtgtatccggggatcaggctctcggctcccacctcggtccaggaggggtcaccctgccacccccagctttggccccatgtctgctgtgttctgctgtcagcccacacatctgtgttgtacagccgcagctgccggtgtctggttgggatgcaggtccgcccagaatggaagaccgctggggactgggaagctttccagaaagccatctgagctccccagagcacctgtcagtgtccagactgtgaaacacatgcagctggtgacagccagtgtggggctgtcccggaggtcatgacaggtgcagccagctgggcagcctggctccttggctccgttagagcgagggcagcacattgtggggaccaaggaggagttcagggccggcagcagatggggactgcctggtagcagatgcccctgcctcagcagcccctgggtgtgtccctgggtcaagagggagtccccagggaggggtaaggcgtgtgtgacacatctcaggggccctgcatccccagcgcagtgtgcacatggttccctatgggtaactggccccagcgcagtgtgcacatggttcctgacgggtgactggccccagaccctctggccccccagcagtgtaagcagctgggggccatgacgcagaggccccctgggcttccgcaaggatggaaagagcttgggtggagggcccaggaaggagactgtgggcatgagggccagcgccctgacctgagggcactggacactgcttctgttcactgctgccatcaggaagggctgggctgccggcttctcagagggagtcaggagtgagattctatctgaaatatacaatttccctcctggtcattaaggcaaacaaactaaaatgccgcagggaccatgtagattgcagtggctgcccacccccagggccacccatttgtggcctgaaccatttaccagccttggaggtggctggacccaggtgtgggctccccctggcctcctgccctctgttggatgcgctctggggtcgggaaggccggggcagggttgcaggacggaggtggggggcccccaccatgccccaggggatgagcctctgagtacatcagaggggagagaggaggggccaggcagggaggaggggccaggcaggcagggagcctctaagcacttgtgggaggaggtggggccaggcagggaggggccagtgagccacctcggaactcaaggtagtcaacattccccacagaggcggggccctgggctgccacagggccaagctgggaggtgatgccagggcctgccccagagtccagcctctcctgggctgccagttctctgcttttcacactgggggccccagcaacacagggtctgacctctcgctccctccacagaggcagcctcttaccgcacacccctgtatgggcagccctcctggtggggtgaggacgatggtagcacgctgcctgacgcccagcgccagggagagccctacccaggttggtcttggggccaggctggtgagaccctgagggctcccagagggtggtgtgtgaaggggatggcctgggcttgaggagcccactccgggggacatggggcctgtctccccctcttgggtggagtggatggtcctggctgaggagggtggtggcaggtggttaccctgaggcccggtctgaagacatcttcccacaccagagcgccccaagggaccagtgcagcaggacggggagctccacggcttccgcgcccctgctgagcctcagggctgctcgttccggcgggagcccagctacttcgagatccccacgaaggagaccccgcagccgtcgcagccccccgaggtgccggcacacgagatgcccacgaaggatgcagaggcaggtgggggcggagcggcccctgtggtgcagagccacgcctccttcaccatcgagtttgatgactgcagccctggcaagatgaagatcaaggaccatatcaccaagttttccctgcgccagcggcggcccccgggcaaggaggccacacctggcgagatggtgtcggctgagaccaaggtggccgactggctggtgcagaatgacccgagcctgctgcaccgggttggccctggggatgaccgccacagcaccaagagcgacctgcctgtccacacccgcaccctgaagggtgagtgcccagctggcggccgtgccagtcccgggacaggcaggggaccggactttggctgggtctgcactgttgccatgcagaggggcccattcagctgggttgacttcccatttttcagttaattgcctaagagccacctgcctggtcaggagtccggtcctgcgtcttcccgttgcacttctttgccctgtgtgggggggccctgagggctggggtgctttgtcaactcagctaaggcatggggtgatgaggctgcctgagatcgacagctgtttcctttctctcggcctgacaaggtggggtcccctgtctcccccaggccacaagcacgaggacggcacgcagagtgactcagaggaccccctggccaaggcggcctcggccgctggggtgcccttggaggccagcggggagcaggtgcggctgcagaggcagatcaagcgggacccccaggagctactacataaccagcaggcctttgtcatcgagttcttcgacgaggacacaccccgaaagaagcgctcccagtccttcacgcacagcccgtccggggaccccaaggccgacaagcgccgtggcccaacgccggccgatagggaccgccccagtgtcccagccccagtccaggcagggggccgcagctcggggccacagagggccggctcgctcaagcgggagaagacagaggaacggctgggcagcccctcgcccgcctcccgaacccctgcccgccccttcggaagcgtggggcgccgctcccgcctggcccaggacttcatggcccagtgtctgcgggagagctccccggccgcccggcccagccccgagaaggttcctccggtgctgcccgctcccctgacaccccatgggaccagccccgtgggccccccgaccccaccgcccgcccccacggacccccagctgaccaaggcacggaaacaggaggaggacgacagcctcagtgacgcagggacatacaccatcgagaccgaggcgcaggacacggaggtggaggaggcccggaagatgatcgaccaggtgcagcccagcggcgagtgagagccctcgtggggaacgggggggtggaggcgatgccgggggtggcgagtgagagccctcgtggggaacggggggtggaggcgatgccgggggtggcgagtgagagccctcgtggggaacggggggtggaggtgatgccgggggtggcgagtgagagccctcgtggggaaccgggggtggaggtgatgccgggggtggcgagtgagagccctcgtggggaacgggggggtggaggtgatgccgggggtggcgagtgagagccctcgtggggaacgggggggtggaggtgatgccgggggtggcgagtgagagccctcgtggggaacggggggtggaggtgatgccgggggtggcgagtgagagcactcgtggggaacggggggtggaggcgatgccgggggtggcgagtgagagccctcgtggggaatcgggggtggaggcgatgccgggggtggcgagtgagagtactcgtggggaacggggggtggaggcgatgccgggggtggaggtgggcggacgttgtcctgctccggcccagccctggctcctgcctctggcccagctgggcaggagggagcctggtatgctgcccacagccccgcccctccccttcccagggctgggtccgtatcccatccgcatgtcctgctgacagccaggctgcatgtcccggccaccagccactctggccaaccaggtccctgctctccctgtggcctgggggtggccagtgtcagtggagggttgggaggtgggcttctctgaccctcggtgcctgggaccatttcctcttggcaggtctttggggtgttggagtcccctgaactctccagggcatcttcggccacctttcgcccagtcatcagaggggacagagatgagtctgatgacgggggcgtggcccagcggatggcgctactgcaggagtttgcctcccggccactgggtgcggccccccaggcggagcaccaggtacaggcacagacggccaccccaaggaggggctgggcaggaagagggcagcatccaagccggacctggggtcagcgggccccccatggggcgagactggactttcctctgagggacacgctcagaggagggtgggctggggcttccatgaggagggatcggggccaggtgtcaggcccactgttgatttgaggtcctgggcaaaacgggctctgaggtcaggacagggccacggctgctctgccaacctggaactgagttctgtgaggctgcctgggctgggcaggcagggggtcgcgttggagcaagtccaggcgaggcaactgggatccctggctgcctttgcaggggcacgcttgctcatgcggcaggccctgggtggcgcgcatgcgtggggctggtgttggctgctctggacgcccctcctgttccctggcaccccctgcttctcgccgttgggcttgcgtgtggaaacactcccaccctcctctccacagggcctcccggtgccgggctcccctgggggtcagaagtgggtgtcccgctgggccagcctggctgacagctactcagacccgggcctcacaggtaagtggctccagtgctgcgggggagtcgggccaggccggggcgggcctcaggccactgaccacggacacaggctgcctcttcctgagcgtggagggcctgcagaccagcggccctctaaccggctgcctttgtgctccacagaggatggcctgggacgtagaggcggggagccggaggggtccctgcctgtgcgcatgcggcgacggctccctcagctgcccagtgagagggctgacagccctgcgggcccagagagcagcaggaggagtgggcctgggccaccggagctggacagtgagcagcccagccgcctcttcggccaggaggagttggatcctgacagcctcagcgatgccagtgggtcggacgggggccgaggccccgagccaggggtggagccacaggacagcagacgcaggagcccccaggaggggcccacgtggagcaggggtcggcgctcaccaagggcccccggggagccaactcccgcctctttcttcattggggaccagaatggggacgctgtgttatctaggaaaccgcttgcggctccaggggatggggagggcctagggcagacagcccagcccagccccccagcacgggatggcgtctatgtcagtgccaatgggagaatggtcatccagctacggcctggacggtccccagaacccgacggccctgccccagcctttctccggcaagagagcttcactaaggagccagccagtggtcccccagcgcccggcaagcccccccacatctccagccacccgcttctacaggacctggccgctacccgggccgcacgcatggacttccactcccaggacacccacctgatcttgaaggagacggagacggccctggcggccctggaggcccgactcctctctaattctgtggatgccgagtgtgaggggggcagcaccccgaggccgccggaggacgccctgtctggggactcggacgtggacacagccagcaccgtcagcctgcgtagtggcaagagcgggcccagccccacaaccccccagcctctgcgggcacagaaggagatgtcgccatccccgccagctgcacaggacccgggaggcaccgccctggtcagtgcccgtgagcagtcctcagagaggcagcatcacccacttggcccgacggacatgggccgtggagagccggtacggcgctcagccataaggcgtggccacaggccccgagggtccctggattggcccagtgaggagcgtggccctgtcctcgcccacctacccagctcagatgtgatggcctccaaccacgaaacccctgaggccaccggggcaggacggctaggttctcgccggaaaccagcggccccaccgccatccccagctgcccgggaggagcagagccgtagctcagccagctcccagaaggggccgcaggccttgacccgctccaacagcctgtccacccctcgccccacacgggcctcccggctgaggcgggcccggctgggggacgcttcagacactgaggctgcggatggtgagcgggggtccctgggcaaccctgagcccgtgggccggccagctgctgagcaggccaagaagctgtcacgcctggacatcctggccatgccccggaagcgggccggctccttcacagggactagtgaccccgaggcagcccctgcccgcaccagcttctctggccgcagtgtggagttgtgctgtgccagccgcaagcccaccatggccgaagcacgggctgtctccaggaaggctgccaacacagccaccaccacgggtccccgccagcccttcagcagggcccgctcaggcagtgcccgatacacctccagtgagtgccagggcgggtgggaggccagggccaagacagggctgccagtgggtctgcagcatcttggatgccagctgagtgctggccgtgggcccctggtcctggcacgagaggagcctctgttcccaaagctggggtagatgtgttgctggactcacgtgcacacacacacgtgcatgggccgagggcagggcccgcagtcccctggtgtgggtagaacaccctgaccatctctggcgtggagagggccttccatcccccagggtgtgcctcagggccccgaagcccaggctggccctccccactcttcctgtactcctggctcaggcccctggtgcctttgggtccccacgccatctgcccatgggcctgaggccctaggcctggggagggctgtcccatggatctctgccgcagtactgtggctcagtgaagggtgccaagtacacctgtgccctccgctggtagctgctctaacacccttctgagcccgcaggccccatgaccagggagggagggagggctgtgagcagagtcctgccctgccccccagatgtccatgggcacagcaagcggggatggtcctctgtggccaccagagctggcctcctacctggggtggccggacatccgcgtctgcagagcggggcccaccccgcccgccgaggcagctgagctgtcctgcgagtggattggtttgaggtcaaggtgctgctgctactgccttctgccctgtgcacccacctacccacccacgatcccagtggagcctctttcctgactcccagcatcctcccacagccccaccccaactgctggctgcactgggcaggccttgcgtatggctggaggctgaggcagggttcgctggaggaaggggtggggcggggccgagggtcacccctgcttggtggagcctgctgtccctacccgacgtggtgcactggtggtgtttgacccaagcatgcggctcgccatcatgccccgctacagtgcaggagcgcagctgctgccaggcttagagcaggggctggtgaggaggccaggactctgcccaggagggcggaacctgaagctttgggtctgacaaactcaagcaggcagcagggagggactgcagtggccttgcttgcgctctgactggtccttgcctgtctgtgtggtccagcctgggccgcagcaggtcctggtggggaggtttactctgttttggggtctgtcaggcactgctttcccaccacctgtaagggggtttcccacctaatcagctgcagactgctcccgggttgcagccactggcctgggagcaccaggccgccttccccgcatgtgccctgggctggtgggggccttgtggtccctggagctcagcagctgttgatgtttcaatgaagggctactgggtgggggcaccagcctcgacgctgcccagccctgcagcactgagccctctcccagagggaccctgggactgccacagggtgctgagtgctgctttgttctgttcttgcttctaaaaccaattcactcaccaagacacgaggcgccggcagcagggctcggattacacgtccacctctgaggaggagtacggctcccgccacggctcccccaaacacacacgctcccacacctcaacagccactcagaccccgagggctggcagctccagccgggctcgttcccgggcccccggcccccgggacacggacgacgatgaggaggagcctgacccttatggtttcatcgtgcagacggcagagattgcggagattgccaggtgagtagcccattcagagtaaatccactgggtgccagtgcgttttcttgagtgagagcaccctgagggcagggaccaggctgggagctcccttcttgagtggatagatggtacggcagatggctggctggctggatggatggacaaatggatggatggatggatggatggatggatggatggatggatggatgaatggatggatggataggagggtgggtgggtggatggatggataggagggtgggtgggtgggtggatggatggatggatgggcaggtgggcaggtagatggataggttgctgggtgggtggatgggtggatggctgggtgggtaggtgggtgggtgggtggatggatggatggatgggagggtgggtgggtggatggatggatggatgcatggatggatggatggatggatggatgggtgggtaggtgggtgggtgggtggatggatggatggatggatgaataggagggtgggtgggtggatggatggatggatggatgaatggatgagtgagtgggtggatggatggatgggtgagtgggtgggtgggtggatggatggatggatgagtgtgtggatggatggatggatgagtgggtgggtggatggatggatgagtggatggatggatggatggatggatggatgaatggatgagtgagtgggtggatgggtgagtgggtgggtggatggatggatggatggatgaatgagtgggttggtggatggatggatgagtgggtgggtagatggatggatgaatggatggatgggtgagtaggtgggtgggtgggtggatggatggatggatggatgggtgagtgagtgggtggatggatggaaggatggatgagtgggtgggtggatggatggatggatgaatggatgagtgagtgggtggatggatggatgggtgagtgggtgggtggatggatggatggatgagtggtgggtggatggatggatggatgaatggatgagtgagtgggtggatggatggatgagtgggtagatggatggatggatggatggatgagtgggtgggtggatggatggatggatggatgaatggatgaatgagtgggtgggtgggtggatggatgaatggatgagtgggtgggtggatggagggatggatggatggatggatggatgagtgggtggatggatgggtgggtgggtggatggatgggtgggtgggtgtgtggatggatgggtgggtgggtgtggatggatggatgagtgggtgggtggatggatggatggatggatggatgagtgggtgggtggatggatggatggatggatggagagtgagtgggtggatggaggggtgggtggatgcagatcttcccaggaggtgagaccgccagtacaaggagggcctcctcaaaggttttcattagaaatgaactccctcacatggtcattcagtaacagggccctctccaggccaggcgctggggaggatggggtagggagttgggtgggagtgagagtggtctttgccaagcagtggtcagtactgcaaaggcagtccctgaaaggctgtggggcaggcagggggggtcccaggaccagggtggatggcaagtgtttgttgtggaggatgctgagcttgaagcccatgagggacctggaaggaggtggccaggagcaggcggcccttagagagtggcccacactggggtggaggcgcaggcacctgaggctgtgagcagcatgaagttggtggggaggacctggggggcttggaaggatggggactggggacagggctcttgggatgcttgaggtattgggggagcatagggaagaaggctgccatcagcggaggaggctagcacagggctagggctctggacagagacactgcacctggctgagaagggggtgggtgcttccaggcctgagagcagaaggggatgtggggggcccatgtgggtttctggagttctctgccttccatggtgggtgagctggagcatgccatatgacgggggcaggaggccagggagtgctgggcgggggcctgagggccaggggcatgtgccagttggtgtcacccagaggtggagggagggcttccatgttttgtcttgatgtggaatggtggacccagctaggacccagtcctgaatggggccagggcagccagtgggatgtgcaaggccatctgggcagagggtgctgggggtgtttctctggtcgtgccagtgtctggcgagggttgtggtgccgctggaggtaggggtagggggagggccctcagggtggtctgttccttgggtgactgccagtgtgggggccgaggaggcttggggtggggcctgtccccatgaggatgggtggttggcagtgacagggagcctaggtccccacggcctgggctgaaggcctaagtggggcaggacctgctggtggcccaggtgcttaaggggccagcaggacagctgacgaggctgtgcgctccagcagagggctgggagctgctcacgggcccggcaggcccctgtcctcgctgggaagtgtctgttacctcggcagggtggaggcctgtgccccctgggcacatcctagggggactgagctggccaggcttgagcagggggctaggctgagctgccattggcctcactggcctgcaaggggtcccctccctctctggatctgcccagccccaccctctgcccagccccaccctctgcccagcccccaccctcagtgtgaggagtgccaggctgtagtttctgtggcctcagcccactcccttccttgcctcagtttctctgcctgcagagctgggcacccgtggcacccacacgttctatgactgagtcccatccatcccatttgggccccgcagctgtgatgctggccctggggggccggagagagaggaggtgtggcctgccccagagccagcaagggtttctgtgcacccttcttttcaggctccgtcccagccccccaccatccctccttgtggctgtggggagtttggcctccctttggggccgtggccagtgcctgtgtaaccagtggctaggccggtgtttggggccaggctggggagcacctcccccaggccccacctctggccagcagctgcctgggagctgggaggggctttgaggcctgtctggcccctgctgccccgacttcctctgtgcagaacctgccgtctttcctgccggctgcaggctgagccagacgctggtgaaggacgtggccatcctagcccaggagatccacgatgtggctggggacggtgacacactgggctcctcggagcctgcccacagcgcctccctcagcaacatgcccagcacccccgcctcgaccatctctgcccgggaggaggtgagccccaggctttctgaggcccctgtgccagagccaccctcgaggagggtcaggccaggtccccacagccctttgcatgcctcggctgaggccctgctgcacatccccacttggcgagctggaacatgtccccctgggtcagcgccccaaacggccaccggagagctcgaggtctggggcgctcgtggcacctgagtcaagcctgactgtgccgtcatccccagcccagctgcctccatggcggggcaggggcacaggagggaccttgcacagacggaaggtgggtgtgctctgtccacctgccgggccggagcagggaggtgcagccacagcctggcaggagcctctgcctggggcccacggtgccggccctccctcttgcagctggtgcagcgcatccccgaggccagcctcaacttccagaaggtgccgcccggctcgctgaactctcgggactttgaccagaacatgaacgacagctgtgaggacgccctggccaacaagacgcggcctcggaaccgagaggaggcacggtgcccactaccgccacggagctgggtgtggggggagcaggggcggggctcctcgagggcggggccatgctgaggccgggctcttgcaggtgatcttcgataacctgatgctgaacccggtgtcccagctgtcgcaggccatccgtgagaacacagagcaccttgccgagaagatgaagtgagtcggcttcctggctgaggtggacgcccagacaccagcacagctgcatgagctgagactcagcctggctgaatccctcaagggcagcggtttcatgggtactcgtgtgcacctgtggagcagccctcccgtgtgcacgtgtatgtggctcccagcaggcagaccctgaactcagaggagccagcgcctccagggcggcccttcctccccttctcccctagccctcatcccgggcccagccctccccaccgccgagtgtcaggcacagatgggactttggtgcccttcatgcatcaggcctcagtttcccccttaggcccaggtgggctgggatgaacttcaccatggcagaggaggtctgggagaattgtgcctcagctctgtcatctctgtccttgtccccccatttctgcctccccctacctcggacaggatcctctttcagaacacagggagagcttgggaggacctggaagccaggatcaacgccgagaacgaggtgcccatcctgaagacatctaacaaggtgagcgctggggccccgtgccccttggcctgcccccagccagcctgcctttgcctggctggccccaaaccttgtcccagctcctgcacacagagccccggggcagggctgcagcccgtcagaagttgactccacctcccttcctgccacgtttccaggaaatcagctccatcctgaaggaactgaggcgggtgcagaaacagctggaaggtgagtgtggcccaagcctggggcagcaagggaggctggcagggccttgtggggaaccctgactcacagggtgggagcaggtgaactggatccgcagcctgaccctccctccccacctccagttatcaatgccatcgtggaccccagtgggagcctggacctgctcacaggaaacaggagcttggccagctctgcacagccggggctggggaagggccgcgtggctgcccagagcccaccctcacccgcctcagccgaggccctgctgccagccctgcccctgaggaatttcccacagcgggccagctgtgggcctcccagcctcccggaccccaccttcctccctgatgccgagaggttcctgatctaggccccagacctggccaggccagcctccctgtgcgtgtgcgtctctgccttccgtccgccgcacacccgcctgcctggccgcaggtggttctccctgaagacccccacatgtgccatatccctgtgggcgggtgcctcccacgcccttgccccctcgtcagctcccagccagcaccctactcaccctgtccagccccatggccacccccacccctgcctcgccccctacaggcctctgggcccagctcctggccaggctgctgccaaggtcaagccctcaagggcattaccccgcctcctcttcatcactgttatttttgtctttagctttaaaggaaagagttgttggtgccattgcaggtgccccctccaggcctgactggctccgccaggcactaacctgccataaccctttgtgctggcctgcggccaggcagaggaagagaggtcgactgtggggtcatttggtgccaaacatggaggtgggcaggctcacctgttcctgggactgtctgagatggcagggcacttgccctggtggctcccacctgaccccaggccttttataggcaggagccccactgcttccagcctctggtgccaacacagttgccaaacccattgagcttggggctgccctgtggaggcctcctgggtatggaccaggggcttgttgagagctgagccatgcacacaggtgcagacaccccccaactcccatgcacacggctagtccaggcgcctccacgctgcaccgtgaggactgcagggcatgtccccgtgaggggctatgggcctctgtaggtgggcttccaaggtcctgggtgcagccgggtgcatggcagcccttctggcgggggtgagcgcacgaccaaagtcactggaagccgggtttccggaagctcgcagcttggcctgcaccacacgccctccccttttggcttcacgccatcaggcctcaagtgggcatgggggcagggacgggcccaggaactgttgttttctcaggattctttcagctgggaacatggcaggtgagcagagcttggtgcctctgccgtggcccctgctggggcagcccgtgttgccggagcctctaagccaaagagcccgttggccgtggttggtgggggtggacgtgggggtgtcccacctggaccagactggcgtgggtgagctccacaccctgcctggcaatggtatgagagtcggacctggacagggccagctgctgggggagcggcactggggactggaggctggaagcgggtggtgtgtgtcccctgtttacttttagctgagctggggttgggtgtacgggttctgttcctctgagcctgcggcccacctgatgtttacgtgtgtgtgtgagggggggcgggggtggcaggtgtccccccctggtccccgccccaagagcctgctgtctgtatggaggaggtgctagcccggtccaccgggctgctgcccacccctgcatgccccagttgcccaccccgcctgcccctggacatgaagtggtcacgcttcatccacggctccttcccacccctcggcagtggctgtgcaatgttttaagttcacaagttcctgctcctccccacactgagctcctttgttcctccccctccagcctttgcctgggaactggtccttgtttgccgggcttctcggagggttcactgtacattcgttctcaggtggtcttgtggctgtctttcggaaaatggttattttatatgatttgtcatggaatttgttctaataaatcattcttctatcacatggcagcacgctggagcctgtcaccttggccttgtttctctatccttggtgtttggggtgggtggggccctgcacataggacagaccaggggtggctgcaattcagagatgctgccaccaggaggcggcctgggctagaaagcagcatttccagatgtttactcctaaaaaacagaagagttaatttatgaaaactgttcagtgagacagcatccgagagcgctgtttttgtttgtttgtttgtttttgagacggagtctcactctgtcgcccaggctggagtgcagtggcgcgatctcggctcactgcaagctctgcctcctgggttcacgccattctcctgcctcagcctcccgagtagctgggactacagtcgcccgccaccacgcccggctaattttttgtatttttagtagagacggggtttcactgtgttagccaagatggtctcgatctcctgacctcatgatccgcccatctcggcctcccaaagtgctgggattacaggcgggagccaccgcgcctggccgagagcactgtttaaaaccccgctcatcctgcataaaaataggcagtaagcaggcacacagtccccgtgtggtgagcaccacctcccgccccagttccttctccctgctagggcttcggaggacacccactgcccgttgttacatcacgtcactggcacccatcacacccgggttgttggaggtgtcagaggtcactgtccacttccggccacagggcgggccccacggtactgatgtgttgtccggctgccaggctaccaggcagtggttcaggtcctcagcaaggctgaccttgagaccctggcgggagtagcagggcgggcttcttacctccgcagcccagccgtctggctgctccgagccccttgtccttccactccctgcggtggccgtggagaggacatcgccagatgttcctgggtggactgcctttatgatgccaccctcccctgcccttggggatgcatttgagtttgcaagggggtggttgagccgagcggcccgccgagaacttgaggacagggctccacaggcctcatgcagccactcggggcctccacgccttgtcttgcatctgaaccatctgaacgccactcccggggccacactggaggtggtcaccgctggcccggcccccttaacgggaggccacagggaggactgtgggtaaggccaggtagtgagaccttagtctgggcagcagactcctgagggccttctgagtggggccccttaacgggccttcccagagacccaggacctgctggaaagtcagcctcaacagacgtcccagggcccacggctgtggaaggtgccgggggtgcgccagccctagggtagggctgggcctggcgggccagtgggcggtgatctggtttggtgggctcaacattccaggacctccctaaggagtgcgagcttttcttgttccttgtctagtcagagtgaggagggctttgactgggagtgagggcacaggggctgcgggaggaggcggtggagggcagatgggccgtgtggagaggccggaggctgaaggggctgggtccccggcggaggggcagagagggccaaggacatgcccagctcctggcccaagtggcccagatgtggggacagtgggtgagatgctcaggtgacagttggggatgcagtcagggagctggagctgaggagagagaaccctgcgggacagaggggagctcagtggctcagggcctgctttgggtcttgggtcatttgcaggagtgagtgaagcacacatgtggtttgtgtccaattaatcttgctagtgacaaatataagaaaccattagacagaatgaagcccgcaccttttccatgcaaaaattaatggctttttcagagaaaattttcagaaaaattcaaagaaatgatggccaaacattcaaattatgacaaaaaagacagtaaactgtttttactctcaaatacaataaaattttactgagaaggctgtcatgatttagcttgaagaagaacttaaaatcatgccacaggccatttctccttttggccgtgagtaatggggtacaggatggatttgccttctcaccttgaacagtgagaaaatgacaaaatatgtgaaacggcagttttcagacactggacagcaggcagcacaggaccgtgatgtcaagaaaggaaagaaatgaggtgagcccgaccgcccgccttgctcacagcatagcttgcaggccaaagggcggagcggctcccacggggtttggtgatgttgccgagttgaggcccagatcagagtttggggaggccaaagcaactggaatttgcagagtgaagcagcggtgaggagagcaccacacacacagccccagcgccggcagaggaccccctgcacacacgcgaggaagccaggggaggcaggaaaaccacccgcagaacgctggagccgagcatgcctcggatgtgatacaggcctggaaatgcttgcacccccactggctgagggagaaaggctcgtggtgcacaggacactggatggtcctcagaagggaactgccgatgagtagggcaccatcagcccacagccctgcctcccctcccgctgcaaagcttgggtctggttttctcactgtccgaggtgagaaggcaaaccatcctgtactcctatcgctcacggccagaagcagcctgtggcataattttaagttcttccttaagctatcaattataaggcaatttctttctttctttttttttttttttttttggagatggagtctcgctgagtgcagtggtgtgatcttggctcactgcaaccttctcccgggttcaagcaattctcctgcctcagcctcctgagtagctgggattacaggcatgtgccaccacacctggctaatttttgtatttttagtagagacgggggttttgccatgttggccaggctggtctcgaactcttgacctcaggcaatccgcctgcctcagcctcccaaagtgctgggattacaggtgtgagccaccgtgcctggctgggaatttcttagtaaattaggctacctgaaaactaggaacctctattcatccaaagacaccttgaagagagtgaaaaggacaaataatttggactcaaaatgtatagtaactattataagtcagagaaaaaagatgggcaacccaataaagagcagggaaagtgaacaggtgcgttgcaggagggtgtccaagtgaccaaacacctttatgaaaacatgcccaatatcatttgtcaaaaaaagagaagtgcaaattaaaaccataatgagatacaaccatacccaccaaggtagctaaaactagaatccttggcttggcaggtgagagtatagtggttcaactattttggaaaaagtggcagaatttaccaacgctatacatatgcctacctcggacccagcaattctactcccagctttatacccaagagaaacaagtgcattcagcccttcaaaggcatgtccaagactgctcatagcagctgtatgggtaaaatctccacatggaaagcaacctcatggccctcgacaacagaatgggtgaataacacctggtatgttcgagccctgggctaggacatggcaagggaaaaataaatgactacacttcataaaacatggatgattctccagacgtcgcaatgagcaaaagtagccagacaccaaagtctacatgccgtaggatttcaaaagcaggaaaaagcgatccatgacagcagaaatcacaacactggttacctcttggggggaaggtattaactaagatgttcaaggaaatgtcttccacctgtctccaaaaaaaaaaaaaaaaaaaggccaggcatggtggctcacacctgtggtcccaggcttccaggtaatagatggattcagggattttctggttgccagttgattgaaagagttatctgaagacctggaatcaggctgggagcagtggctcacgtctgtaatcccagcactttgggaggccgagacggctgggatcacctgaggtcaggagttggagaccagcctgaactggtgaaaccccatctctactaaaaatacaaaaaaatagccaggcacggtggtgtgcacctgtagtcccagctactctgagggaggaggcacaagaattgcttgaacctgggaggcagaggttgcagtgagctgagatcgcaccgctgcactccagcctgagagagagagcaagactctgtctcctaaaataaaataaataaatttggtcactctacatatgtatgttatactgcatacaaatttgaaaaaaataaggatagaaaatatctaatagcatcaaattgttcctaatatcctcttgtctttctcgcctctgtaggagccgctgacgctctcattttcactcctgatgttggtgatttgtgccttttctcgctcttgtttcattcttgctgtggtttgccagtttcaatactcttctcataaaaccaactttttggttttacatattttctgttgcctgtttattgttttctctttcattgatttctgctgttagttttaattttctttttgtttgttagcttttttcttttcttccctatctggggtttctttcctactcctttctttccttcgtgacatggacagtcactgatttttctgcgaatcttcttttctaatacacagatttaaagctatacatttccttctaaacataattttagctgataccataaggtttgatatattttcatcactatttaggtaaaacaatttctagcgttttgtgatttctttcttggcctgtcagttatttagatgtgtgttgttaaattaccaaacatttgagaattttctggttagtcttttgttattgatttgtagcctcttttcactatggtcagaatatatgcttaaaattatttcagtcacttgaaatgtatagagaatgacttacggcccagtatatggacacttttgataattattacatgtgcccttgaagagaatatgtaaacttccaattttttttggagaggtgttattttttgtcaatttgaccagcttcataatttatgttcaaataatctatatccatatgaattttcttccatctgcttattctactagttactgaaaggactgtgttgaagtcgccgccgtgatagcagatctctctatttctcttttcagttctgtaagtttttattttgttttattttattttattttttgagacggagccgcactctgtagcccaggctggagtgcagtgatgtgatcttggctcactgcaacctccacctcctgggttcaagccattctcctgccttagcctcccgagtagctgggattacagactcccaccaccacacctggctaattaaaaaccccatctttttaaatagagatggggtttcaccatgttggtcaagctggtctcgaactcctgaccgcaagtgatctcctgccttggcctcccaaagtgctgggattacaggtgtgagccactgtgccaggcctataagtttttctttatgtattttgaagctatgctattaggtgcatacaatttagaattattaacttcccggtcgatgagccctcttatcattatgaagtctccgttatctctagttgtttttttatctgaagtccagtttgtctcgcattattatagttctgccagctttttttctagttaatgttatcatgatttattttttccatccttttatttatttatttaaaccaactcacttcaaagaatttctgtccttttaacgacatttttgtggggcttgttttaaaacattcagtctgacaatatttcttgtaattggagtatttttagtatacatctattatatttatcaatgtacttaggtttaaatctgctatattacatctgctatttgttcttttttctcccttttttttttccttttttaggattaattaaaatattttattttacatcctccgatttgcttgttagtcatacttttactgtactagtagcaattacccaaacaattataaaattaatccttcactaattatggtctaaggcaaattgttctttttactactttctggcaattatacaattataattataaaatcatttacaattataaaatgtaattataaaattcatccttcacttaccagggcctaatgtaaatgtgtacttttatcacttcctggacaatgtaaagaccttctaacgctttatttatttatttattttttgagacagagtctcgctctgtcgcccaggctggagtgcagtggtgtgaactcggctcactgcaacctctgcctcctgggttcaagcgattctcctgcctcagcctccggaggagctggggctacaggcatgtgtcaccatgcccagctatttttttttttttttttttttagtagagacgggatctcaccatgttggtcaggctagtcttgaactcctgacctcaaaggatccacccgccttggcctcccaaagtgctgggattacaagtgtgagccaccacgctctgcccttctaacgctttaaatccatcggcctctcccccactttttgtgctgtcattctcaggtatttcagttctgcacaatgttaaaccacacaataaatcatcttatcattttctacagccggcgtgcatggaaacgcactggcgtgtttcttctctgctgctcttttattctttccctcctgcatttccatgtttccatccaggaccattttccaaaggcctccattgtgatttgtcttgtttattagtgcatgtttgctgtaaggaattctctcaattcactggggagggtgtctgaaaatgtttttgttttgcctttccctttcacttgaaatagcatcccaagttggcagttattttctcttggtacttagagaatgttgttccattgtcttctggctttcagtgcttacgtggagaagtcaagagcctcattattgcttctttgaaggtggcatcttgttttttcctggctgttatttgtttaatttatttttatttttgtagagacaggatcctcctgtctcggcctcccaaagtgttgggattacaggcgtgagccactgtgccccacctcctgttactgcttttctcctagttagtgggttttcagtggttttactacaatgtgcttaggagtatctttgtatttctctatcttgaaatgtgtagcacttcttgcatacgcaattggtatgtctttcattggttttggaaaagttgcactcattttctcttcagatattgttctgccccatttgcaatctcccttcttggatttgagtgacagatgtggtaggcctgttgacggcaccctgtgtgtctctgatgctatgttccgtgcagttttctctgcgtgcttcagtcttctgtcggctgctgacctcaatcggtgcttgttaatcctctcttgagttctgtccactaacagtctgttaacccatctgtcacagtctttaccttggttattgtattcttagttctagagtttctatttgattttttcaagatttcatttctctagtgaaaatttccatctcgccgcttatttctcagagcagtcatcagagtcacttcaaagctccaacagtttcatcccctgcttttacacttgggtctatatattttttaatgtgtctggtgactcttggtttaaaacgacagacactgtggaaaaaaagtacaatctctggatgatattgtggccatcagagaggacccgccctgtcctctgccacaaagcagggacagatcaccagtcaagtcatgactgagctgtctaggacaggctgtagacatggtaagtctggttccacctcttgtttgccctctgatttacctctttgtcgtgcttctagggcacacccctctggggtctcaactgcaagccaggagagtttagcagtacctccctcctccctcctcctttgaaggaagtcctgggctcaattttgcttcccccgagccataatagagtgaagtttcactgaactcttcaaccactcaatgctcagcctcttagctgaggtgaacgtgactctcatgtcgggtgagaattagccactgcctcaagaggaaaaccagcacaggaagtccggctctcttctcagatcctctattctctgaataatttccaccccaatcctggtggtcctggcagggttgagagccaacgtctatctcctgagacttgtgagtttgccagaatctattacgcatgtcttttctgcctcttagcaaccatcctctgcccaacttctcagcccctcaccctcactgcttaatctctaccccttgaaacagctagaattgtcagctaaaagtaaaatcaaaattagacatcattataggcaagaaagggaaatccccatatgccagaaatggagtgggaaccgcgagccaggacgcgcagggagctgacgctgcaggtgggaaccgagagccaggacgcgcagggagctgacgctgcaggtgggaaccgagagccaggacgcgcagggagctgtcgctgcaggtgggaaccgcgagccaggacgggcagggagctgacgctgcaggtgggaaccgcgagccaggacgggcagggagctgtcgctgcaggtgggaaccgcgagccaggacgggcagggagctgtcgctgcaggtgggaaccatcagccaggacgcgcagggagctgtcgctgcaggtgggaaccatcagccaggacgcacagggagctgtcgctgcaggtgggaaccatcagccaggacgggcagggagctgacgctgcaggtgggaaccgagagccaggacgcgcagggagctgacgctgcaggtgggaaccgagagccaggacgcgcagggagctgtcgctgcaggtgggaaccgcgagccaggacgggcagggagctgacgctgcaggtgggaaccgagagccaggacgggcagggagctgtcgctgcaggtgggaaccgtcagccaggacgggcagggagctgtcgctgcaggtgggaaccatcagccaggatgcgcagggagctgtcgctgcaggtgggaaccgcgagccaggacgggcagggagctgtcgctgcaggtgggaaccgtcagccaggacgggcagggagctgacgctgcaggtgggaaccgagagccaggacgcgcagggagctgtcgctgcaggtgggaaccatcagccaggacgggcagggagctgacgctgcaggtgggaaccgcgagccaggacgggcagggagctgacgctgcaagtgggaaccgagagccaggacgcgcagggagctgtcgctgcaggtgggaaccatcagccaggacgggcagggagctgacgctgcaggtgggaaccgcgagccaggacgcgcagggagctgacgctgcaggtgggaaccgagagccaggacgcgcagggagctgtcgctgcaggtgggaaccatcagccaggacgggcagggagctgacgctgcaggtgggaaccgcgagccaggacgggcagggagctgacgctgcaagtgggaactgagagccaggacgcgcagggagctgtcgctgcaggtgggaaccatcagccaggacgggcagggagctgtcgctgcaggtgggaaccgcgagccaggacgggcagggagctgacgctgcaggtgggaaccgagagccaggacgcgcagggagctgtcgctgcaggtgggaaccgagagccaggaagcccagggagctgtcgctgcaggtgggaaccgcgagccgggacgggcagggcagggagctgaccctgcaggtgggaaccgagagccaggacgcgcagggagctgtcgctgcaggtgggaaccatgagccaggacgggcagggagctgtcgctgcaggtgggaaccgcgagccaggacgggcagggagctgacgctgcaggtgggaaccgagagccaggatggtcagggagctgacactgcaggtgggaaccgagagccaggaagcccagggagctgtcgctgcaggtgggaaccgcgagccgggacgggcagggcagggagctgaccctgcaggtgggaaccgagagccaggacgcgcagggagctgtcgctgcaggtgggaaccatgagccaggacgggcagggagctgtcgctgcaggtgggaaccgcgagccaggacgggcagggagctgacgctgcaggtgggaaccgagagccaggacgcgcagggagctgtcgctgcaggtgggaaccatgagccaggatggtcagggagctgacactgcagtatctctgggacgtttatgggcccagaaatagccctactggctaagcacccgagatgttccagccacccggtcaggggatgaggccttatgctaggagaggggagagatgacattgagaatcctgctccgagatgtgtgttcaaagggcagggaaaggggccagataaacttgacttgtggctccagtgaacaggcaaggaaacttgtctatcccctgactgtgggtgagaaggaaaattccacagtgagaaattgaaacctcagggaaagttgaccaactaattaacagagctgaagaaacaacttgcaaatgggaaggttgatcatcagaaattaggcagatgcaggaatgggatgaagacatgtaaaatgtcaaaggagattatgaggcatggaagatagaatgaaaatctatttaatgagttttacaggatgaggataaagaaataagaggagtcgatattcaaagagataatggctgagatccttacagaaataaccaaaagcataaatccttaagtttaagctgcacgagtcccaaggagaatgcataagaataaatctaacctgaacacagcatgttgaaactgcagaactccaaagacaaagagaaaaccttaaaagcaaacagagataagagaaactgttttcaaaggaacaacaattagcttggtgcatatttctccacagccacattatgtttcagaagtcagtatcttcaaattgtaagaatataacaaccaatacccaacttaagtattattcaagagtgaaggagggagcagggcacagtgacacatgcctataatcccagcactttgggaggccaagatgggaggatcacttgagcccaggagttccaaaccagcctgggcaacgtagtgagaccttgtctctacaaagaataaaaaaattagctggacattgtggtgtgtgtctgtagtcccagccactcaggaggctgaggtggaaggatggcttgagcctggaggtcaaggctgtgctgagccgggatcacaccactgtactacagcttgggcaacagagtaagaccttgtttcctaaaaaaagaaaaaagtgaaggaggaatagctattttcagacaataaaacctggcaatttaccactgttagagccatgatgaaagaatcacttaaggataataaactttaggaagaaaaaaccctttaattcagaattcagaaggaagttggggcatgcaagaagaaatagtgagtaaagaaactggtaaatatgtggtaaatctaaataatcattgaatgttaaaaagttataatggctatgaaagtttataccaaaaggtaaaactaaaatactaaggaataaaagccagcatccctcaggaagcagttggagcaaaacattctgagccctttttgctgttcaaaagggtggagagatgaagtctagacttctgaaagtcaagtatcatgttacaaatataaacgtagccactaacagcacagaaagataatgggttcttttctgtcagctgtattgtaggttcccaggaaccagcaagtatgataaaacctttaagctttcctgttctgtctcctcatctgcagctggtcctaccattcctcccctaaggtaacatgattaaagcagggagaaggaccacagccctgaaaagttctgcactctcaaagggaaagggagaagtgaacgtgtgggagaccctggaacagcaggtgctgcctggccatgcagtggcctcattatcaaggggagcttctggatctcaggacttaatatcaacttgttctcttattagcctcatttggaactgttgaaccagcgtcttaccaagctacaggcagagatgaaagtgagacctcagcccacctgggtgtatctctcttcagtctccccttgtttcacgtggtctcagggttgacatttatgttacagctgaccattaaagaatctaagtaggccaggtgcagtggctcacacctgtcatcccagcactttgggaggctgaagcaggcagattgcttgagcccaggagtttgagaccagcctgggtgacatgacgaaaccctgcctctaccaaaaaatataaaaattacctggctgtggtggcacacacctgtggccccagtgacacaggaggctgagacaggaggatcatttgagcctgggaggttgaggctgcagtgagccgtgatcataccattgcactccagtctgggtgacagagtgagaccctgtctcaaaaaaaaaaaaattagaatctgtaagtaaagaattagagaaattcattcaaagttttgtgggttgatggtgacccctgcagaagcagaaaggcaagcatctccaatccagggccctcaatgctcccatgcagcaaagcctggcaaatatgagctcacatcaaaagttgttttttttttgtttgtttgtgtttttttttttttttgagacagagtatcactgtgtcatgcaggccggaatgcagtggtgtgatcttggctcactgcaagctctgcctcccaggttcacgccattctcctgcctcagcctcccgagtagctgggactacaggcacctgccaccacgcccggctaattttttgtatttttagtagagacagggtttcaccgtgttagccaggatggtcttgatctcctgacctcatgatccgcctgccttggcctcctaaagtgctgggattacaggcgtgagccactgtccccggcccaaaagttatcaagcagcaacaccagcaaaaaatgacagatggacacagtactggaagatgcaaaaggaacaaaagagcatgggatacagccagagtcagaaaaacatcacatggaaaactataatgactgaaaataaagatctttcaaaacctcaatgaaagagttaaacagcagattagacacagttaaaacaagaattagtcaactgtaagaaagatgagaagaaattacccaaaatgcaatacacaggaacatggtgggaatagaaaatgtgaaagacatgttaataggcatagaagactgcgtgacaacatataacatacatctatctggagtttctgaatgagggagtcgaaaggatgagacacaggaaatattcaaagagatcaggccagaattttccagaactgggaaagacacataccatggatgaaattgtctctcaaaagatgttaaagtcctgatgcccagtgcctgtgaatgtggccttatttggaaatagagcctttacagatgatcaaggtaagatgaagtaattgggggagatccggtaaaccaaaaataaaaacctaagctcccgactgactgatggatccccccctcagcaaagggcattccaaagttaacctaaaagactagctcaggccatgatgcgaattaggggtcagatgcttcattataccctcttccctttggaattctggcacagctgaccagcattaacatttcaacagaaagattaaaattaggactgatagaacagactattgaagtctgataagaaacatctgcaatccattctctctgaagtctgctacctggaaggcttcatctgcatagtaagaaccctggtctctacaaccgttatcttaacctagacacccccttctattgattccaggtctttagataactcttttttttctttttttttttttgagatgaagtcttgctctgttgcccagcctggagtgcagtggtgtgatctcggcccactgcaacctccacctcccaggttccagcgattctcccacctcagcctctggtgtagctgggattacaggcatgtgccaccatgcctggcgaatttttgtatttttagtagaaatggggtttcatcatgttggccaggctggtcttgaactcctaacctcaggtgatcctccaaacttggcctccaaaagtgctgggattacgggtgcgagccaccatgcctggcctatattaactctttcaaccaactggcaaccagaaaatccttgaatccatctctgacctcgaagcccccacttcaagttgtcccacctttccagaccaaaccgatgtacatcttacatgtattgattgatgtcttatgcctccctaaaatgtataaaaccaagctgtagcccgaccaccttggaaacatgtctcaggatctgctggggctgtgtcacaggccattaggcactcatatttggctcagaataaatctcttcaaatagtttacagaatttgactctttttattgacaaccctaatcccatgtgactgatgccttatggtaggggaaatttgagacagacatgtacagagggaaggcatgaagacacagggagaatttcatctataagctaaagaacacctggggctaccagaaattatgagagagccacaggatcctccctcacagcctcagaaggaattaaccttgccgacaccttgagtttggacttccagcctctggaactgtgagacaatacatttctgttgcataaactactcagtttgtgaacttcactacagcaaccctagaaatgaatacaacatatatccacagaagatacaaaaacataagggaagccaaacagaataaatgaaagtaaaactacacagttacatcacagtaacattgaggaatactgtagataataaaatttgtttaaaacagccacaatagtaaagaaggattctctacaaaagaatggtggtggccaggcatggtggctcacacctgtaatcccagccagcactttgggaggcagcggtgggtggatcacctgaggtcaggagtttgagaccagcctggccaatatggcaaaaccccgtctctagtaaaaatacaaaaattagctgggtgtggtagtgtgcacctgtaaacccagctatttggaaggctgaggtggaagaatcacttgaacctgggaggtggaggttgcaatgagccaagatcatgccatttgcactccagcctgggcgacagagtgagactttgtctccaaaatgaaaatgaatggtggtggatttcttaacaatgggaccctaaagacctcaaagtttccagagaaaataattgtcaatctgtaattctatacccagaaaaatgatctttcaatactaaaggaaaattagaaatatttttatgttacataacaactaagagtttaccaacacatcttgactcaaggaaaacaattgacaacccaaaattttatacccagctaaactaatattcaagtagactttaaaggatatatttcaggaagaaggacaatgatcacagagggagaggctgaagtcaaagaaggaatagtgaataaagaaattgctaaaagtggctgggcactgtggctcacacctgtaatgccagcactttcggaggccaagatgggtggatcgcctcagctcaggaattcgagaccaccctgggcaacatggtgaagccccacccctactaaaatacaaaaaaattagctaggcatggtggcgtgcacctggagtcccagctactcaggaggctgaggcatgagaattgcttgagcccaggaggcagagattacaatgagctgagttatgccactgcactccagcttgggctacagagtgagactctgtctcaaaaaataaataaataaataaaagtatttttaaaaggaaatcattaaaagtggataattctaaacacactctcactagataaataatatctagttagacaaatatataattatagtagttaaatatatcatccttataaacatttaatttatggagtttaaaataataatattacaagtgctatggtcaggcaagtattaataaaaagaaagctgatgtggctaaactaatattctcttttttttttttgagacagagttttgttcttgttgcccaggctggagtgcaacggtgcaatctcggctcaccgcaacctccgtctcctgggttcaagtgattctcctgcctcagcctcccgagtagctaggattacaggtgtgcggcaccacgctgtgctaattttgtatttttagtagagacgggggtttctccatgttggtcaggctagcctcgaactcccaacctcaggtgatccacctgccttggcctgccaaagtgctgggattacaggtgtgagccaccatgcccagcactaaattgattttcaaaaaaatatattttaagacaaaaaccataattagggaaaagaaggccggtatataataatgaatagtattgttcagaggatgtaaagattcaaaacatgtatgtacctgaaaacagccataagtatggggaaaaaatgaagaagactgcaagtagaaattgataattctatcataaaagaagatttcaacacaactctctcagtgactgccaggtcaagcggataaaacattaataaaaggtgaataagattccaatagcacatttcgcgagctggatttaaagccatatctagacgtgaccgttagagaggacacattatgctctggtacgtgtggagcacttacaacaatcagcacacgcttagacataaggcagggcttaacacacttcaaaacccacttatgacaatgagcacatgcttagacataaggcagggcttaacacacttcaaaacccacttaggacaatgagcacacgcttagacataaggcagggcttaacacacttcaaaacccagtgtcatatgacttcactctctcagccaaatgtaattcaactctcaatcactcactgaggaagagtgttaaaatacatctggaaaccttataacagatttctaaatcattcatgaatgaaagaaaacgtaaaatatttagaactaaataataatgtatccctgacacacttacattagtaaagaagagcagctgaaaattaaaaagttaagcatccggccgggcacggtggctcatgcctgtaatcccagcactttgggaggccaaggtgggcggatcatgaggtcaggagtttgacaccagcctggccaacacggtgaaatcctgtctctactaaaacacaacaattagccgggcatggtggcgcagggctgtaatcccaactactcaggaggctgaggcaggagaattgcttgaacccaggaggcaaaggttgcaatgagccaagatcgtgccacttcactccagcctgggccacacagcgagactcttgtctcaaaaagaaacaaacaaacaaaaatgttaagcatccaactgaaggaagtctaaaaatgacaataggaatatactaagaaagtagaaggatgaagataaaggtgaaacataaataaatgaaaaacaaaacaaaactagaactaaaaatatctaaaactaaattagaactaaaagcagaactaacatatataaatttgatttcttgaaaaaattaatgaaatggccacaagatctctgaagggaaagaccggcaagaggcacaaaaccctactgagaaatgagaggagggctgctctacaatgcagcagagggcaacatgagtgatctcacagcaaggcaacttggaaaattacacaaaatggaccatttctagaaaaacattatttgccaagtttgattcatagagaaacagaaagcccaaagagtcctataatcctagaagaaattaagaagttaaaatcttcccacaaagatgtcaaaaatctaagacaattttacatgttctgccaaaattaaaaagaatattttatcccattttacaaacttcaaaatgtaggcaaaagtgggcacatgacctagttcactgtaggactctatcataatctcaatacaaagacaggacaagtgtgtaccacaaaagaaaaagcacactcttgggcacggatgaaaaatcctatataattattgccctatccaatctcaaaaatgtataaaaagtaccgttaaccactgcacccccaacacacagtcaaaaatctacgtataacttttgactccccccaagttgatgactagtagcctactgttgaccagaagccttacagatcacacaaacagttgattaacacatatcttatgttgtctttattatatgctatattcttacaatcaagtaagctagaagaaagaacataatattattaagaaaatcataagaaagagaaaatatatttgcacttcattaagtggaagtggatcatcctaaaggtctccattctcgtcgtgttcacaatgagtaggctgaggaggaggaggaagaggagggcttggtcttgctgtgttaggaatggcagaggcagaagaaagtttgcgtgtaaggggacccatgcaagtcaaacctgtgttgtccaagtttcaaactgtgtatgatattttggttcagttgggattattccaggaatccaaggttaatttaattttagaaaatgtctaagtcattccattcacatattaaaggagaaaaaccatattgtcatctcaatggttgccccaaaagcacatggtgcttctaaagaagggagagacttgctcatcagaccgcgcacctcagaacaaagctgtgataatgaatatagaacaacacagcacggagagaaacggatcaacggaatgggaaagagaaccgggacaaagacccgcacatgtggcgacttgagttcgtcagagctggccagacatatctgttggaggaagacggaatagtcttaaatacccacgaggaaaagaagtgaaatggaactctgcctccagccttccaaagcaatcagttccaggtgtagacaacacctcaatgtgaaaaaacaggggggcctttagagcagagtatttggctttacacacttagataacagcaaaagaaaaaaaaacttgcaaagaaatcttaaatttctcttactagtattactggctgtagagatattggaattgttattttgaaaacatgttaaatatagggtaagctaaagctagtaattacattaaagttgttaggagccaaaattttccatataagagaaatgacatacaagtacaaaaccaaagaaattaagaaaaactcttttttttttttttttttttttgagacatggtctctgctctgtcaccaaggctggagtgcagtggtgccatctcgactcactgcagcctagacctcatgggctcaagcaatcctcctacctcaaactcccacataggtgggactacaggtgtgcaccaccacacccaactaattttttgtattttttgtagaaatgaggttttgctatgtttcccaggctgctctcaaactcttgagctcaagcgatctacccaccttggcctcccaaagtgctgggattacaggcgtaagccattgttcccagcctaaggaaaatttttaatgttaaatttgaattggaactatcaataggaactcatgatttaacctgggtttctaaatgccatttccccactttaaagacccatggactcctcagtaagtagctgagtccaggtctggtgcaggaaatgtgtaataagataaggctggaagatcttgttgtggcagaaagcagctgaattaagatgcatagattattggaaatatgaaaaaagaatatagtggccagaatgatggattttgttagtggggtaatgaagctgtgattatgcaggaagctttccttctttattcagaaatgcatactcaagtatttagaggtaaaatatcatttatctctgcccattacttttaaattttccagcaaaaatgatgaaagagctcccactgaccaaagaatgatgactgaactggatcaaaacacattaaatatataataatccgtgagtccataatgatacatcaaaaagtcaaagaaagaaaactaaagcaaaaagcaaacaaaaactcatctgccaccatcagagacagcccattgcacaaaccccttaccctgaaaattggtaattagagagaaagattcaagcttttctcctgcctcgccagcaagaactacacatatgttgcaagtattgccgactcaattccaggccgctgcaatgtcacataaatgtttcagctttccagtgcatacaaaagttatctttatactttacgtagtctagtaagtgtacaataccattaagttgaaaaaaaactgtacgtaccttaattttaaaatatcttattgctaaaaaatgctaataatcatctgagccttgggggagttgtaatctttttgccggtgagggtctcgcctcagtgttgatggctgctgactgatagggtggtacttgctgaaggctggagtggctgtggcagtttcttaaataagacaacaatgaagtttgccgcatcagtggacgcttcctttcatgaaagcggcactccccacgattcaagtacagatggtcccatcttaggacaattcgagttaatgatctttcaactttatcgtggtgcaaaagtgacacaccttcagtagaaaccatgctttgagcacccacacaaccattctgtttttcactttcagtgtagtattcaataagttacacaaggtattgacactttattataaagtgggctttgtgttaggtgattttgcccaactctagggtgaaatcatatgcctgttagccatgtttttttggtttttgtgttttttttgagacagagtctcactctgttgcccaggctggagtgcagtggtgccatctcagctcactgcaacctccgcctcccgggttcaagagattctcctgcctcagcctcctgagtagctgggactagaagcacctgccaccatgcccggctaatttttgtatttttagtagagacaggggtacaccatattggtcaggctggtctcaaactcctgacctcaggtgatccatccgccttggcctcccaaagtgctgggattacaggcgtgagctaccaagcccggcctttgtatatcttcttctcagaaatatctgtaagttggccaggtgccgtggctcactcctgtaatcccagcactttgggaggccaaggagggcagatcacaatgtcaggagttcaagaccagcctgacaaacgtggtgaaaccccatgtctactaaaaatacaaaacttagccaggcatggtggcgcttgcctgtggtcccagctactccgtaggctgaggcatgataatcccttgaatctgggaggcagaggttgcagtgagccaagattgcatcaccaaactccaccctgggcaacagaacaagactccatctcaacaacaacaacaacaaaaagaaatgtctgcaagtgttctgatcacgtttaaggtcaggctatgctatgatgttcagtaagttaggggtattaaatgcataatgcattttcttttgagacagagtcttgttctattgcccaggctggagttcagtgatgcaatcttggctcactgcaacctctgcctcccggattcaagggattctcgtgcctcagtctacggagtagctgagaccacaggcacacgccaacatgcccagctaagttttgtattttttgtagacacagggttttgccatattgcccaggctggtcttgaactcctgggctccagtgatctgcccacctcagcctcccaaactgttgggattacaggcgtgagccacctcacccagcctgcatttttgacatgatatattcttaattgatacataatttttgtacatattcacggggtgcatgtaagcttttattacatgcatagcatgcgtcatgattaactcagtatttagggtgtccatcacttcaagtctttgtcatttttatgtgttgggaatattccaagtcctctcttccagctcttttgaaataaacaatacattgttgtcaactatagctaccctactctgctatcaaacattagacatattccttccatcgcaccataatgagtgcatttgtgctcattaagcatcctctttttgtcctccccctccactggaaggaaataatgtatacagtggtccattttcaagacaaagtgccttaaatcggcttaggtcagcaaactacagaagaagcaggatatactaggccctgggttggatagccaatgcctgcttgtcacccaccctcccgccacctacttaagttgccctcacccaaaccaaagaagtttggtctaagataaaagtttgctagcctgtaaaatagcttgccttgtctgttcgtatcagcctgcccagctacttaggtcataagtcaaatacttgaagagcccctgagctaactaggattgcaatgcattgtgggctgcaacaaaatgcagcaagacaactctaaagaaaacacctaaagcccctgcccaacaaccaataggtgacgtccaggaaggttgtgaccccatagtactcagcctatgaggaaccgggggagggacctgcacacgaggggataaattgcttgttgaaactgtgctgggtgtgcctgcccaccagacacccgatcttgcaagactgtcattaaaagtttcactttggcttttctccgggtctctaagtccattctttgggtttggatgggtgagtttgtttctcacatacccacgcacccttcctagactctgggatctatcgttctcttctctgcctcagaggtcaacttttttcactcccatgtgtgagtgagaacatgtgatgtttgtctttctgtgactggcctatttctcttaacataatgacctccagttccattcacgttgctgcaaatgacaagatttcattctttttatgaccaaacagtattccattgtgtgtgtgtgtatatatatatcacattttctttatccattcatccattgatagacagttaggttgattccatatcttggctaccgtgagtagtgccgcagtaagcatgggagtacaagaatccctttcatatactgatttcctttcctttggataaatactcagtagtgggattgctggatcgtatggtagttctgtttttagttttttgagaaacttccatacagttctccacaatggcttcactaatttacattcccaccaacagagcataagtgttcccttttcttggcatccttgtcagcatttattttttgtcttcttgataacaccaattctaactggggtgagatgatatctcattgtggttttgatctgcatttccctgatgactagtgatactgagatttttctcgtatgcctgttggccatttgtatgtctcttgagaaatgtctattcagatcttttgcctgatttgttttttcaagactgagtttcgctcttgttgccaagctggagtgcaatggcacaatctcgactcactgcaacctcagcctcccgggttcaagcgattctcctgcctcagcctcccgagtagctgggattacaggcgcctgccaccacgcccacctaattttttgtatttttagtagagacagggttttgccatgttggccaggctgttctcaaactcctgacctcaagagatccgcccactttggcctcccaaagtgctgggattacaggcgtgagccaccgtgcccggcctatttattttttaaacagtgtcttgctctgtcacccagactggagtgcagtggcatcatattggctcactgcaacctctgcctcctgggttcaagtgattcttctgcatcagtctcccaagtagctgggactacaggcatgcgccaccatgcctggctaattttgtatttttagtagagacagggtttcatcaagttggccaggctagtctcaaactcctagactcaagtgatctgcccacctcggccttccaaaatgctgggattatgagctactgcacctggtcacattaaaaaaaatttttttagcaacagggtctcactgtattgtgcaggctggtctcaaactcctggtctggagtgattctctcaccttggcctcccaaaactctgggattgcaggcgtgagtcaccttgcccagcctgctgggagtttttatcatgaagaagggatgtcgaattttatcacatgctttctctgtatctattgagatgaccatacggtttttgtcctttaatctgtgatttgacgtattgcatgtattgatttgcgtatgttgaaccatccttgcatccccaggataaatcccacttagtcataatgtattatctttcaatgtgctattagattcaatttgctagtatgttgttgaggatttttgtgtatctattcatcaggaatattgacctgtagttttcttttttgttgttgtgtccctgcctggtttgagtatcaggataatgctggcctcatagaatgggtcagagagaattccctcctcttcagttttttggaacagtttaaggagaaatggtattagttcttttttgtaagtttggtagaatttagtagtaaagccatctggtctataggccttttgcgttgttgttgggagatttttattactgttccaatctcatcactccttattgatctgttcgggtttttttgtttcttcctgattcaatctcggcagctacgcgtgtccagggatgtctccatttcctccaggtttccagtttctgagtgtataatttctcatgtagtctctggtgatcttttgtatttctgtgatatcagttgtaatgtctcttttttgtttctggttttggttatttgggttgtctctctttttttcttcattatcaacttagaatattttcagcttccatttatgatgggcttatcaggacatagctccaccatgaggtgaggtgtgtctgatgtgcttacggtggggtttaagtgctcccacaagcctgctctgacagtctgtacttatttggggtaaaaaacaaaaaaaaacaaaaaaaaaaaaaacaaaaaacttagctctgctgacaaataatgagtcatattttcccacaaagttaatttttgaaataacaaaggaaattaaagaaaaaatgttcaggctgggcacggtggctcacacctgtaatcccagcactttgggaggccgaggcaggcagatcacgaggtcaggagattgagaccatcctggctaacacggtgaaaccccgtctctactaaaaatacaaaaaattagctgggcgtggtggcgggcacctgtagtcccagctactcgggaggctgaggcaggagaatggcgtgaacctgggaggcagagcttgcagtgagccaagatcacaccactgcactccagcctgggcgacagagcgagactccgtccaaaaaaaaaaaaagtaaaatgacaggaaaagatataacattcaaacagcaactcaaagagaggtggagttcctatactaatatcagaaaatatagatattaagacaaaaattattgttagagacaaagaaggatgtgttataatgataagagggtgatccataaggaagatataataactagaaacacatatgcactagctgggcacggtggctcatgcctgtaatctcagcactttgggagcctgaggcgggtggatcacgaggtcaggagattgagaccatcctggctaacacggtgaaaccccgtctctactaaaaatacaaaaaattagctgggcatggtggcgggcgcctgtagtcccagctactctggaggctgaggcaggagaatggcctgaacctgggaggcggagcttgcagtgagccgagatggcgccactacactccagcctgggcgacagagcaagactccatctcaaaaaaaaaaaaagttttgcttcatgggaaatccccaaagtccctccccacaccccatgggaccaaagggccctagacctcagggtggggcctgcagcgcagggagcagagccggcaaggagctgccctcaggtcgttcctggccacacagccagcctcggagccactgagaggcctgccctgggtcccgaatctagacgccccttccagcctcaatctttcttccagggtaagcagcctgagaggccaagaggacagtccaccgaaccctgagcccaaggcccaggattccttgcttaaacatccccaagcctggatccatcctcccgaggtagagctgcctgagctgtacccagtcctgctggcctgaggggcagccaggggaggtgacgtggtgcttttctggggctgcaatgagctcagacccacgggctgggtgtagcatgtgggctcattgaggcccctcacaatgtggggaaatcggagaggggactggctggggctggccctcctgcaaggacttctgagagtgctccaaggagccctggggtcctccacttgcccctggccttccaggccctcacacaccattgttgtccagacagaagagactgggcgctgtggttcacgcctgtaatcccagcactttgggaggccgaggcgggtggatcatctgagttcaggagttcgagaccagcctggccaacatggtgaaaccccgtctctaataaaaaatacaaaaattagccgggcgtggtggcacgtgccttaatcccagctacttgggagacagaggcaggagaatcgtatgaactcgggaggcagaagttgcagtgagccgagataaagccgttgcactcaaacctggggtacaagagcgagacttctctcaaaggaaaaagaaaaaaaaaaagacagaagagaacctgttctgtctaactgccttttgcttgagtgcagggaaggcagcctcccttcatactcatgccccagccctgcaaatgtcacagcaggacccacctggctgcccctccccatacccagagtaaccctcacccagagtccctggaggacccaaccctcgggggcatgcctggggcccagctgcattcaggcatccagcaacccagccagagggctggggctccccaaccatggccgggaggtaagggctgaacccaaggccaaatcagagcatcaggaaggtgaagagagatctgggaggggctagggagaggatggatctcttccccattcacttcctggcccacccagactggccccaggggtgcagctgacaggccccacccttgggaactgcaccctcctgactggtgtcctgcaggcaccctgaggccatcaccctggacccctgccctacataggccttacaaggaggagccagggtggacacccagacctcattgaaagtaggagtgttctcaaggtcccagaccttactcagggaccccagtcggggggtggggcagtgggaggcagagccccttgctaggagcttctagccaggcccaccttttcagatatgccagtgagcagccccagcttcgttctccaagataaagaccctagttacctccattgctcagcctcccttgcagctaagtgtagccatgtgactaagttctagatcaagttccagatcacagataagtggaagtgccctgtgggacttccaggaagtctcctctgggatgtcccttattctctgctaagaacacagaggcaatggctgagttccagcagccactgtgaggccatgaaggcagggatcctagggactgggatctgagagcctggctcccaatggcagtggagcaatgccatcatctctagcaaggccgtctctagcctgccagcccctggacctgcttagtgttcgagagtaatgaacaaccttgctgaagccactgttccttaggtgtctgtggcctgcagctgaacttgactccgattcgtaggcccgcaactggagggcctctacctcgagggagtggggtgtagatttttcctggaggtgaaggttctcagccctaccctctagcccgcccacccagctccagccgtctgtttctgtctcagatgagagggggcctctcaggacaaagaggaagtagctggaaggggaaggagccagctgcagagaggaggaggtgagctgcagagaagaggaggttggtgtggagcacaggcagcaccgagcctgccccgtgagctgagggcctgcagtctgcggctggaatcaggatagacaccaaggcaggacccccagaggtatgtgccaatgaggccagggcagctgagaaaagccaggcatggggaaagggctgctgtctgcctccctatggcctcagcctcccagcaaccccaggtccagagagtcacacagcctccagctagtcctgtagatgactcgctccgtccccagtccgtgcagctgggataagctgggccctggctctccagccaggtgacagctgggccctctacctcagcctgggactggcagccatgcctaatgccctgcagggcaggaaatctggcaccttcagccatgacctctgatgtctgcagggtcttacgctatctaccatgggaccagggggctacagccctactctgcaggggtctctcagcttgagccaacctggctggcggtcctcccaggttccattgcaggaggaggtggtgaggcgctctggggtctgtagtcctgggaggggacttggacaggctccaagtctgagatggggcctgcaagaggcagcgcctctgtgctctgagctgcccgtctgcctggagcatttaagggagcaaaggtcctctctggtgagggcagggagtgtggggagcagctgtccaagaacagccctggcacctcgttgcccagccacagcccaggattccatgtttcctctcattgaccagccacagcccaggattccatgtttcctcttctgagagttagtgggggagagcaaaggcccgatgctgggccctgaatccctggggacagtggggacacggtgggcaccctgaggtctcctctgtggggtggggggagcatcccccagagttcagctctggggtgggggcggcacccacccacctctgcaggaccccccagcgtggggggagttgggccgcagtgacttggcctgagtcccctgtccccacacttggtttatgctcctacccccaatcccccataacgcttggtctccagggcagactcagtccaggcccgactcctgtggtgttcctggcatttccgccccatgctgaggcaggccaggttctcaaagccctcagccctgacccgtgggaggacagcccagacgaaccccagaggcctggaggctgagctggctgctcctgggtggacagccgacccaccgagccctgggtcccagcgcccagcctggctgcagacactggcactcagcactgcccaggcccaggccccaaacctcggagacatccccatcccagccaggggccagccagctcctgccctggtggatgtctcagtcagaggctggccagccaggtgaccatgctgggcacagacccctccctgcacccggggagggcgcctctgtacttgtgaggcacccttcccccatggtggcacctggggcagcctgactgcttgctttgggggtaggagtggggatgggagcccacatcccacagggcccagatggcctggctcccagctccttgtggggtgaccactctgaggagataaggcgagtccctgcagcagaggacaaccccctctgccagcagtaggggtcccactctgccgccatctctgccctctccacgcctagcctctccagcaagggtactgctcagctgccccctctgacctgtggctctctggaggggctgccgtggggccaagacaggagcccagcccaggagggaagcagttatttataggccagcaataagaggaccaagcgacaaaagcagaaacagccctttcagacgcagtttcagttgtggttgaaacagggaactgagatgcaaatacctagatactcactgagtgggagaccctgaaaggggagacacagaaagccggggcatgtggctaggcacagacgcccgcccgcccctcgtgcttggcccaggctcagccctggggaccgccttaacagcagtccttccggcttggccagggggacaggacaggtgacatgtggccggctgcgggctccaacacccacacggcttgtcctcgtggaaagcacacccccaacatccagggcgtgacctcgggcatgagtggggggcttttgggggcttatgtgggtgtctgtgcaggggtgtccccagtgcccagctgcccaggcactgaggggcagttctgggcagagctggagctgctggtgatgccaggctgccctgtgcagatgctgaagcctctttggaaagcagcagtggcccccacatggccatgctccatgccgccccgccgcccgtgggacagagaggctggcacggtaggactggggggccccaggggggaggtggctgggatcaatggcctttcaagagctccgagccagagtggagaggtcacaagcagccttgagggggcctccaagcagaggtgccctgactggtgggcaagggaagcctccctgggctgctccagaccttccctttatgcccctgctggaggtgctggggacagccagttaccacgagccacagcattgcagagtgggctgcaggccccctgacccctgccaccaccctgggctgggggccttctctgtatcaccctcccctctcccttgtccaccctagtcccaccccagtggcagcccaggtccgggaagtcaagacggtctctgtctcagcactggaggggccatcgtggcccagccagaagtcaagccccgccctgtctggtgaccctgcgggtgctgccccatccagttgcaggtcctgggagcgctggctgtgctgtggctgggctccgtggctcttatctgcctcctgtggcaagtgccccgtcctcccacctggggccaggtgcagcccaaggacgtgcccaggtcctgggagcatggctccagcccagcttgggagcccctggaagcagaggccaggcagcagagggactcctgccagtaagtgagcccatggaggcctgcgggggcaggtctcagtttggggctgctgcctgtgtttctgcccttggatctgcccgtgagataaggggggccctctaccagctcctccaggaaggtgcaggtcaccagggagggccacgaccatatgagctggagtgggggctggggacggggcaggcgtgtggtgctttttgcagcaaacagaggctgccacctgggggctctgacaggctggagaacactgcctgtgctgaggctcaccccctcagtccttccacccctgggggtaatgtcactgtcccctgccgcccctcatccttccctcccacccttctttccctgcggttggggtcctggaatcccaggactgccccggaggaacctgttgggccatcctgcacacatcccctggaaacgggagcttacctgcccctggcccaacctttcccttccaggccagctctggccaccaccaagggcttccacaccacgaggccaccccagaccccagactccacagctctgctctactctgcccggcttcaggagcagctgctccctgtgggcagtgcctcagggctgagtggggccaggaccccccagtctagcctgctctggaccaggcagcccctctcaggctccttcccaaattgctcctgggtgtcaccaccccagcagcatgctgggctcaggcccaccctgcccagtctgttttgttgcctataccttaaacccttaccctgcacacttggcctgggctcatcccgggggccacctgagcaacggttgctctggcttggcagtgggatggggcaggtgatgtgaggtgggctgggggctcccgcacccatactgagcccagtgtggctctccccacaggcttgtccttgtggaaagcatcccccaggacctgccatctgcagccggcagcccctctgcccagcctctgggccaggcctggctgcagctgctggacactgcccaggagagcgtccacgtggcttcatactactggtccctcacagggcctgacatcggggtcaacgactcgtcttcccagctggtgcgccccgccctggccccaccgcatcctggtgctggaaacacagcaagtcaggctgcctatctatgcaggcgtctcgggcaccaggcccgggggctcagcttggtggtagggtctagcatggaacagggattaggccgctcctttgggggctctaacagcagaggtgtcaaggagctgggcctctgggtgactaaacactcagactgtgcctggtgcagtttggctctcaccaagggtcatccagatacttgacctgaccttgagctgtgggcagtcataggtgggcctcctgaggaggacatgggtcctagtggggatgcggaggagagggcagcctgaggtcagctctcatggctggcctggccttgcagggagaggctcttctgcagaagctgcagcagctgctgggcaggaacatttccctggctgtggccaccagcagcccgacactggccaggacatccaccgacctgcaggttctggctgcccgaggtgggtacctgcaccatgctgggcaccactgccctagcgtcgggcatgggctgtctggctggcaccacaggacaaggaaaagaagtgagggtgggaaaggtgccctggacttccctaggacaccccaggagggcaggacccagggctctgaggtcctttgagtcagcttcacctgggcacagggctggttccacggatccaaaagtgccattttccacagggcagagcacaggtggcctcggagccctgctgagcccagcagctgacctgtgggtggaggctcaggctgggacctctggctgggcagtgagaggccatgggcagtcaccacaaaggcaggctctggagctgagctgcccagagggatcctgggccagtctatccctctgtgtcctcacctataaaatggggatgaggatagcagcagcttagtaggactgttgtgaggacatctgagtcaaccccactgtcaagagcttggggtcaggctcaccatgaagctagcacttagcaagacctagttcatcccattgcctgaactctccaccaggtgcccatgtacgacaggtgcccatggggcggctcaccaggggtgttttgcactccaaattctgggttgtggatggacggcacatatacatgggcagtgccaacatggactggcggtctctgacgcaggtgagtgccagggccctaacacaggaggcctgcctgaagcgtttccccgcctgcactcctggggacttggcctgacatctcagtgcatctggagaaagtcgtgtagtcctgtttacaattcactatggtagaaacaaccggagactggtctaataaatgatagaattctacacagccactgaattcatgctgtggaatcacattcaatgacatggaaagatgttcaagtcacattacccagggaagcatggagattacaaaatacaagcctttttaggaaaagcaatgcatgaaaaacgtgtcagaatggtcatggcaaaggcaaccatggttatcacttgacagtgggattaagaatgatcccattcttaatggcttgatgcattttctattgtttttgtaataaacgtgtattgctttgatcattggaatacaatgttcaaaaacacaggcacccgctgggcactcctcccaccagcacactctattacagattcctacaggcaatgcttcccgcaagtggggaccagtcgggcagggactgcacctgccccaacatccctggcctgggtggagtggggtggaggccccacagaggggtttttctcccacagcgcctgactttggtccctgcaggtgaaggagcttggcgctgtcatctataactgcagccacctggcccaagacctggagaagaccttccagacctactgggtactgggggtgcccaaggctgtcctccccaaaacctggcctcagaacttctcatctcacttcaaccgtttccagcccttccacggcctctttgatggggtgcccaccactgcctacttctcagtaagacgggttgagaaggagcccatcagaggcccctgttctcccctggctggccagacccacagggagccctctgggctggccctgcagacaccagcagcatcagctgggtcctcaggcagccagcaccatgggtggggctgtggccctggggtgagcagcaagcaggctggcatcagtaggctctgggctgtgcctggaggcaggcttagctccaggaggacagctggtcagcaccatccctgggaaacaggccgcctgggaggtggtgggaggacctggggccctgggagtctccagactgctgggcgaggccaaggggcttagctgggcactggagagggaggggaaccccacttgctctgcggggaaggaagggaagagtgaggggtgggcagatcctcctttatcagcccacgggggtgggggtggacagccctccagccagccgagggactggtctgtagtagaggctgtatcagaacaagggaagcctccctagatgggggtgggggtggcaccctgaagggagtggataaacttccctgtggccaggaactgtttctgggacgtcaatccagcctggagcccagggcagtccagctgcttccccactctctccgccaggcctcagagccagtccccaggacccctgttgagccgaccccttctttcctcatatttccaggcacctgggccccctccctccacaccacatggggcctcttaggtggtgcatggtggggtcacaagttcagaatgggctgggctggcagagccttcagggatttctctcccgtcacaggcgtcgccaccagcactctgtccccagggccgcacccgggacctggaggcgctgctggcggtgatggggagcgcccaggagttcatctatgcctccgtgatggagtatttccccaccacgcgcttcagccaccccccgaggtaggtctgagtgggaggtgggcggcctgctctgctgacgggcagctcctgggcacgtcccctcctgctgggacccctatcgggcccggcttgtaagcagagccccgtccctccccaccccaaggtactggccggtgctggacaacgcgctgcgggcggcagccttcggcaagggcgtgcgcgtgcgcctgctggtcggctgcggactcaacacggaccccaccatgttcccctacctgcggtccctgcaggcgctcagcaaccccgcggccaacgtctctgtggacgtggtgagggcgtgctcccggccgggcgtgggaaaggcggccctcctgccgcccttcctgacgcgctgcctctgctcccctaagaaagtcttcatcgtgccggtggggaaccattccaacatcccattcagcagggtgaaccacagcaagttcatggtcacggagaaggcagcctacataggtgagcgcgatcagatcacggcgggcgggccccagggtggccaggcacgggcgagggaggcactggctttgtgaccggcgtggacacctcaggagggaggggctgctgctgaagggggacggggtctccatggagttccggggaccaggccacccgcctgtcacctggccccacagggccccagaacactgagtcaggacgcctgtccccaagtgatgaaggtggagttctaccgcgaccagctgtccctcccgcacctaagcgaggggcttccccggctggagtctgatgacagtggaggggccagctgccaaccgtccccaaacccgtagccgggcctggcgctgagcgggctgcagaggggcctgtgggagccggcgccccagtgtctcctccatcctccccgcaggcacctccaactggtcggaggattacttcagcagcacggcgggggtgggcttggtggtcacccagagccctggcgcgcagcccgcgggggccacggtgcaggagcagctgcggcagctctttgagcgggactggagttcgcgctacgccgtcggcctggacggacaggctccgggccaggactgcgtttggcagggctgaggggggcctctttttctctcggcgaccccgccccgcacgcgccctcccctctgaccccggcctgggcttcagccgcttcctcccgcaagcagcccgggtccgcactgcgccaggagccgcctgcgaccgcccgggcgtcgcaaaccgcccgcctgctctctgatttccgagtccagccccccctgagccccacctcctccagggagccctccaggaagccccttccctgactcctggcccacaggccaggcctaaaaaaaactcgtggcttcccggtgcctctgtgtgagtcccgcgcgggcggcccttcatcctcttgccaagggcccgcctctatgcgcccgcccctgcgaaactgcgccgcgcgaccgccgtggcagcgcctcagctagccccgggtccgcgagaacctggggcggggcggggcggggaccagacgggcctcccaggcggagcgaaccctccacctcccaccccgcgccgggctgccgcgctccggaacccaaattcccgccccgaggctgccgggggaagcgagaggcgcggagcccacgcccgggactccagcggaggaaacgcagaccaaggcgcagcgccgcgcacccaccgccagggggcagctcctacggcgccggacaggggcggcgcgggaggggagcggggctgaggggaccgggagggcgggaggggacctgcgactgaggggacagggagggcgggaggcgacccgcggctgagtgagggaagggcgggaggggacccgcggctgaggggaccgggagggcgggaggcgacccgcggctgagtgaggggagggtgggaggggacccgcggctgaggggacagggagggcgggaggggacccgcggctgaggggaccgggagggcgggaggcgacccggggctgagtgaggggagggcgggaggggagcggggctgaggggaccgggagggcgggaggggacctgcgactgaggggacggggaggatgtgaggcgatccggggctgagtgaggggagggtgggaggggacccgcggctgaggggacggggagggcgggaggggacccgcggctgaggggacggggagggcgggaggcgacccggggctgaggggacggggagggcgggaggggacccgcggctgaggggacaggtcctgcgtgcgggctggggagacaggcgggcgagggtaggggtgcacaaggctgtgtggtttgtgggctgttgtgcagggtgggtccaagcatgtgggggcaggcttgtcctggggatgcagtgcccagggttggtggatggggctgagaggaccagcatttgagctggagggcaggaaggtgactccagtctgagaccaggacttggatgcagctccactggaactcaccctatcctgggagccacctgggcacctgtcctgcagatgcaggatttgaacccaggtttggcaactcagttcccactcttctgctatgaatgctgggtcagaaggattctcaaaacaccctggcttatctcacctgatggttcctgaccaagaccacagggtaccctcccctggtggaggtccatggggccatgctaggctggagttcagggatggctcagcggtatgaaggagcactggatgctgaatggaccccagggtgccccgaatgctctcccggtcttgaggcaccactttcctacccttctctacttctctccttttcctacccttctctacttttttctttcctacatttgtgtccctgccacactgtgaactcagccatatcttcctcttccctctttgctttggggaaagctagcaaagttcatctcaggtacagtacaagttacttttctgttcgattagtgacctcatacttcccccatctaaaggacaccttagacttcagcattctgtctgtgcagaaatctcctacacccatcctgcctccctgcccaagcttgtgaaaagcttgctgcagatgctgcagggggatagggatccacatagccctgcaaggccttcaggagcttctgggggctgctttgtgtgtgagctgcacttggccaagccaagctctggcagttgcagtggctgctccctgtggcttcctatccctcattcatgctccatatctcctcagtaaccatctggcaaaaagcttcgtggcaacacctggctcagaagccgatatcatcccagactaagctctgccctccagggttgcacgtgtgggtttgctccctggttcttggccttatacctgaatgtgtctcagagcacttggcctgctctcttggcctgccaactatgttctaggagggctctgtgctccaggctgtgatttggacaactggctggtggccctcagccagtgaaaggcctctttccacacacctggggactggcagtcacacctcagtggcactgacagaggcctgcttcaaggcagatgcctattccaaaggaaatccagcttgacaaggcttgggagaccccaggagggtgccacaatgtggccccttctgggctatagcagacagactctagaatggctcccttgacccccacctgctggtatgcatgcccttgtgtgatctcaccttgagtgtgtgcaggacctgtgccttgttgtaaccaatagaatacagaggtaaggggatgtcactcctgtgacaccttgtgatcatgtgacataagattataacattatcaaggaatagcagtctatcccttgctagctttaaaaagtgagctgctaggctatgagctgtcctatgaagaggcccatgtagcagggtactggggttgcctccagcccccaactagcaagaaactggggccctcaatcatcccatccacaaggagttgagtgtggctagcaacaacgtgagcttcagaagtggctgctttcctggtcatacctgaaggggagaccacagccccagctgacatcttgattgtagcctaatgggaccttgagcagagaacccaacaaagccacacttgggctcctgatccacagaaactgggagatcataaatgtgtgttgttttaagttgctaatttgtagtgatgttcttatgcagcatagataactcatacacagagaaccaaggccacgcgagaaccctgtgggggcccctgctgctcagccactcctcacatgctgggacagctgtctctctggcctctagcaccaaggtccccactatcccaggccttgactcttggatcagagagggacaaaagccccatggagccaagcagactcctccccctgggctgcactcacctagcttgtctggcacacacaagttggagtagagaaggcaggaagccctgggaagggagagggtgatggccttgcttaactgggatgagtgtccaccaaatttcccttcccacttcccctgctcatgagcccccaggggacctgtgtcagttcactttctagaggcttctatgtgccctaacttggatgacacccacgggcctccccaactcagcacagggaacatatgcccatggtggcatggggaaagaacccagcctctcccctgcccaggctcctgcaccccatagctgtcacccctctggaacctctcagggcagcacgagtggtagcctcggagtggccttcaccctccaggcactgcggtcctccagattggctcacagcccagctcttgctcccatatccacagccatgagagcagccacctccccagggggccataagcgcttctcaccaggagcccacctaggccaggagggagctgggggcaagttccaactgcccccttgaacactgcatacccatgaatctggcaggggcatctgggaagagatttgaccactgaaagactgtagggaaacccttgaacctcaatccgctacgccacgtggatttgcttcctgtgggctgcccaagagcgcctctgtggtgaaggaagcttctgaggatgggccactaaagatggccaaggtcacctttctgtgctgtccccactctgcactccatctcccatcccacactgcctccagctggagggagggagggagggttgtacgtctgtgtccctgccacactgtgaactcagccctatcttccttgtcttcctcacagcctctggctcagaggaggacctggacaaatggatgataggtaggcaaccacccaaatgttcctcattgactgttctctagagctgcttagtagagaccaggagtgtgtgggaggaaagccctggtaaacttcgaccctgagacagaagacctcagcagccttcagcatgggatgcagcactttctttattgcccatccagggaacagccaagccagctccatctgcattctggctgcagcgtgtacattaggggactcaggggccacagtgtgggaccgtgcacactggcaaggcactggcggatgctggcaggccagtggacatggatagatgagaatgacaactcacagatgtcctagcttctgctggcccagctgccagccactggccatcacccttttgcccagcatgtgtgcattgtcacccaaaacatcttgaaacttgccattagtgaggcattcaacaaagaagtaagctaagtgagtaggaaacagtgtttcctggaatataccgcactctgcctgaaataggaaaactatgtttgccgggaagcagcagcagcaggaaagaagttataccaaaaacgacttgtacaccacagacattataaccctttcctcaaagaaacagtcatgttctgttgggtattatggacaggtctctggaaatttatctaataaagaccaacaaacttccccagcagtgcctctgagtaccgtgtgaattctggtgtcttgtggaagtcagggtgccttctttgcatccaaagctttgagggagctgggaagctttggttccattttaggagggctgtgtgatggtgacaaaggtgttctggtcatttctgctctgttctccgttctgtgaagtgaggtggatgtaatgtgctgtgggatggggtgctccatatgtgtgtgtagcctttactttccaacttagttttttgcatctctcttgtactgatgagccatacctctcagccttcatttggtcccaggcctgaccctttgctttcatcgtcagcttttctgtcctgctcgggcaggattaactctgttcttgccgcggatgtcaccatcactctggagtccagcccagtgcccacaggcccgatcagttcaccctcttccttctcttcaggggagaaactttctcgggcatcaaaaaacgtgattgtttcttcttgaagtttttgttcttccagctctgccccatcttcggtgcttttgcttttcttggtaggagatgaggagaaccctaatttgggaaatcggaaccagcctgccttctcctgttttttaggcagttctgcctctggtcgtgcctcaggctgtgtttgaatgggagcagatctctggacgtcatttttggaatcaacacctgtctcatcaacagaagaggaaaacccaatgtttggaagccaaaaccagagcagaccagattttttactttctggtttgtcttttggagccctgccttcatctgccagtggtgtggttgcctcttggctatcatcagggggaaactcaagaatttctgctggctcctcatctgaacagctgtctgcaagctggtggccagaaggaacttcaaatgtgagtgtttgctgtcccagtacattgacgctggaagagatcatctcaaatggttctccagtgtcaggctggagatctccagaaatggagtctactcctggggtggcttgtatgggagcctcttctgtgccctcctgagtcctagagtgttgagtcattgttgtgtacactctagcctgcgtgtggggctctgggattttcacttttaataaggaaaatccgtacgaaggtgtttgaatctctgacgtggggatctctgattcccgcacaatctgagtggaaaaagtcctgggtactgagagatctacaaactctggtgtcactatgctgtgtatagtgacctcttgactttcaacctgagcaccctgaatatgcactctgacctttgaaattgggggagcttccaaaggcaggttaaggtccacaggctgctccccagggaccccagcacctgccttcaggatgctggctccccagagccccggactttccttacaaagggctgtatcaatattggcctctggacactgcacttccctcacagtggggatgaacacatcatcctctgagctgggggcagggaaggagaaccttggtaccattaatttggggaatttgacagttaggacagaatcttcccacagttgatccacattaaccacagaaatctgggatggcatatcagtacttgaagctttcaatttaagtggaccttcaggctgggaagaccatttctctgttttatcctccatgctggcaaggtcatgtcctggcttggaaagaggagtctcatctatttctcctggaagaacctgggtttctggaagcctcatgccaggcatctgaaaagggagaggtcctttggatggatggatcctgacctcagaagtggaaagctcatccccagtcatcccagcagtggagaggtgcagcttcaagcctgtgctgtcaagatcacaccttagaatatctgtggatgatttgctctcagaagctgtcacttctgcatctgcctctgggagctgtagggacatagctgcctccacgtttgacccagaaacaaggaactctttgactttagctgctgcttcaccccctgttgctgccggtgcctgtgtctgagccacttccagctttccagccccgcctctgtccctgaaagagcgcctaaggctgggcatgcggaacttgggcattttaaaccagctttcctgcgagtacttggtcatggcttcctcctctgggctttccactgtgaggacttcagcatctggttttctacaggatggctggaggggatcttcaggtgtgggggctatcccctccccacaaggctggctcactgggacatccccgagcccacatcctctgctgtcaccttcggtagacagatcatgtttgggaagaggcaggtcagcttcaggctggctcacctccaccttggccttggaggatctgagatcaggtttggcaaagcccaaactgggaatgtggacctgtggccggtggaggttcacaccctcacttcctgtggcacttgctgttgcaccaagtcctcccctaccaccgtcactgctggccttttctgtgtcttgaaagctaccccctgctgtggcactagaaagggaaggatccacgtctctctgtggcaggctgaccccactcttagaagccttcattttgggaagtgcaagttttggcatggcaaagccaggctttgtgctcctccccttctctccatccctctcaggaggcagatccatgtggatggcagactgcggggccacttcatccttgtctaaaaccaggctgagttttgagtcctccacgctgcattctgggtccacctttggccctgtttccttcttcggggaccacctaaatgatggaagcttaatcttaggcattttcaagggactccctttcccttcgtggtcagcatcttcagaaggggcttctccaggggccactactgatgtctgcaaggaggccacaagctcttctgggccctgagacacacaggtgcctggggatggcagctgggtgcttggcaaggggcactgcactctttctccagggctaagaggagacatgactggggcacccactgctgcatgtaggtctccctcaggaactgccatttgggggactgaaaacacaaactttggtttatagaatttaggaaaagatacctgaccaagagaaacaggaatcatggaattcagtgggccagagtgactctcagcttgagatgttggaactccctctggaggctgcaggtcagtggagcactctgtcttgggaagaggaatatcagcctgagacccagaaggaatttccagagcaagctcaggggccaaggcagctctgggaacagtcacctggtattttgtaagtgtaacatcctcacagggagagagaatagaagattcaaagtgaggaccagtgagatcaagccgggatgatggaaacccagcaaaacccaccttaggcatctgcatggatggctctgaacaagccgaaacctgttgtaattcaaaacttgagcattctgaagatgataaaggaatcgtggaaagacctatgctagactttgcacctgggactaaactatctttaggagttttggtagaagaaaatgaaactttgggcactttaaaatgcagtttcttaaacttcgaatccattccaacttctccaacagcaagccccaagttaccatcgcgagatggatcatgaagatcaccttcatgaacaacagattccacaatgggaaatgtggaagtcttctcatggaatgtaacatttccttcgatttcagaggaagacatggaaactttctttgacgaccattcaaaaccagacgtgctcagttttggtccttgaaacttactgtctttcccagctacatcctcgtgggccagggacaggtccccctcaagccgcgcaccatccagcatggatcctggggcctggacatccgtctccacgctgggcagagacacctccacatcgggggccatcacctctgcctttgggcctttcaggtccagcttggggcccttgacgtccacctgggggcccttgaggtccactttgggcatcttgaaactgggcatctccaccttgggcaggtgccctttgaggccggctacctcgggcatgtggccttctggaagtttcaagtccacctggccagcctggacctccaggtcggcggaaggggcctgaatgcggaggtcagtggtcttgaggtccccctgcatggagggaatgctcatgtcggcctccatctttggcgcagacacatccaccgagacctcgatggacttgcctggggacaacatcccaaaggatggcatcttgaacttgggcattttgaacttgctgtctttggcagtcacgtccttgtcagccagggacaggtccccctccagccgcgtactgtccagcttggctcctggggcttggatgtccacctccatgctgggcagagacacgtccaggttgggggacgtcacctccaccttggggcctttcaggtccagcttggggacattaacgtctatctggggacccttgaggtccactttgggtaccttgaaactgggcatctgcagcttcggcaggtgccctttgaggccggctccctcatgcacagggccctctgggagtttcacatcctcttggccagcctggacctccagatcagcggaagggggctgaatgctgaggtgagtggtcttcaggtccccctgcatggaggggaggctcacgtcagcctccaccttcagcgcagacacatccaacgaggcctcgatggacttgcctggggcagacaccccgaacgacggcatcttgaacttgggcattttgaacttgctgtctttggcagtcatgtccttgtcggctagggacaggtcaccctccagccgcacactgtccagcttggctcccggggcctcgacgtccacctccatgctgggcagagacacctccacgacgggggtcatcacatccgccttggggcctttcaggtccagcttggggcccttgacatccacctgggggcccttgagggccactttgggcatcttcaaacagggcatctgcaccttggggaggtgccctttgaggccggctcccttgggcagggggccctccgggagtttcacgtccacttggccagcctggacctccaggtcggcggaaggggactgaatgctgaggtcagtggtcttgaggtccccctgcatggaggggaggctcacgtcggctttcgccttcagctcagacacatccacggacgcctccatggacttgcctggggccgacaccccgaatgatggcatcttgaacttgggcattttgaacttgctgtctttggcagtcacatccttgtcggccagggacaggtccccctccagctgcacaccatccagctttgctctcggggcctggacgtccacctccatgctggacagagacatcttcacatcaggggctgtcacttccgccttggggcctttcaggtccagcttggggcccttaacatctatctgggggcccttgaggtccactttgggcatcttgaaactgggcatctgcaccttgggcaggtgccctttgaggctggctccctcgggcacggggccctctgggagtttcacgtccacttggccagcctggacctccaggtcagcggaagggggctgaacgctgaggtcagtggccttgaggtccccctgcatggaagggaggctcacgtcggcctccacctttggcgcggtcacatccactgatgcctccatggacttgcctggggcagacaccccgaacgacggcatcttgaacttgggcattttgaacttgctgtctttggccgtcatgtccttgtcggccagggacaggtccccctccagccgcgcaccatccagcttggctcctggggcctcgacgtccacctccacgctgggcagagaaacctccacatcaggggctgtcacttccaccttggggtcttttaggtccagcttggggcccttgatgtctatttcagggcccttgaggtcgactttgggcatcttgaaactgggcatctgcaccttgggcaggtgtcctttgaggccggcttcctcgggcacgtggccctccaggagtttcatgtccacctggcgagcttggaccgtcaggtcggcagaatggggctgaatgctgaggtcagtggtcttgaggtccccctgcatggaggggagactcacatcggcctccaccttgggtgcagacacgtgcaccgaggcctcaatggacttgcctggggcagacaccccaaatgacggcatcttgaacttgggcattttgaatttgctgtctttggcagtcacatccttgtcggccagggacaggtccccctccagctgtgcactatccagtttggctcttggggcctggacgtccacctccacgctgggcagagacacctccacatcaggggctgtgacttccgccttggagacttttaggtccagcttggggcccttgatgtccacctgggggcccttgaggtccactttgggcatcttcaaactgggcatctccaccttgggcaggtgctctttgaggccggctccctcgggcacctggccctccgggagcttcacatccatctggccagcctggaccttcaggtcggcagaagggggctgaatgctgaggtcagtggtcttcaggtccccctgcatggaggggagactcacatcggcttccaccttgggtgcagacacatccaccgaggcctccatggacttccctggggccgataccctgaatgacggcatcttgaatttgggcattttgaacttgctgtctttggcagtcacgtccttgtcagccagggacaggtctccctccagccgcccagcatccagcttggccttcggggcctggacatccacctccacgctgggcagagacacctcgacatcggggactctcacttctgccttggggcctttcaggtccagcttggggcccttaacatctatctgggggcccttgaggtccactttgggcgtctttaaactgggcatctccactttgggcaggtgccctttgaggccggctccctcgggcacggggccctccaggagttccacatccacttggacagcctggacctccaggtcagcggaagggggctgaatgctgaggtcagtggccttgaggtccccctgcatggaggagaggctcacgtcggcctccaccttcggcgcagacacatccagcgaggcctcgatggacctgcctggggccgacaccccgaaggagggcatcttgaacttgggcattttgaacttgctgtctttggcagtcacatccttttcagccagggacaggtccccctccagccgcgcaccatccagcttggctctcggggcctggacgtccacctccacgctgggcagagacacctccacatcagggactgtcacttccgccttggggacttttaggtccagcttggggcccttgatgtccacctgggggctcttgaggtccactttgggcatcttgaaactgggcatctccaccttgggcaggtgccctttgaggccagctccctcgggcacgtggccctccgggagcttcacgtccacctggccagcctggacctccaggtccacagaagggagctgaatgctgaggtcagtggtcttgaggtccccctgcatggaggggaggctcacgtcggcctccgccttcggcgcagacacatccaccgaggcctggatggacttgcctggggcagacgccctgtacgacggcatcttgaatttgggcattttgaacttgctgtctttggcagtcacatccttgtcggccagggacaggtccccctccagccgtgcaccatccaacttggctcctggggcctcgacgtccacctccatgctgggctgagacacctccacgtcgggggccgtcacatccatcttcgggcctttcaggtccagcttggggcccttgatgtctatctgggggcccttgcgatctactttgggcatcttgaaactgggcatctgcaacttgggcaggtgccctttgaggccagctccctcgagaacgtggccctctgggagcttcacgtccacctggccagcctggacctccagttgggcagaggggggctcaatgctgatgtcagtgttcttcaggtccccctgcatggaggggaggctcaggtcggcctccacctttggcgcagacacatccaccaagacctcaatggacttgcctggggcagacaccccgaacgacggcatcttgaacttgggcattttgaacttgctgtctttggcagtcacatccttgtcggccagggacaggtccccctccagccgtgcaccatccaacttggctcctggggcctcgacatccacctccatgccgggctgagacacctccacgtcgggggccgtcacgtccgtcttcgggcctttcaggtccagcttggggcccttgacatctatctggggtcccttgcgatctactttgggcatcttgaaactgggcatctgcaacttgggcaggtgccctttgaggccagctccctcgggaacgtggccctctgggagcttcaggtccacctggccagcctggacctccagttgggcagaggggggctcaatgctgatgtcagtggtcttcaggtccccctgcatggaggggaggctcacttcggcctccaccttcggcgcagacacatccaccgagacctcaatggacttgcctggggcagacaccccgaacgacggcatcttgaacttgggcattttgaacttgctgtctttggcagtcacatccttgtcggccagggacaggtcaccctccagccgtgcaccatccagctttgctctcggggcctcgacgtccacctccacgctgggcagagacacctccacgtcgggggccgtcacctccgccttggggcctttcaggtccagcttggggcccttgacgtctatctgggggcccttgagatccactttgggcatcttgaaactgggcatctgcaccttgggcaggtgccctttgaggccggctccctcgggaacgtggccctctgggagtttcacgtccacctggccagcctggacctccagttgggcggaggggggctgaatgcggatgtcagtggtcttaagatccccttgcatggaggggaagctcccgtcagcttccaccttcagctcagacacatccaccgaggcctcgatggacttgcctggggccgacaccccgaatgacggcatcttgaacttgggcattttgaacttgctgtctttggctgtcatgcccttgtcggccagggacaggtccccctccagccgcgcaccatccagctttgctctcggggcctggacgtccacctccatgctggacagagacatcttcacatcgggggctgtcacttccgccttggggcctttcaggtccacgttggggcccttaacatctatctgggggcccttgaggtccacttcaggcatcttgaaactgggcatctgcagcttgggcaggtgccctttgaggccggctccctcgggaacgtggccctctgggagtttcacatccacctggccagcctggacctccagttgggcagaggggggctgaatgctgatgtcagtggtcttaaggtccccttgcatggaggggaggctcatgtcggcttccaccttcagctcagacacatccaccaacgcctcgatggactcgcctggggccgacaccctgaatgatggcatcttgaacttgggcattttgaacttgctatctttggctgtcacacccttgtcggccagggacaggtccccctccagccgcgcaccatccagctttgctctcggggcctggacgtccacctccatgctggacagagacatctccacatcgggggctgtcacttccgccttggggcctttcaggtccagcttggggcccttgacatctagctgggggcccttgaggtccatttcaggcatcttgaaactgggcatctgcaccttgggcaggtgccctttgaggccggctccctccggcacagggccctctgggagtttcacgtccacttggccagcctggacctccaggtcagcggaagggggctgaatgctgaggtcagtggccttgaggtccccctgcatggaggagaggctcccgtcggcctccaccttcggcgcagacacatccaccgaggcctcgatggacttgcctggggcagacaccccgaatgacggcatcttgaacttgggaattttgaacctgctgtctttggtagtcacatccttgtccgccacagacaggtccccctccagccacgcaccatccagcttggctcccggggcctcgacatccacctccacgctgggctgagacacctccacgtcgggggccatcacgtccgtcttggggcctttcaggtccagcttggggcccttgacatctatctgggggcccttgagatctactttgggcatcttgaaactgggcatctgcagcttgggcaggtgccctttgaggccggctccctccggcacggggccctctgggagtttcacatccacttggccagcctggacctccaggtcagcggaagggggctgaacgctgaggtcagtggtcttgaggtccccctgcatggaggggaggctcacgtcggcctccaccttcaacgcagacacatccgctgaggcctcgatggacttgccaagggcagacaccccaaacgacagcatcttgaacttgggcattttgaacttgctgtctttggcagtcacgtccttgtcggccagggacatgtccccctccagccgcgcaccatccagcttggctcctggggccttgacgtccacctccacgctgggcagagacacctccacatcaggggctgtcacttccaccttggggtcttttaggtccagcttggggcccttgatgtctatttcggggcccttgaggtccactttgggcaccttgaaactgggcatctgcagcttgggcaggtgccctttgaggccgacttcctcgggcacagggccctccaggagtttcacgtccacctggccagcctggaccttcacgtcggcggaaaggggctgaatgctgaggtcagtggtcttgaggtccccctgcatggaggggagactcatgtcggcctccaccttgggtggagacacatccaccgaggcctcgatggacttgcctggggcagacaccccaaacgacggcatcttgaacttgggcattttgaacttgctgtctttggtagtcaggtccttgttggccagggtcaggtccccctgcagatgcgcactatccagcttggctcttggggcctggacgtccacctccatgctgggcagagacacctcgacatcggggactctcatttccaccttggggtcttttaggtccagtttggggcccttgatgtccacctgggggcccttgaggtccactttgggcatcttcaaactgggcatctccaccttgggcaggtgccctttgaggccagctccctcgggcacgtggccctccgggagcttcacatccacctggccagtctggaccttcaggtcggcagaagggggctgaatgctgaggtcagtggtcttcaggtccccctgcatggaggggagactcacgtcggcctccaccttgggtgcaggcacatccaccgaggcctcgatggacctccctggggccgataccccgaacgacggcatcttgaatttgggcattttgaacttgctgtctttggcagtcatgtccttgtcggccagggacaggtctccctccagccgcgcaccatccagcttagccttctgggcctggacatccacctccatgctgggcagagacacctcgacatcgggggctgtcacttccgccttggggcctttcaggtccagcttggcgcccttaacatctgtctgggggcccttgaggtccactttgggcatcttgaaactgggcatatccaccttgggcaagtgccctttgaggccggctccctcgggcacctggccctccgggagcttcatgtccacttggccagcctggaccaccaggtctgcagaagggagcggaatgcagaggtccgtggtcttgaggtccccctgcatggaggggaggctcacttcggcctccaccttcggcgcagacacatccaccgaggcctcgatggacttgcctggggcagacaccccgaacgacggcatcttgaacttgggcattttgaacttgctgtctttggcagtcacatccttgtcggccagggacaggtcaccctccagccgcacactgtccagcttggctcctggagcctcgacgtccacctccacgctgggcagagacacctccacgtcgggggccatcacctccgccttggggcctttcaggtccagcttggggcccttgacgtccatctgggggcccttgagggccactttgggcatcttcaaactgggcatctgcaccttggggaggtgccctttgaagccggctccctcgggaagggggccctccgggagtttcacgttcacttggccagcctggacctccaggtcggcggaaggggactgaatgctgaggtcagtggtcttcaggtccccctgcatggaggggaggctcacatcagcttccaccttcggctcagacacatccaccgaggcctcgatggacttgcctggggccgacaccccaaatgatggcatcttgaacttgggcattttgaacttgctgtctttggcagtcaccgccttgtcggccagggacaggtccccctccagctgcgcaccatccagctttgctctcggggcctggacgtccacctccatgctggacagagacatcttcacatcgggggctgtcacttccaccttggggcctttcaggtccagcttggggcccttaacatctatctggggccccttgaggtccactttgggcatcttgaaactgggcatctgcactttgggcaggtgccctttgaggccggctccctcggacacagggccctctgggagtttcacgtccacttggccagcctggacctccaggtcagcagaagggggctgtatgctcaggtcagtggccttgaggtccccctgcatggaggggaggctcacgtcggcctccaccttcggcgcagacacatccactgaggcctcgatggacttgcctggggcagacaccccgaacgacggcatcttgaacttgggcattttgaacttgctgtctttggtagtcaagtccttgtcggccagggacatgtcctcctccagccgtccaccatccagcttggctcctggggcctcgacatccacctccacgctgggcagagaaacctccacatcaggggctgtcacttccaccttggggtcttttaggtccagcttggggcccttgatgtctatttcagggcccttgaggtccactttgggcaccttgaaactgggcatctgcagcttgggcaggtgccctttgaggccggctccctcgggcacggggccctctgggagtttcacgtccaattggccagcctggagctccaggtcagtggaagggggctgaatgctgaggtcagtggtcttgaggtccccctgcatggaggggaggctcatgtcggcctccaccttgggtgcagacaggtccacggaggcctcaatggacttgcctggggcagacaccccgaacgacggcatcttgaacttgggcattttgaacttgctgtctttggcagtcacgtccttgtcagccagggacaggtccccgtccagctgtgcgccatccaacttggctcccggggcctgcatgtccacctccacactgggcagagacacagccacttcgtgggccgtcacctctgccttatgacctttcaggtccagcttggggcccctgacttccacctgggggcccttgaggtccactttgggcatcttcaaactaggcatctgcaccttgggcaggtgccctttgaagccggctccctcaggcacgtggccctccaggagcttcacgtccacctggccagcgtggacctccaggtcagcggaagggggctgaatgctgaggtcagtggtcttgaggtccccctgcatggaggggagactcacgtcggcctccactttgggtgcagacacatccaccgaggcctcgatggacttgcctggggctgacgccccgaacgatggcatcttgaacttgggcattttgaacctgctgtctttggcagtcacatccttgtcggccagggacagttccccctccagccgcgcactgtccagcttggctcccggggcctcgacgtccacctccacgctgggcagagacacctccacatcaggggctgtgacttccgccttggggcttttcaggtccagcttggggcccttgacgtccacctgggggcccttgagggccactttgggcatcttgaaactgggcatctccaccttgggcaagtgccctttaaggccagctccctcgggcaggtggccctccgggagcttcacatccacctggtcagcctggaccttcaggtcagtagaagcaggctgaatgctgaggtcagtggtcttcaggtccccctgcatggaggggagactcaggtcggcctccaccttgggtgcagacacatccaccaaggccttgatggacttccctggggccgataccccgaacgacggcatcttgaacttgggcattttgaacttgctgtctttggcagtcacgtccttgtcggccagggacaggtccccctccagccacgcaccatccagcttggccttctgggcctggacatccacctccatgctgggcagagacacctcgccatcgggggctgtcacttccgccttggggcctttcaggtccagcttggggcccttaacatctatctgggggcccttgaggtccactttgggcatcttgaaactgggcatctccactttgggcaggtgcactttggggccggctccctcgggcacagggccctccggaagtttcacatccacttggccagcctggacctccaggtcagcggaagggggctgaatgctgaggtcagtggccttgaggtccccctgcatggaggagaggctcacgtcggcctccaccttcggcgcagacacatccaccgagtcctccatggacttgcctggggccgacaccccgaatgatggcatcttgaacttgggcattttgaacttgctgtctttggcagtcacctccttgtcggccagggacaggtccccctccagccgcgcaccatccagctttgctctcggggcctggacgtccacctccatgctggacagagacatcttcacatcgggggctgtcacttccgccttggggcctttcaggtccagcttggggcccttgaggtccactttgggcatcttcaaactgggcctctgcaccttgggcaggtgccctttgaggctggctccctcgggcagggggccctccggaagtttcacatccacttggccatcctggacctccaggtcagcggaaggggtctggacgctgaggtcagtggtcttgaggtccccctgcatggagaggaggctcacgtcggcctccaccttcggcgcagacacatccaccgaggcctccatggacttgcctggggctgacgccccgaacaatggcatcttgaacttgggcattttgaacttgctgtctttggtggccacttccttttctgtcagaatttgttccttttttaagcgtttttcatcgtgtattagttgtatttttgttgtgtttgtcattgagtcactgtcttctttgtcttttaatccttcctctgtgcgtctctgttctcttctatcagctgttgctgtggcctctccttcccttccctgctctgtgtcttctgtggctttttctctgcctgtctttgtgtgcttgcttggcgaccatcctaaggagggtatcttgaacttgggcattcttatctgtccttctgtgtcttccctgcccttgtcctgttcctcagtgatccttgtcctctgtagtccttcctctccatctccttcatccccctgtgcttctgcatgtgtggttggttccctgcccggcatccacccggctccttccacctcctcacccttcaggccagtacccgcttttgaggacgcatcctgtctcttccctcgctgtggggtactaaggcgcctttctctttctggctctttttctgtggaaaatgcaaattttggtgtctttaaatcgtgtactcgcaccctaatttctggtgggccaatctgtgtgcctccttcggttgtgtctctcaaggacagtctggcgatcccgatttccaggctctgcagtccctcgccttcaccctcccggctcattccaggagttggctgggccctgggcttcctctgggccactgctgtctcctgtgcctgcccctccagggtctttccatggagcctggctgccctgagtcccccttcctgaggggttccctcgcaaagtctagggtcaccgagctctgtgggcaatggcatgctctgagcaggcatcacttctcgatcctgttctgccctctcctctctcctgctgcctgtggcagccccagtctcctcgaggctatcaccccagggccccaactcttccaggaccccagcacggcccaccccactctggaaccccctgcctggctgtcctgtcgatgaagggccctgtcccgagcctgtcctgaatctgaggttgaggaacttccgcctcctctggctgcccggccctgccttctgctcttggcgctccaccgtgagctgggcctctgtgtctgtgcttgtaggggacacgtcatgtgcgtccctaggttcgtaggcctctgacgagctgtgtgacctctggggtcccggcccccgcttgctctttatggattgaaattttggccaagagagcctctccctctggctctgcctgcctctccccacccttggtttggagatgagtctctcttggtccccatctccttccagagttttcgtgggggtctctctgcacccatcagcaacatccgtgtcctgaaacatagggagagggaatctgttggtgccagtccaagaagcctggggccctggcccagggacagatggagtgggagtgctatcccctcccaggctcagccagcagggtagtgaagccagctggggccctgccccccgggcatagtggtctcacctccttctccttgccctgtgggccgtgctgggcatcgctggaagcccactcttcatcctgtggggcagggagctgccgtctgattttgaactgaaccttgtacggctctgaatattgaaggattttgagagcatcttcatattttatgttttcaaagaacacggttgtactgagcagctgatcccctagaccaagaaagagcagccccagggccgggtgtgtgaatgagacggggtctgctgtcttgccttggctggcgaggagggtcccggggacatgaatagggggaatcccactgagtctgccccaccagtcccccactgagtgcctcaggcacaggcaaggtggatggggtcccccattttactagatgcagtgggtgatcccagcctcaagctgttgagcagaggcgtgaggaggtcatcctaagctccaggtgtggttcttacccctcaatacccccctccaggtccctcccatcctggtggggagaatggtgaccccagggatggaactgccatggcaccttctctcaagttaaaaagcttggcggctgaggagtccttcagcacttgcttgacgaagatcccctggtccccaccacctgtgacactgtagccactggctcctgcctccacctctgtcttcagcgtcacctctgttgcctcctggacagcctggagcagaagcacatcagggccatggtgagcatgtgccagtcccaccataagcatccctgctggggcctgtgtctccagaggatgggcaccccaccatcctttccatcagcccagacaacacagagcagagtagggtacccaccaggtgggctcaggtagctgtctctgagctctggaggaagccagctggaacctgccagaactcttgtccccaccccaacctgccaggacttaggcacagcctgtccatgccaccaggcccagcagggcaccaggagcagcgcagaacggattctgctttccctgtggccagtttctctttttcagctccttcatgcattcttcacaaacgcgtgaagcaccagttgtgtgcaaggcacctgatgctcaagacaaggaagcacagcaatgccaaggaaaatacgggacattgggtgcagcctgcgagacctgggacaggatggggcctgtgtcctgcagagctcttggactgctggggcctccaaggaaaaaaactagttgcttaagaggcagagtgccctcatcattgggtgctagcagagtctagcaccttccatagttccatggcctgggtgctgactggccttttcagccccacagcttgaatatgcaacagacaccagcactgccccattgcacggaggagaaaatcgaggtctgtacagccaggtctacctggccaggagcttggctatgcatcagactccaccccagggaggggtggagagggccaggaccagatgtagccttctggagcccctgcccttccccaggcctgacaagggggacaagaacacccctcctccccagggcacggggcacactgccagcctctttgctcctcccctgcctgctctgacctcggactctctggctggatcccttgaggaccgacacacctctgtgaccctcagctcctgctgtacccacctctggacgactcatcctgaaaaatgtccgtgagtcccctgaatctcgcttccaccaggatctccgtctcccagcagaaccttgcctgccgggggcgtcttcctgcagccacaagtgttgggagttaggcacctgccccagctcagggacagggaggggcacaggtaggctggtgccagaccaggagccctcccttcagaggggcccagaacttccaacacacagctgtgtgcagaggcagccgagttcctccaggcacatccacagagaaaaggcaactctcggccttcctgcttcccgacagggcccagcctacagcccacagcacccaccctacagcccacagcgcccatagggaagccccacagcaactggagttttgtatggagggagataagaaattcaaattgtacaaaaatgaatcctttcatagacatgcctcctctgatcccttccccgagtccttgtctccagaggtagccatggggccctgtccccaaagacagcatgagtgtgttacacaggtgcagggatgcacacaccctgtgcccctgaaacacaaacacagtaacatgaggcctgtccccatcagcccatacgcatgctcacaagagctgcagggcacctccatcccactgtgccctggccggccacagggagggacccaagggcacagaggagtctgagaggacatctgagtgggcactgcccagtgggcagcggggcagggcagcaaggttgaacagacatgcgtgagttgcccacacagggcgatgcaggaggagacctgggtgcctgtggggctctgcccagcaggctcacctggagtccaaagtcggcagcctcagtcgtgtattcgtagacaggtgaagacccctgcggccgtggtcgaatgccctcatccgcaggcccttcagtcacctgacgggagagaatccagttatttttgccactcggttctcccagggcccagggagaatgggggcagggtatgaggaggacacacttcctcctgctctcacttacagagtggtcatcttccgtttctgcacctggctccccgggctgcagctgacggccggacactgcagagagagtggctgtcagtggagacaagcaggctgggggagcagatcggggcccgggggagggagccaggactgtatgtacactgtggaggtgtcatagtcctttcctggacactggatcggagagcaaactcaggggctgggggaagatctatagccaatgggctggagaggctgaggcatcacgtcaggtagcagtgaattgagactggacttattccaagttggaacagatttagtccaagaaagtgactaaacaaacacaaggcgtttgttattgtataaccacaccctgggaggatcagaatccagagctgccagaatatattatctaaaatgtccagcagccaccaaaaaattacaagttacgcgaagaaacaagaatgtatggtccatactgagaaacaaagcagtgaatggaaagtgtctctaaatgtctactaatgctgggtttaatacagacttcaaagaaactattaaaagtttgttcaggccgggcacggtggctcatgcctgtaatcccaggactttgggaggctgaggcgggtggatcacctgaggttgggagttcgagaccagcctcaccaacatggagaaaccccatctctactaaaaatacaaaattagccaggcatggtggcacatgcctgtaatcccagctactcaggaggctgaggtaggagaatcacttgaacctgggaggcggaggttgtggtgagccgagattgtgccattgtactccagcctgggcaacaagagtgaaactccgtctcaaaaagaaaaaaaaaagtttgttcaaaacacaaaaacaaatcatgtttaaaaaattaatggaaaatatgttaacaatggctcaatgaagagagaatctcataaagaaataaaacttattttttaaaagcaagcaaaaattctggagttgaaaatttactactggggttcaccaacagatttgagataccagaagaattatcaacttgtagattaatataaattaaccaatttgaagaacggggtcagggggaagattgtttgaagaaaaacagagtctcagagcattaaccataagataaagaggcagaagagagagttgaagaagtgatagctgaaaacaatctgcagaatccaagaagcgcgaccagacctaagcaggagaaacacagagatccacacctagaaacgtcacagtcaaaatgcttaagagaaagggccccatcacataataagggcacaaaaatacaactaacacctgaatcacatcaaaaccatagaagctacgagaaagtggaacaatatattcaaagggctgaaagaaactgttgtcaacgaagaatttgatatcaagcaacctatccttccaaaaataaaggcaaaatagtctgggcatgctggcttatgcctgtaatcccagcactttgggaggctgaagtgcgaggattgcttgagcccagaaactcaaggccagcctgagcaatatagtaagatctcatctctacaaaaaaaaattttttttttgagacggagtctcactctgtcacccaggatgaagtgcagtggcacgatcttggttcactgcaacctccgcctcccaggttcaagtgattcttctgcctcagcctcccgagtagctgggactacagacacgcgctaccatgcccagctaattttcgtacgtttaggagagacgggtttcaccatgtcggccaggctggtcttgaactcttgacctcgtgatccgcctgcctcagcctcccaaagtgctgggattacaggcatgagctgccgtgtccggcccaaaaatttttttaaaaattagcggggcatggtggtgcatgcctatagtcccagctgctcaggaggctgaggcgggaggatagcttaagcctgagaggttgaggctgcagtgagctgtgattgcaccacttcactctagtcaggcagagcaagactctgtctcaaaaaaataaaaatttaaattttaaaaaaaggaaaaataaaggcattcccaaatgaacaaagacttggaaatgtcattgctagcaaatctgccttacaagatatactaaagaagtccttcggactgaaaggaactaataccagacactaagtcaaatgcacaggaagaaatggagaatgcagaaaatggtaactatgcaggcaaatataaaagactctatgaatatatattgtcctcattttatttcttaacttctttcaaaaacagaggattgtataaagcaaggattgacaaacttttcttgaaaaaggcaatatagtggatattttaagcttaccaggccacatgatctctgttgcaactctgcagccatagtacaaaagcagctatagattatagataatatgtaaataaatgagcaaaactgtttcaacaaaactttacttgtaaaacaaaaaggaggctggatttagaagacagacaatcatctgtgaaccacttatataaggcaacaattctaacaccatattgttaggattataacatatatagatacagtatatacgtgacaataatagcaaaaaggagtaggaggagagggtatacagtcagcctctcatatcagtggtttctgtatcctgagttcaatgaaacttgggtcaaaaatgttctcccaaaaattgcacctgtactgaacacgtgtagactttttttcttgtcattattccctaaacaatatagtataccagctatttacatagcatttacattgcattaggtattataagtaatctagagatgatttaaagtataggggagggaagatgtatgtaggttatttgcaaatactacattgctttatagaagggacttgagcatccatgaattttggtatctgagggaggtcctagaagcaatccctcatggatgctgaggcacaagtgtaccctggaccaaagtttctataatttaccagaattaagctggcattgcctggggctgggagtgggaagggagattgattgtaaatggggttgagaaaatttggaaggtgatggaggtcttccagaactggattgtggtaatgtttgcacaactctataaggttagtaaaatgattgaattgtacatttacaatgggtgagttctatggtttataaactgtacctcaatgaaactgtaaaagaaaaaggtaattaactgtataaaacaaaaataagtcagcacggtggctcacacctgtaatcccagcactttgggaggccaaggagggcagatcacttgaggccaggagtttgagaccagcctggccaacatggtgaaacccctctctactaaaaatacaaacattagctgggcagggtggtgcacgtctgtaatcccagctactcaagaagcagaggcaggagaatcacttgaacccaggaggtggaggttgcagtgagctgagattgttccactgcactccagccttggtaacagaccaagactctgtctccaaaaaaaaaaacaaataaaataaaatgtatcttagaattttacaaatatagaagtaaagcatatgacaggatggggatggagtgcaaaagttgctgttgtgggccgggcacggtggctcacgcctgtaatcccagcactttgggaggccgaggcgggcggatcacgaggtcaggagatcaaaaccatcctggctaacacagtgaaaccccgtctctactaaaaatacaaaaaaatagccgggcgaggtggcgggcgcctgtagtcccagctactcgggaggctgaggcaggagaatggcgtgaaccccggggggcggagcctgcagtgagccgagatcgcgtcactgcactccagcctgggtgacagcgagaccccatcttaaaaaaaaaaaaaaagttgctgttgtgaagatcttacattatacttaaagtaggacaatcttacttgaaattatactgtaataagttaaatattcagggtataaagcataatgcaaccattaaaaaaataaaaagatgtataggtaataagccaatagtggaaccaaaatggaatgctaggctgggcacagtggcttgtgccgtaatcccagcactttaggagaccgaggcaggaggaacacttgaggccaggagtttgagactagcctgggcaacacagtgagacctcatctttagaaaatatttaaaaattagccatgcatggtggcgcacatctgtattcccagctactcgggaggctgaggtgggaggatcacttgagcccaggaggttaaagctgcagtgagccaagctcatgccactgcactccagccggggcagcaaagcaagaccctgtctcaaaaaacaaacaaaccaaaaaacacctagatctcctttttgaaacactgcagtaaaaactggcaaaactgaaaggagaaataaatccacaattattatacaataggagattctaacactcttaggaaatgataaccttacaaagtagaataggggaagatacaaaacacttgaagtacccatcaaccaacgagaccaaactggcactgggagaacactcctgacagcagccggtgcatgctgctctcaggtgcacaggggacagtcactgagacaggccccatgctggctcagaaacctgtcttgacgaatttaaaataacttcagtcatccgagttctcttctctgacccccagtggaatcaagacagtgcggcagaaacacaaatcagtgaacagaaaacaaagtccagaacagccccacacttacatggccaattcattcttgtttgttggttggttggttttgttttgagacagggtctcactctgtcgctcaggctggaatgcagtggcacaatctcagctcacagcaacttctgcctcctgggttcaagcgtttctggtgcctcatcctcccaagtagctgggattacaggcatgcgccatcatgcctcactaattttttttttttttggtacttttagtagagatggggtttcaccatgttgcccaggctggtcttgaactcctggcctcaagtgatccacctgccttggcctcccaaagtacaggcgtgagccaccatgcccggccaaattcttgtcaaagcagcccagttattccaacagaaagcaaagtcttttcaccgaatggtcctggaacagctgggtatttactgggaaaccaataaacctggacccttccatcccatcactcatgaaaatgaatttgaaatgaatcatagaggggaatgtaaaaccaaaaactataaaacttctagaagaaaatataggagaacttctttaacacctcgagggcagcaaagttttcttaggatacagaaggtaaggatcatagaacgaaaactgataaatttaagttctcataatttaaaacactggccttaagagctttcattttcctcagaaaacgaaaaggcagtgaatgtatctggcaaaggacttgcatggagcctgtgtacaactcaacggaagagaaaaagctcagctaaaaataggcagcagatttgaacagacatttcacaaaagaagatgtacgagtgttcaataagtacaaggaaagatgctcaacattttcagtcatcaggaaaatgcaaatcaagaccaatggaacagaacagagatcccagaaacagacacacgtacacaaagctgtgatgatctgttcaacacatggcctgggatccatgggatatccatatggaaaaacattaatcttcgccccacctcagccagagaaaattaatttcatgtggattacagatccaaaattaaaggcttaacaataaaatttctagaaaataaatagaaattacttttggagtaggggaaaaattcttaaacagaacacacaaaaaatgacagatattggtctatattaaaattaagagcttctggccaggcgcggtggctcacgcctgtaatcccaacactttgggaggccgaggcgggcggatcacgaggtcaggagatcgagaccatcctggctaacacggtgaaaccctgtctcttctaaaaatacaaaaaattagccgggtgtggtggcgggtgcctgtagtcccagctactcgggaggctgaggcaggagaatggcgtgaacccgggaggcggagcttgcagtgagctgagattgcgccactgcactccagcctgggccacacagcgagactccgtctaaaaaaaaaaaagaaaaaaaaaagagagagagagaaaagaattaagagcttctgttcatcaaaaaacaccactaagggcatgaaatgtaaattagtatagccatgatagaaaacactatggatggttcctcaaaaaattaaaaatagaactaccatttgatccagcagtcccactactgggtatatatccaaaggaaatgaaatcgataaattgcagctatctttgcccaaaacacagattgggcaaagatacctgcaatacatttaccaagcaaaggcctccaacccagaatgcacaaagaattcttgcaaaccaaaagacaaacaacccgatagaaatatgggcaagaaaacactggaaaggtagctcatagaagaggatattcaaccagccgattagtatatggaaagatggccagcatttctagtcatctgggcaatgctaacaaaaccacgaggtgccatatgctcccaggagaatggctgaaatggaaaagtcgaggcagaccacctggagacaaggcctagggcagctggaactccatcctggtgtgggttgggggtcagctggcgcaaccacttggaaacagcctggtagagccttaccctgtggcccagcaactcatagccaggggcagagccaagaaatatgcgcacatatgtccctcaaaagatggatgcaggaacatccatctcagtataatctgcagcacccagaaaccagagattcaaatgtccatcaacagtagaataaaaaaaaatgcgaggtatttgtccaatggaacagtatatggtataaactatgcctatgtgcaacgtggatgaagttcacaaacacaaggttgagacacagaagctagatataaaaagcgctcgtaccgggggagcccgtcacatccagctcacagtcaggctcaggccacctagggctgaagtcaccagggggagcaggcagacagggtctcctggagaggactaattacttgggtgtgccatggtttgtaccctttctccataaaaaattttagaattctatataaaatcaaacacaattataaactttacactaataaatctgaaaatttcgattgattggatatattcctagaaaacccacaagaagaaccaaacttgtccaacccacggcccacaggccgcatgtggcccagaacagctttgaatacggcttaacacaaattcataaacttcctaaaactttattacactcttttgcaattgtttcttttagctcatcagctatcattagtgtagtttatgtgtgacccaagacaattcttcttcttccaatgtagcccagggaagccaaaagataggacggacgccccgatggataatccaagtatttttgtaacgatttaaaaatcaacatggtgaaaccccatctctactaaaaatacaaaaattagctgggcatggtggcaggcgcctgtaatcccagctactaggaagactgaggcaggagaatcacttgaacccagaaggcagaggttgcagtgagccaagatcatgccattgcactccagcctcagcaacaaaagcaaaactctgtctcaaaaaaaaaaaaaaaaaaaagaaaagaaaagaaaagaaaaaatcaaatcccttatttaaaaccgtcccacaaaaaggactccagtctcaaccccactctgaattatactctaaatattccaagaagaaacagtaccaatcttacgccaactctggcgccctggcctgggctccagggcctccctcctgcagtgacaaggagggtctcagaactaaggcccccatccctgccccagacccagttgctggtaggacactgattgggaaggagcatgtccctatcctttggggtggtgtgctggcctcggggaccagctgctccctgtcccctgcggtaggtgtcctggccttggggactgtcccacgaagacagatggggaggcccagtcccggcagtggtctaggtctggctgctcctctggccagtgtgctgtgtggccctgagcaagctcatcccctctctgagctttcattccctcatggatatgtggaccaccctgcctgccctgactgtgggttgctgggctacagacactgctcccgcagaggcacccccagggccatgcctgctcatcccaagagcacctctgcctgcgcgggcccctgccactccctcaccgcttcacgggcctttccttgcccttctgcaagatggctcacagcccaggtcccctctggctctgctctcaggcctggcagggctggaggatggtgtctcctggaggaggttctctcaagcgaaggaagagaagggcaggaggtgagggcaggcagggctgggtcagtgccaggaggcatcaacactcacccccacgtcatcccggccccgccaccttcctactgctccgggggccaggcccagacccctggcctccataaccccccagcagagccacaacctccgtttcccccacctgccaaaccagccttgcccacggtgtcagcccaagaattgtacccctggcaaccccacaacacgatctcctccacaggccccttctccctaaccaggcagtgaaggggcaagaccctgtctcccttctgcacagctctgtcctggccacctgggcccatctcactcacctttgcattcagacactgccccaccacctgacagggcccctgctgctcccacctggacgcacccccaacctgcacagacagaacttggccagccccaccgctctgcctcccagatggctgccaaaccctccactccttgcccacctgccccctcccactccctccacgtggccctgccagggctccccagtgcaccccacaaccctgagggaccaccagctggggccaccccagcccctctggagctgcctggagctccagccacaccagacccacaacaaattcgtgggacggggtggtgccaaggaaagggacaggaatctggccagagcctgcccaccgctaagccaagggcaatggcaggtaagccactctctggcctcagtttcccttcctgctctgcccagaccctgccgctcaatccccaaggtgggtaacatatgtgaaaactgaggctgggggaggggagccacttacccaaggggacccagccagtaggtgtggagctggggcaactacctagcagggctgggggcagaggagggtccctgggtcacttggcccacagctgctcccctggcagcaggtgcagctggggtcatgagtggggaggggctccactgcctcggagaccgggtgtcccaggccctgcctagcactcagggtggggcaggtgttctgaggctgcccagaaacccagccgcctccccgtccctccgcagcctccccagccaaaaagccccacccagctggcaggagcctggatgggttgggggtggggggcagctgctgtgaggcccaagaaagggtcaggagggcaactcctcggagaagggactcgccaggcagggaaacacaggtctgctgggctgggggtgggcaccacggtcaagggcccctgagctgggcacagccggctgcactcccaaatctctccagggtagtcttgtgggtgttggggccggtgagggagggtgtcgacagcaagccctgggcacaccctgtgctgggaacctgcatgggggaaggaggaggagacgtgaccagccctgctcctgctggccctcgtgcctggtcctgccactggcccacgcgggacagtccccagccccaccctcagccaccgcactgggagcggctgttcctacactgcctgtagtggggatggagtgcagaggctcagcgagcggcagacctgcctctggccacagagctgcgcagtggggacccctccagtcactgggctggcaggagcctggcccaggaacacaaacaggaagggggaaatcctgcccgcctcgggataaggctgcgcagccaggctaccggcctcggacccgcgccagtcgggagagagaggaaggcccccagtatcccagtcccccgccaagagcaccgcctcccaggcccgagctcctgaggaagccccgcctcggccgcagagcgcaggggaggccgcctttgcccgcccggcctccggttctcccagacaggctctgcaagtggccccatcacctgaatcatgacactgtttgttgacggtcaccaaagccccacttcacagaggagaatgtggaggtgactcgcctgagccaggcccagctggtcaggccgttggcacctggttccttccccaatgcccttcccccactccccgggccccccagcgccctggcctcaacactaccattaacattcctgcgggtgaaaacttgaaccttgtggagggaccccgggacccaggtcagtcccttgcatgccagggcaggtgggggtggtaccacagtgaaagccgcagaggacacccaccctggcccagaaaagctgcctccccgagaactggactatcctggcgcagggcctgagcaggcggggcctcaggcagtgtgtctgggggacgagcagatcctggccgggaggcggggaggggccgagcgggaggggagaaggaacacaggcggggagtgtggcagaggctcaccaacacccctgctccacagctgggtccagattgaggactcccaccagccaccagctaaatgagagttcttggagggtccagaacaggtccgtggggggaggaggtggattttgcttaaacaaaatccaagtttgcctctaaactggcagccccagggccccatctctggcctccaggtgggagggcatggttgggtgcatttgcaagtccccagggccctgggggctggcagggaggagactggctctccagtggccggaaaagtccatcctgggtgggaggaacgaatggcccactccaggtttgcaggtgtgtgtgcacacgtgtgtgctcacaggatgtacgtgctcaggtgctagggcgtgtgtgcacttgtgtgtctggcctgggctcctccctctgaacacccatggacagcccagagtgaggccatggaggcgggagccctgtgggagtcactgccctcgggctggaaacctggtgcccacccagacacaggcacacacagccggccgcacttgggcctcacccagtcgtggaacttcatgaagaaggtgccaagcgggctgactgtcatgagaccttcagacttccctgagcaacatcccccgcccctccccgatgcttcttgagataactctctcgggatgagctcaggctcttgctcctgcctctgtgtctgcctccaaggctgcaggagggctggggaagccagactcagtcccctagacctgggagctgggctccttgcccatccagcagccattccccactgcagcccagctgcacccgtgaggctattcacatcaccctctcccgaaacaacctttcgtagctccctggtgccatccatcggtcagactggcctggcagcctctccgtgcctgctctagccctagccgacatccccagcctctccagccctcactgtgcctgcctgggccacaggcgctctctctctgggctttcccaggctgtcttctctgctgggcaaattcacagactgagcttggccaccctgccatggcttctggacactgccggctccctggtccccagaacactttgctcaccaagcactcagagcctggcacacagtaggtgcataataaatgctagtgcaggcagtgcatgggaaaaaggaaggagcttgtcagatctcctggaaaagcctggtaagcctgagggtgggagccagttgatggggatgggagggcagcaggtgggcccagttcatctccttctgctcctggagaaactgaggcacagggtagcacatgtgccacctctccaagggatttggcagccaaaaggaacagccccatgctcccatccatcccaggcgggctagcctgagccagtttccctgggctgaaaggccggccccacagacgtccagggcagtgtgaccctgtgatggagctacccatcgccccaggcccccacagcccacctcgggcacccccaggagagtaaacctggcctttggaagcaaccaccctccacagccacccagggcccctgtgcaccaagcaagcacacggtcatctgaggacccttctccaggccccacgcccaccttggggacttgcagacctgcggctgccctgaatgtgggtgctcttggcattcacctccccccacacccaggctccttggaaacaagagccactgtcccctacctgcccagggcccacagcttggtgtcctgccacacaccttgtatggcctgggctccgccggcaccccagggaccaggacccaggagaaggggctccggggctttctccctgacatccctgcccagcccgctggccctggctggagccacggtgaactaacacccctgcccgtctgtcagctgcaggtcgggggatgcctagcccagctctgttcctccagccccccttgctggtggcctgctggcccccacagacccgcggaagagtgaggcaagcaggtgtccggacatggacacaggagccacttaccaaggaagctacagacgctctcccaactggcccagaagcgaagatcccaactggccacctccccctgccacgcccggttcttccctccacagctcctccccccattgtcccgcctctgcctgctcctagggctggctctggaccctgccaggacccccacatcccaccagagggagtgggcgggtcccctgatgggccaggagcctggccagcccccaacactcactcagcttcttggagctggggaccccaccctgagtgcccacccccagcctgagcagctgactgcagaggaacagaccgctctgagtcacacagccagcccagtctggtgagtgccttagtgtgcgccaggtcctgctgtgtggacagacacaggcctgaggcaggtccctcctaggcaggctctgcacaaaccctgtgtctcagtttccctatgggggccaggacagaggctggcccagaagggaggagaggcatagcctaagggcctgcccccatggtcactgggccagtgaccttggggcctggtcatctgccacctgcctgagcccccagggcagccgaccctggcctcccttcagcccgctcagcccaaactcacagcggccaccacacctcgaagcaccagggtatctggtaagcagggtgcggtggggctcaggaagcagcattttttgaaacagggtctctctctcacccaggttggagtgcagtggtgcgatcatggctcactgcagcctcaaactcctggactcaaaccatcctcccgtgtcagcctctcaagtggctggggctccaggtgacgccaccacacctggctaattttaaaaattttttgtagagataggatcctaccatattgtccaggctgatctcatacgcatgggctcaggtgatcctcccgccttggcctcccaagtggctggggctgcaggcacacaccagcacgcctggctaatttttaaattttttgtagagacaaggtctccctgtgttgccctggctagtctcaaactcctaggctcaagtgatccttctgcctcagcctcccaaactgctgggattacaggtgtgagcctccgcactggcctagcttttttttttaacaagcctcccatccttccccgtcatttcaatacaagtggtggctgagaaacacctgagtcccatgaccccaagtcccccactatccagagctccagctgcctggcccacctcctggtcacctcaccctgctgcaccctgggcccttagcccccactcctctttgctctgggcagccaggaggctccagcaggactcaaccagctgtgctacgtgtagcccccctgggatcccagtgtgccagccctgtgcccatagcctgggtgtggacgtgcctccaacaggcagtctggagcaggcccacacagccgaggcccagcccaggccttaggggcagcgaggggtcagacccagcctgggaggtcagcgatggaacggcttgcacctgcaccaggccccaacggcatgggaagaggtgggaaggtgcagctgagagggctgcccccgccacgggatgccagggtggcctgaggtgggcacacagagaaggggtcctcaagtaggccagaggacttcaagggcagggaaggctctgtcccagccccagggcaggggcacttgccggcaaatggggtgggagaggcctcaggggctcctcaggcctgaaaggtggggacctgattccaggccccttctgggcctccccccattgcaataccctaaaaaggctgacacaaaaacctaacggtcacaaagatagaaaacgactctatttacacggaggcaggaaagctggccacgtctgctccagggacactcccagacagctctcacctgggaacgctgtttactgtttaccacctgacacccacactcagccaggcagggcagggctggctgagtcagcgccgtacccagaggcccagcctgctggagtgggacaggaaggagacgctggcacagagcggggccgtcatgccagacacagcactgacccccgcaagagcctttgctggggcccccaccccagctacgcccacctcacagcagccagagggaggtgccctgcacagctggccacagcgctggccacgcaagcccttcccagaccctcgctgcagtgcggccagtgtggtccgccaagccctggaacacatgacggagatctcctcctggtgcaccctccccaacgcggacagccatgggaacgcaccacaccctgccccaggccctctccagactctaagcacgtgccactggctctgcctggggcaccctcccagctcagatcctggacttgctcccccgccaggcactcagaaccgagccctcggctccagagcccctggcggtgggtgcccacagcacggtgcagacacacagcaagggatggggtcaggctggaggccctgggctctggctcagggggccacttactgggaagggtaagagctggagagccatgcttcacacctgcccctgttgctacccagtcccaagagaggcacacttgaccaccagcaggcgggtgctgggcagggccttgctcacctgcctcagttcccgggggccccacctaccggacccctggcaccacgtggtgggactcagtggtcaggcaggtgtctgatcagctggagggacggcaagcaggggctctgctaagccaccacatcacagaccctgagacctaggccatccggcatgtcccgtgatgcgcactgaacagctagtcctggctcagagctgctaggacccaggaccagctaggagtcgccatgggaactcggctgctggcgggggccagggagggctgagggcagcggatggtgaatcagccgggaggaggccaaggcgtgaagctcggcattctcagggcgtgtgtcaccaaggagcccgcggtgctggctcacccaggagccaggcctgccaagcagcaggagcagggcgaggaccgaaggctgtggccctaaacaaaggggccttaattccacctggtgggggtgagtcatggggcctcctgcccacccaggcgccatcacctgacagcccctccagccggcagggctcacacggacatagcccagtaagggtcccccaagtgtcctgcccctgccacatcccgggtacccccagctgcccctgcttggctataccctcagcagcgtccaggcaggggtgtggcttgagatccctttccggactcctgcctggaacagcctgggcaattgcctagcctcccaccaccgccacccctgcaggaaggagtccctcccaagagctctgcagagaggaggccccgatgccactcccaccctcacaagcacacattgggtcagcaggtccgagtgcgcagcagagctggcagggcagggacccgcagccggaggggaggggagggcggtggctgcaaaaacctctgcctggcctctgtggggtgcggggatgggggagtaccgcctcccgccccagcccctccccatcccctgcctcctgggctcagctccatgtttccattttagaaagtgcttctgactattaaatatttatccgagcaaggaaggccttgactcccggccagccgatgacttccaaaaaaagaaaaataaagggaaatctggaggcccaggctgagtgcaggtggggcctggtggagacaccctcaagctcgcagcgtggctggggatcccgtcacccttagagcgggtggaggggagcagaggagcatgccccgtcctccttgtgtgtccagttaagcctccgctaagctcccttagctaacctggcctccacatcccccacggagcagcttccttcccaccaaaactgccctaagacctatggggctccccggtgccctcaggacaaagccctccctccagcagctgacgctgccacctctccatcctcaccccaccccgtcccagatgcactgggttgaacaacttgcaggtccctgacttcgccctcagcctctgcaggctcctgctgctttgcctccgcttctttttcatgaccagtcccggtctccattgggccagttgtcctccagggagccctctctggcccttctgtgccccctaaggctgcactggccacaaaaatgggattcacatttgttgactgaacaatgggtggatccttcctctgctgagctatgacctcccaggtcccagggttcccggggtggctttgagacccagaaggatgggtgaacaggccgccagacagacggggaagcacccccacaactcacaccatccctgagcgcagggtccgtctctgccagccggaagaccaagctgggagagtgtggcattttactcctgaagtgggtggcagggacccccagatggccagtgccccccacttgctggggcttgggggcctttcctccccagcacctatacttctccacacctggccaagccagcccctagctgagcctgaaacacagaggccttccgcataggtgtcacaagaggaaggacacagagcgggccagagtctaagggagagctgggagtgggcccagcaacccaggggacttcccagaagaggcagctcctagcccagcccaggacagaagagcttggccaaatggagagaaggcaatgagggcattcctgttgtaggcccagccacgacgagcccggatgggagtgggcactcagcttcctgggcatggagaaggccgggagggagcgggctcctggggcattggaactggaggctctgcgggcttgaccctcctgtccacttctgagcctcacccccttccctgagctgcaccaggtgggcactgcctgaggcttggggcaggagccagaggccagcaggcagcccagcctccctccctggtggtccagcttctgtttccccaccagggaaagagctggggttgttaggaacacacttacagcatcactgtcggtggcttctgagaggccacctcactggagggcactccaggatgccctctgctgcctcctcctcaaggcccattcctgccactagcggctacagaggggctcctttgcctgcggtcaccctgcctggtggggcagggcagagccagcacctgtcagaacagcatgtcaccgaccaaagcgtgcgacattctgctctggcccctaagagcccagggagtcactgcgtcactgtccccagcctcagtgtccttgtctgcagaatgggaatacagccctcccccagtgtagatgacccagtcagggagacaccagggtggtgacagacccgcccgcgctgtcactcggcatccctggctgcgtggagctagcagcacaggcagctgcaatcactcctgaccccgaatgtgaggtcctgacccacatttgcagcctgaggccctgaagagggcaccagcgaggcacagaacagcgagaccacctccacagctgccttgctttgcacccttcttgggaaagggcccagccatctcatgacccccaccgcagagaagagaccacccacacatcttcgcatggtatcaccacctggggccttcccaacacggtggtgctttcttggggggtcgtgggaggtgctcaggccacaccggggcagcaggtgcagggtgggggccggggccggggaggggttccctgtctccccagttatcaggggcccagctctgcccctgggaaagaggcaacctgcccctggagtaggcaagagtgtgacacccagagcccactgggagtgaactggctggtgttacagtcggcagcgctgcgtggggtggtcccagcatggccaccagggggcagcctcggcacaaaagccgcccaggagatggctccctgctgggctggtgcctggtgtgtcgggcagagggcaggtttggactggacaggaagacgagagcaggggagagtccgcccatctccagcctgctgagaggaaactgcaggtggaaaaggcctggaccaaatccaggctgggaaaggcagtagttggcagggtgcttgtcaggaatgcacgttcctgggccgcagggttggggagggtctgggaaccggtgtgctggacagaactcccaaggtctctgatcttgcaagtctcctaccaaagctccagcgagagccactgaccttattccctaagagcggatggttccgtaggctggacacagggagggactgccccagacgggctgggaaccatgaagccagcacaagcctctgtggaggcagggggtggatgagatggtcctggaccctgcagcttgggagtctctgggtgcccgtgagtgaggaggaagcagagcagaaaggctgtgcagggaagctgggggcagggtagtggtcccatgcctgggggccctgcccttctccctctgaggaggtcgacctgcagccatgtgggcagggccagtcatagtgaaagaggagggggccaggggcctccagcccaccggagccatcatcctcccgctgctgtgcccaaacaccttgggctcccatctgcgacaccgtgaagcaggtgctgtaggggcctccctgctctggagccccccagacaagcctcccaccctaagtgcgcaccagacagacaggccacaggaggggccttggtagtgcctgctgcagctggggggcatgcccaggccaggggcacccctctcacctgcagcattgtcggcaccattagcattgacctgttttccccaaggagtggggtccagcctgcaccagtgccggccagcccaaccccctggccagtggctgccaatgccctgggtgtggtcagctgcagcagcatagacccagcgcccaagggactgccctgcccccctcagccctgccctccaagatgctgagacacccaggccccggaaccaggcccagtgcagggacagacacacaaagagcagcaggtacacatgccgtagcctgcggctcagagggaggctactgaccatccctgggggcatgccagtaggtagcacccactttcccttgcccagcactgcgggaccctgtggcctgactttgaccccattcaggcccctcaccaggccccagacctcaggcctagccctgccacagcctccacctagccagcgaccccaccacacagccacacagtagacgcagcccagccctgcctggaagccccggaccaaagtggagagcccagactcctggaccagcctggctgctctcccgcaaagcaggtgagagggcaagcctggtgcaggtgccccgggtcccggcggccccggctttcacgccccttgcagacaccagccctgctccagagtgcggtagcacctcccaggaggccgcctctcgaccagacagcgtcccaggagcggggcaggagcgagaaggagagacagacagggaccgcgagtgacagagggagtgagcgacagagacgagtcagccaccgagaaacaaagtgagcgacagagacagtctcagaggccgggagaggagcaggaacctacagccacggacaggtagaacgcgaggcatgggagaagagactccagcggccgggaaggcccagaaccacgcgcgagtcccgcaggcgtctccgagtcccccgcccccaaggcccgcactgcgcgcccctggacacgccccggcgcgcgccctcgcgcgtagcccacccgccccaggggagcgggctgcaggcggggaggggcgcaccgctgccgggggttccgggccaggtgggcagcaccatgtggaagcagtcgcacatcgcggcggccaggcggtgcgggcctggcggcccgtcgcgtccagtcgctggtcccggctccggcgcacggggcgggcgggcgggagccgcgctctgccccgctgccctgcgctgccgcgggcggccgacctcggactgcggacaccgcgcgccaggctacccagccgctcagctaggaccccgcccggctccgcccagccctgccgggccactgcggagcgcgctcgcgggcggtgccgtcggcctcattcagcccattggctgccgtcgccgcggccccgcccctcccagccaggccccgccccaccccgcgcccccggcccgcctgtcgcgtccgcagaattaactttggactcccgccagggagcgacctctggatccccgcaccgaggctcctggacttgccgctgtcttcacctcccattccgggggagacagacactttagtcagaagctggggtggggggcagcctgcggggacaacaggggtcgcgggcaccgcaggaggtgatctggcagcataaggacaagatagaattctgcaggggctggtgggtggcagatacgaggacgcggctgagagcgtgcagcgggaacagggcgccccgggcagggctgcggggtgggcgccgcgtgcgggagcgcccagcgctgggggcagtcctggagccagaaccccgcccagagtcatcctttctgctgattcttgtcaagagcctagggcctaggacacagcggcaaccagcaccccactggccctgccccaggggctccaggtctggcgtagacacaagcaagcctgtaaggatgaggcgttctgcagggcggcactgccctgggggcgggggaacggaggtcctggagggctcctggcagtgtaagctgggaccttaggggtgagacatgtgccaggcagtgtaggaagcgttctggagagaggggacagagtagcgtgtgtgcagagaatgggggcaaaagggctggggttgaaagtcaggcccagtgggcgggggcagggcagcaaggaggctgagggggctcctgtcggtaggaggtgccacttaaggctccaagcagggtctctgagcgtggtgagagctgaggaaagactgcgcaggtggctaggggtgttggcatggggcacagctggaaacaggagcagtggaaccacggccatggtatgggagggagtgaaaggatatgcaggcagaggggacttggtgaggatcagagtgcagagggtgggagcctccctgggatctagcttgggcaccacacagaggcagcacacctgggggtgtggacagggagggcaggggcccaagggagttctaagagtttggtgacgcctggcctggtgtagacccaaaccgggcataccccagaaggagtggagttctgcagggattgtcggggaaggcagggctggaagagacccaggagaggaccgccacctccatgaggagctgcctggcaatgtccaggggtgtgggtcagatgcagggacacacacacacacggacacacatacggatacacacacacatacatacatacagagataaagacacagagacacacagacacacacggacagagacacagacacacagatacacaggtacacatacagacacacacacagaggcacacacagacacacacagagacacacagacacacatggacagagacacagacacagagatacacaggtacacatagaggcacactcacacacacacagacacacacacagagacacacagacacatacacatagagacacaaacacacatgctctgtcatacacacacacacacacacacacacacggacaccttttcctggggtgggaagaggccaggctgtaccggaagggccaggcagacacacacactcatagataagatcacaaactcaccaagacacagacacaggccacctgagatatttgatacactcaggcctgcatgcatgaacacccacaccaggatacagacccatgcacgtgtatacatacacacaggggcacacgcattcctgggctcatttggagaccacgcacagctagcgggcccaggtgagccacccgggcacgatgactcaccctagacagttcccgttagccgcgctgcagccaccgggcagccatccagcagcaggtcagatggacgccagagccactgctgggaagaggccctggcagcctcctgccagtgagcccaggcatgatgggcacaaccttctccctcgtgtggggacctggcgcaggtcttaccccaccccctcgcagtgtccttttttcggggctgagcagtgttgcctggggtccagaggccctgcacttacctccctccccaggagcccaccctgctctggtcacctggagtcagtcactccctggacacagggagagagccactagggtgcctgggtgcatacacctctgtgtgtgtccctggatgtgtctatgcctctgcctggtctgctggggtttcgcccgctagtcctctgtgtctgagtctggctgcagggcctgggaacgaggggccgctcagggcactcacccacctttgtgtcctcagcccctttaggtgtgtgcccttgacaaagtcatgtggcctcctgggtccccatccaaatgaagtggcccctctcctgattgtctggcgtgatctgcgcagggctacggggactccccttggctttgcgggatgggtgaggatggagccctgggtggggaagccgaggttgcccccgacatgtccctgtccctgggctactacctgctgcccctgcctctgttttccttcagcaagatgagagaaccctccaggccatcttggtgggggccgagtgagagcgcaagttcagcgtggcgtcacgggagtgtggggaccccacacttgggaggactttgccctggtcctgcccctcagcctggggtggctgagatcttcccctagctgtgtccactgggcctgtcctcccctggctaagaaatggtcccagaaccaaccacagctgcccaggtccaggaactttgcctctgccctgcacggggctgcccacttccaaggtgggcacagacacacacacgcagctgcgccatgctcccctgtggccccagaattcaggatggggtctgggcagggcctgctccacccggaggccgtccctcccttctcctgcccactctgagacagagggctggtgtctctctgcagtggcctctggctctgcgctgccctgagtgctggggccacagtctggttgtgactgtcggggagctggggactgcccctcccaccctccttctgggggtcttctcctagcttgagggttaagctgacagtgtcatgagtaagacaccttggggtgtctgtccagagagcttccccacctcaaggaacctggggtcctgagagctctatctcactccagatgcctctgggagggcctgcaacttgggcagtgtacccccacaaacaggcaggctgcggctatgtgcagttgaggactggctccccaggggccagccagaatccctcctcccgcccaccagggcctcagcagctgaaacaggggtccagggtcacagctgtgggagcaggggagaagatgagaggggctgccagcccccatcccgggccctgcccgccagctgaagcctgcgctcctgtcgtcacgcccagctccagtttcctccccatgtgcccctctgaggacagatgcccagctagggaggaccacagaagcatgcctgggctcaggaattcatgcccccacccacagcatcgctggacacaagcccaactcacagccgcccctggcacatacaaggccccacacctgctgtaggtgtcaccccagggagagggcatcgcatgctctctcctgtgcacacagcctccacctcttccctggaccactgagatggggacactggcccagcccactggttgcccacagccttcctgaggctgggtgccggggcctgggtgaggagccgaggctccccaggccctgatcatcagcagagccgctgccctgcccccatggcctgactggcgctgcttgcctccaccctctgcaggcagggatgcccacagcatcaatgattgattcttgctgcggcagctgcagcaacataagcaaaaatagctctgctgtggtccctgccccgccccagccacagccttgcatccagcccagcctcgtgcccagatggaggggtgtgaggtgaggtgggagcatctaggactgtctcagccactgcctgcccctcctcagtcttttatacggagatgatgggggaggaccccctgaccaggtgggggacacttgtccacccagcctcccactcttgcctgaccacactgactcctgacctctaaccgcctcactctcccccaaagctgggtgcccgtttcaggcctgggtattgtccccaggtccacttcctctgcacccacacagctgggatcaggaaatgtggcagtggtggggcatgtcagggtgctgccatcgttccactcggatgggtttcttcaacccatgtcttcatcgggctctctggctcagcagtccgtgtgggctagcctgggatccgagcagcagcaggttcccatgctgccgcctgcaagccctggcactcctgctgccagaggtgaggacaggcacacgccccaacttgccctagggacttggggctgaggatcccagaggaccaggatgcctgggtgcttctggggacccctccccagccagtccttgctcatcaggtgatgctgggagatcccaagatgactgtggggctctgtgcataggtggcacttgccccagaacccaggctggccccttcctcctgagactagggtagggaagcttggctcctctgcagaagggaaggtgctccccacacagccattgagcagggctggggctcagggtggaccgaggtggctggagaggtcctgggagggccacatgggctcctcgtcccgaccacactccacctgccccctccatgcccctcgggagtcatggctaatgtcccccacacccaggctttaatgggaacccaccctctccggcccagtctcccctagcagctgggccagttcaatttgagcagtgcctgctccaatcgccaacctggaagccttatcctcagctcgtgcctttcaggctgtgccatgaagcaggatggtctgcccagaagctggcccaagaagccagcagcggcctagcagccacctgggctgcccccacctcctcctgcaaccagggttgggcacctgatgtcaaggttgccgctgccatttcctctgcaccttggcttccccgacgcagcacttctcagtgggtcacaaggggtcactcaggcatattagttccctgctgctgccataacaaaatacccccgacacagtggttgaaaacagcatgtgcgcatttatcaactccagttctaggtgtgggcaggatggtgtgccttctggaggcttcaggggagatctgttttctggtcccttcagcctccagaggcatctgcagtctcgtatcactccggctctgcttccatctttgcgtctcctctctgactctgaccttcctgcttccttctcaggacctttgtgattacatgcctcatccaggctccactcctcctctcaagagccttaatttaagcccatctataaagtgtctttgaccctgtaaggtcacatagccacaggttccaggggttaggatgtggacatctctgtggggctgttcaactgccacaccagctcttcaacccatatgggtcatttctatcctccaaccaccctgggagtactgtgctccccacgctcttcacgtggaagctgaggcccagacgggggtggggaattgcagagaacgaggagagcagctcctgtcccagctctgcttctcacgcaggcctttggggtggggcctcagtttccccacctgtacacaaggacaacactcctcctgcccccctcccagctccctgggcctcaaggacggcaaggacgtgcagtggatgaggggcagcagtgggaacggacactgcccttaagctggcaagacaggcccaggcctggtctacaaacccagccagctcctgatcaccatccttagggtcactgcggtgctggggtggccaagccaagatccagtcctgggcagtctgaccgaagagcttccatactgcatggcccggctgctctgcccctcaggaaggagcggggacaggaggctgggtctaaggtgcagagaatgatctcatcttgtcatttgtaaaattaaattgttctgtagcttggctgagaaggaccagggagggaaggggtgattcaagcaaggacagagtccaggcagggccccaggccccagggtgggagaaatgcgagcctgaggtagatagggggtggacagtaggtggcatggttcagggcttcaccagggccaggccctccccttacccagaggaggcagtgatgggggccagtctgggaaggccagggaggagatggagtcaaggttgactccttgagtctgggggtgagggcagatggcagaaggcctggaagcccggaggggagctgccagaggccagcctagctccttggtcgtccagtggctggagaggggctgtccgtcagccctgctctgcccgggtctggctggtgacaaaggaggggagcactccatgcggcctgcgagggaggggtggagcctccccgcagctccttcccccaggaatggggacgagttaggggcgggcgaggttttgggattcaggagtcagcaagacggacttggctctcgccagggacaggtggggtcctgaggggccgtcgctcagctgcacccacagaggggtcggcggcgcggcaagttaggctgcggggcgccgggagaaggggctgcgggtgacgggtgcgctgggacggacctggggagctcgtcgtgaggaagaaagaaccactctagggccaggcccagtggctcaagcctgtaatcccagcactttgggaggccgaggcgggcggatcacgaggtcaggaaatcgagaccatcctggctaacacggtgaaacccagtctctattaaaatacaaaaaaatcagccgggcgtggtggcgggcgcctgtagtcccagctactcgggaggctgaggcaggagaatggcgtgaacccgggaggcggagcttgcagtgagtcgagatcgcgccactgctctccagcctgggcgacagagcgagactccgtctcaaaaaaaaaagaaaaaaaaaaaaaagaaagaaccactcgggcggcgaactgagcacggacagaaagctcgagcggcccggcgcccagggctcggccagtgtggaagcccgatcccacccgcagcggaggcggcccggggcagggagggcgggtccggggcgggtcctgaacggcgggggccggcgctggcctcgccccggatgcgtgctgacgccacggcgacggacgccggaagcggagctggcgcacgccgttgccaggcaacggggcggcgcaggcaggagggaacggctggttgcaggtttctctcgccctggtcccgcgcggccccgccgaggcggcgaccaaggtgggtgcggggactctcgggagccgtgggccaggcgcttagccggccacctcgggccctgtccaggcccaggcgttccagggctgctctgcgggccgcgtgcgagagggactctcgggaggccccggggcgccgcacccactccttcccacttgggactcccgcgggcgcccggctctcgctcctctggccagcgtgggcctcccaggccccctcgcggctctctccagagcaggagccccaccttgggccgcccctctcacacctgccgtgggtctggtacgcgcctctgtgtcggactccgcgcccgcctgcgtgggaggaagccaggactcccgggcgaccgggccattcctgtggtttgtgtcagttccacagcagcacgtgggcactttccaccgtcagccactgggcagcccggggcactcctgcagcgtcccctggccctctccagggcaggggaaggttgggcagtcctgggcggccagcaccccggcgtgcatgtctcctgagcagctgcccatcgggcctctgctggcctgggggctccaagatgcaaggccggcgggagctggggggagagcctttgagtgacctccaggaggaagcagccagcgcttccctccgagtggcacctgagaggctgagtgatgacagtttggaatggagacggacctgccccgaccttctcctgtccgatgggaaagccagcatctccatgccccgtgagggcggttccacctgcactgcccgatgtcctgaccctggggaacacagcagcacttggggggagtttgaaggctttcgggaatcttcagccaagtctggacaattctcacagtcccttgaactcctcgagggacccacagaaccccagccaccgagaaccacttctgccccaaaagagtgcagttctcaccaaccatgccagggtggaccttgggtgacaggaacttctgccgtcccaccttctgaggtatttctgctgtgctgtggtcaccatgttgagtgggacgtgtacacaccaagaggcctacagccctcgaatgctgtggcgtgctggccagggagggggctgacagccccagagcgtctgcttctctcctggccttcgtccctggccatgtggttggcagtcccatcctgaggccagggaagcaatgagttggcagaggaggctgcagaaatgggtcacacgaaggccaggtgggggccacctgagctgggtcgctctttctgaccattcctcccccagcctgtccattccccattggtgggggctgcactggccccagctcagggcatttgaggaggagctttttgtctgaattctgaatctgctgagttcaaaagtctcagagattctaaaatcacatgatcacatttcaacttgcttgtaatgaattgggtgacgcgggatccaacctgtccgggagcttgtaatgaattgggtgatgcccattccgacctgtccgggagccagggtcccagccttcaggcccctgccccctgctctctttcagagcagactgtgggtgtttaccgtttggtgacacttccgctccttctcttttcctgtcttcttccttccattgttcctctttctctgccacttcttcccaaatggttcatcccaagcaccatcatgagagatcagaaataaaaccagtgaggaaggaaataaagatattgtagttctcagggctggcctgttttctcttccttttctttttttttttttttttttttttttttttttgagacagcctcactctgtcgctgaggctggagtgcagtggcactgtgtcggctcactgcaacctctgtctcctgggttcaagcagttctcctgccttagcctcctgagtagctgggattacaggcatccaccaccacgcccggctaactttttatatatatatatatatatgtatgtttagtagagactgggttttaccatgtttgccaggctggtcttgaactcctgacctcaggtgatccgcccgcctcggcctctcaaagtgctgggattacaggcgtgagccaccatgcccggccggactgttttctgaagcagtttccctggaatcctgatgagatccactcttaatagagtaaggtctgctgtaatgcttgttttgaatacaggatttgttttccagcgtgattgatgtattagggaacaattagagcatagttgaaatttcacaagaaagagtagataaatgcagaaaactgcccccagctgagctggggcccgttggaatacatgagactcgcacacgtacaccctcacacagcgcttagtgccccaatgtagcacacctgtcaacacctggtgttaggacttcacccggttcagaccaccctcctcctaccccttcacactaactcagcctgcgagcctttgtcttttccaaggtaaagtgctgtgcttactgtagtatgtataatttctttttttttttttttgagacggagtctctctctgtcacccaggctggagtgcagtggcacaatctcggctcactgcaacttctgccccccacccgccggattcaagcgattctcctgcctcagcctcctaagtagctgggattataggcgtgtaccaccacacccagctaatttttgtatttttagtagagatgggggtttcaccatgttggccaggctggtctcgaactcctgacctcgtgatctgcccacctggggctcccaaagtgctgggattacaggcgtgagccaccgcgcccggccgcatgtataatttcttaaccaaactggaaaacagcactgacattattgggtggtcatcttttttcatgtgtcactgatgaagtttgaatgttttgccctaaccccacctttcccatgagtcctctggttttgtgtgattttgctaacttggtgatttttaggaatgaatatgtcaagtgatagtaacactaatggtatgatcaattacaaatttcatttctatcacaattatttctttggaataaggtaacgttatgtatgtctttctcctaactttggtatgcttttcttcttttcttttcagcccattctcagctatgagaacattttaaagtgtgcttttcaagaaataacagtccagcaggcagctgaagacgtttccaccatagaccatttcctagaaataagcagtgaagaaaaacctggcgttgaacgtgtacataaattgtggtaatgaactgaagaaatatttcttacagcaactgcttttgtacttttgtttgataaaagtaggtgtgtgaggctttgtttttgcctttatggagagtagcatctctcctgaggtccctgccatctgtgggtcataggggtcctatgagaaggggcagcacgattggcgctccagctgtggccttccactctgagccctattcatcctcctccccagccagctcacctggagcagctggacccaagcccagctccccttgggtctcagtgccagtgctggtggagtgggtgggggcctcgcattcagtgcgagtggctggtgggcctgggcagtgggcacaggggccttctgggggacttggctgagtgggcaccggctgcctcatggttctcagccacagagttctagaaaacgttccacactctggagccccattgtcagccccaggcccagccccaggggtgctcccggtgctgcctgcagggccacaggctcctaggggaaagtgcacccgcagtcactcgcagatggccattttccagggacacactttcaactgagcattgaaagacagacagcgctcgagtggattaggccgcagtggttgagaagctcgaggtaagttggcccaaggccccagagggaggagggaagtgaaggttggggtgagctagcttccctgtccctcggtgtggtctgcggagtgggtctcccagcagccaggggagagccaggtcagcctgctgatttttgtgtctctgagcaggcctggactttcagagagctctgcagacaggccattctgggctccagccctggcccaccgtgtcctctgctggggtccaaccagcacctgccccagggtaccctctacaggggcttgaggacagaggcctggagcccagaaggccgcaaccagcattgcccagatggcccgtgtgccctctgtgtgtggtgcttctgcaaagcatgatccctggggaaaaactgtggagaatgtggtcccagcaagctgacggtgggggtgggctctgtgctggcagcattgacatctctgtccccagcagcacaactcgcggacccagaggcatggggagtcctgggtgtcaggacttggcggggctggacactcgtgggacagaaggctggatggtactttgggggtggagtagagcatggtttgtgtgttctgaaacactggggtatttttggaaatggtttggtgtttagcacatttgctcttcttctgtactcatctggagtgcagtggcaccatctcagctcactacagcctccgtctcctaggcttaagcgatcttcctgcctcagcctcctgagtactgggactacaggcacccgccactacacccagctaatttttgtattttttgtagagacagggttttgctatgttgctcaggctggtctcaaactcctgagctcaagtgatttgccctcctcagtctcccaaagtgctgggtttacaggtgtgagctgccgcacctgcccttgcactcattttcccttccatactagaacgtgaacttcctgcaggcagaccttctcagtccctcacagtgcgtagcagtgacgtgtggcacatagtagacattcaccgttggtttgctcatttgttctcctgagcatgcactggtactcgtagtttgggagcatctgttttgtactcagcacagttctaggcacttgagtgaacaaaaccagcaaaatatctggtctcacggagcttccactccttggaggagacagtaacggcagtaagtcagctactccagggcaggtgctgtgaggcatagagggggcacgggaggtgggttggggtgttgaaggatggcacgtgttgtttgaataaaagtataaatgaacaaataaatgagacagcccagtgctcctgcagggaatgctgtttttatttgtttttttgtttgtttgtttgagacagagtctcactctgtcccccaggctggagtgcagtggcgcgatctccgctccctgcaacctccgcctcccgggttcaagcgattctcctgcctcagcctccccagtagctgggatgacaggcgcccatcaccacgcccggctatttttttgtatttttagtagagacggggtttcactatgttggccaggcagatcttgaactcctgacctcctgatctgtcagcctcagcctcccaaagtgctgggattacaggcgtgagccactgtgcccagcccgggaacactgtttttagagttcttaacagccatacgcctcttggcttgtgcgcgtctcggcttgcgggtaaaggccaggcgccccgctgcgtgcctcgggccgtgcctcatgatctcctcagaaggctctcaaggtcaccttttaacaagtgcatctgttttccagtaacgaatccagaaaactctggagagcccttcagagcatacacaccacgtctacttctcagcgcctctggagcgagtcccgttgccaggagaacttctttcttgttctcggaatagatgctgcgcagaaggtaggcggtttgggttgacacagggctcctgggagtgtggttgaacttcactgtcaccagtggcccttggccgcgcccaaggggtgggtgcaggcagaggtgtgggttcaggtgggttaaagccactaggtggccccataaacgtgtcagggccactggatgactcccgaatgcttgaggcaggagccagcaaagcctagagcaggaggtggggaaaggctctggaaggaacgggcctgagcctgcagcagacaacgcattcagagatgtgcaacagtgtgtgtgcactcatgccactgccgccgccacgcacatgccaccacgcacacgccgccacgcacacgccgccacacacacgcctcacacgccgccatgcacacacctcacgccaccacatgccgccatgcacacgccgccacgcacacgccaccacgcacacgccgccacgcacaccccgccacgcacatgcctcacacaccaccacatgccgccatgcacacgccaccacgcacacgccgccatgcacacgcctcacacaccaccacatgccaccatgcacacactgccacggccaccactcacacgccaccactcacatgccgccacgcacacgccaccaagcacacacaccacacacgccaccacatgcgccactgccacgcacagactgccgtgcacgtgctcaagctcctgggctgtcgcagaaaacgccagtcatagggagggccgccttttcagagatctagatttcaatgatctttcctcattcttaaatattatggaaattttcaaacatggaaaactcaaaaagggccagccaggcaggcagattggccctggtgaagacaggggcatgaaaatggttgccctgttggcccatgggccacattgggctggccaggaaggaagtgaagggcagaaaggaacagagaggctcccagtgagattcgccctgactgtgtcattgtgtgaggaaaacagagaaccaggaggctaggaaatgggggaggcctgaatagaagcctcaggtgcgggccagctccgagtggcggcagcctgaagggtgtgtctgaaagtggccgtgaagacattattcccattgagcagttgaggggcgctgaggtcctgaaggggagcgaggcctgtgagccgggcatgaggcagcgagtggcagggcgacacaggggaaactggtgcgctgaccttgagaggggcctgagagaactttgcagttttagcatgaaattagtagaggggctcaggggaaaaggaaacaggagacaaaatgatgactgtaccggctgtctgatggggtctgtctccttagaacctttctggaggccagggccacatcatggaagattgtgacctcaaagagcctgaaggactcctcactgtcagcagcttctgtctccagcattgcaaagccctgatccagaccaaggtgagtggtcaccaaggagaggcctcagggaaccgcgctggcggtgtccacacatgtggagccctccgctttctctgatgtgagtcagttgcttgttttcttcctttaagtcttgtggacttccagaaaacaaacatttgtgctatttagggcagacaggcaaattgtgaacaccactgcagggtgccaaggaatataaataccatccggaaagactctcaggccagaggacccaggatatgggtgggtcacgcaggagaagccagggagagaagagagctgcagggaagctgagacgccaggtgtggatgacgaggctggaaggatgaggcaggaccaggctgtgactgttgggccaggggatgttgactccgcctgggcagctgtcgtgaacggatctgactggcggcttcagtcacgggccgcttaccctacacagggtctgcccacagcttttctctcatgagccgcggttcttgccacagagtcacttcatcacatcatcacagccgggctcaaggcagaagaggagatgggcagagaaggggacttcttcttgcagctctctcttttatcagggggaagaaaagcttttctgggctggagtctggagcccaccctcagaccaagtattgcaggaggggtgagatggccaggcctagctcacctggtttcctgctcaccctggagacccaggaccttggaacagtcggggctcattgtgtacacccaggagatggtgggaggggcgcatgggcggctgtgagcatgaagagtgacatgcagggaggcgcaggggtaaagtactgccctgtggcctggtaggaggtaacaaggacctgagactgagctgggacagcaggaaggttgcatagcacaggaggcagccagggtcagcttctgggcaagaattaggcatgaatgtggcactgcccccagctgacatggggtgggttccctggatgatcagcacacaggtgacaggcgacaggtgccatggggcaacaggagagggccctgatcggccgtcttcacaggctgtccatctttttgaaaagcaccatagcacaggagggttatcctagagcagcagctgtaaagaaatgttcgtggctgtgttgttcacagcagccggtgggggagacgtccagccgcagctgtttgggggaagtctgtggtgtagtccaagagtggctactggagggctgtgagtgtgcagggtagtggcagcctccaccagggagtgccagacacgtagcacaagggccagagaccccgcctaagatgtgggcccactgctgtcttcggggctggctgcaggccagagccacagactgcaccatgaggaagccccagcatgttttccctgggcgcctctctggtgacatcccatgatgagaaggtttctaagaggagaaccaaggagagaacactagggggccgagaggcagggggcggccaggggcaaacgcccaagctagcgcttctcattgcccggggtgcgcgcgcctgactgctgtcctctcatctcagctctcggggccgcctggcagcaaacaggggaggctgatgacatgcagccgcttcctgaagaccccctcatgcggaggtggccagcacatcactattccaaggaaaaggatgttcactccacgcaagctcaaactgacactctttaatagcgacgtttgctaaaatcaggaggactttgtacctttatgaggaatttttcattttcttcctggctgggttgatgtggaaaccagagctgtctgtggagctgttttccagaccccaggcccattcctgggatctctccaacaggacctgtcctgtgttctgggcttgtctcgggtctgaccaggagatggaggatgtgtccttggcagagccaaggggagacagaggtttctggatgccatgacaggctgtcggggtccaggtggcactcatgggccccctgccccatgtgaatgctgctggcacctggtggggggttgcccagggatggaccctgggcatggcttctgggctgcttagtccagggggagcaacttgtggccaaatccatgagttcagaggaaaaggggaaggcactgaaacgtcaccagagagacagctgttgagaccgctcagaaaccctctgtctgtcacactctgccctggctgctgtgtggtcagggcaccatgagggtgtacagatgtgctgtgtcctcagagcctcgcaggtgccctcacttactgcctgggcccctgcccagcagcctcaaggacaggcctttgtccctcacggttgtggacaggaggtcgcaccactggcctgcgagagcctctggtgggcccgtggcttcccccagttatctgctaaggaaaactgtgctcttcgaagggcagagccaagaagtcagccctgacttttgtaaaattttactaaataaaaccacctggataagcctgttgtcactggttcatcagctggggggactgatacctgaaatcctgtccccaggggaggcctgaagtcttaagcaagcagccaccctggctgtctcttttcctgccaaggccacacaggggaccatagcctccatgtcactgtggtatcagtgcgatgtgcacagtgatgggcaggagtttccatcatgagggaggaggaagcagatgtccctgcacaaaccctggcctcggccacccagctgcatagccagcaccatgttgcacgtggctctaggtctgtgatgaggagaattcctttttgtttgtttgtttctgggtaccacatggtttggaaagctgcctttatttttcattttcagccaggggaaagtgggaatttagagactgtttttctaacacacagcttccttcaaaggcactgtcttttgggccctgccagcagagcccctccaggagatgccctggtttcctaacctttaaaagttagactttaacaagccaaaatactccatcctgctcctcccactccaagattcgggttcagactgtgccatggcatcatggtgtcacccatggtggcccttgctcctcacctggctggatgttggtgacccacagacctcagaaggccaagcctttcttctgacttccctgtggcctcacaggaacctcagaagcaacaggttccaaacctgacttctgtggcacccactagagaagagaggccctgctgctctcgtccccagaggggagtgagaggaagaggcccctcagagtcaggtaaggagggaccaggcgacgtacatgcaaaccacttgtccactagtgcggctgccaagcccccagggtctggaggaccctgcaacaggcaagtccaaagctccctggcctccctcaggtccacactgagtgctcaggaagaaagtgccaaaagctgggagtgggggcagggagctgacggacactccctcgagaacgcccctctcacagatatgctgggatttttgttcccaaagtctggaggcccagcaggggagctgggacagtgggcgggaggcaagcccccaaaggctgaggaagaggctgcaagacaccccgggcgcaaggcgaggggctggaatggagagcaaaggaagcctccagtggccaaaaaggacggcagtccggctgaagaacggagaaatcatgcagcccccaaagccagtggcttggctgcgacacacaggctgatgtccagaatcactgtgctcaaagctcagaccccaccgaagccatgccctgatgccaccctcagggcgtctgaaggcctaactacagctgcagagaagtccagagctagctcaactaccgggaaggacaactctgttcccactctggcaacctcacagtggaaggcacgtgcccctctgtggaactaaacgttgtttgcttcagcctcgattgttcttttatatgaactgtctagcctgcagtaagacattacaagacacatgaaaaggcaagaaaacgtgagccacagtgagcagtagaagcagagtcagccccagtggtaaaactgaagtcaagggctttgaaggaactctggggaggtggggagggcctgtggaaatggcgggtgacattcaccaagagatagggatgttcagcagaaacagggacacttcagtaaaagacagaatgaagatgctgcaaatgaaaaatacagtatataaatgatctttagatgggtttaacagcagactggacatcacagaggaatggatcagttaacttgaagattggtcactaaagaagatccaaacacagagaggggagggaagacgacagagggtccaagatctgtgggccaaagtcagatggcctaactgggtgtaactggagtcccagagcaggaacaggagagaataaagaagaaatattccaagaccgaatcactaagaactttctgaaattcatgaaagaaaataatccacaaatccaagaatctctgtaactgcaaggaggtgacgtggagaaaaccgtacctgaacacatcctacaggccttaaaggcagctaggatggaaacaggagattcatatagagaagcaacgataggaacaatggctcacttcccaccagaaggccacgcacgcacccacatctgcggtgctgaagggaaaaggaaggtcaacttagaagttcacatacattgaaatattctttaggctggtcacaggggctcacacctgtaatcccagcactttgggaggctgatgcaggtggatcacctgagatcaggagtttgagaccagcctggccaacacggagaaaccccatctctactaaaagtacaaaaattagccaggcgtggtggcgcatgcctgtaatcccagctacttgggaggctgagacaagagacttacttgaacctgggaggggaaggttgcagtgagccgagatcacgccattgcactccagtctgggcaacagagtgagactctatctcaaaaaaataaagaaagaaagaaaagaaaaaaatattctttaaaaatgaaggcattatcagccaggatacagaaaccacaccagttatctgaagaggaaaaaatgtaaagaattactaggcccggtatgtggttcatacctgtaatcccagcactttgagaggccaaggtggaaggattgcttgaggccgggagtttgagaccaggctgggcaacatagtgagacccccatctctacaaaaaagtaaaaaaaaaaaattagcctggtgtggtggcgctcacctgcagtcccagctactcaggaggctgaggtgggaggattgcttgagcccaggagttggaggctgcagtgagctgtgatcacaccactgcactccagcctgggcaacagagtaagaccctatctcttaaaaaaaaaaaaagaattaagtagtaaaagttggttaactactaaaagggtcttggtttggtttggcttgggttagagacagggtcttacgatgttgccgtgctggttttgaactcctgagctcaagcagtcttcctgccttggcctctctttttgttttttgtttttcaataaagacttacttaataggccctgaagtagcaggtgcgggaaagcagcttctctgggttggcggtgaggtacagtgaggaattaaggcctggccaaggccccctgccctcccaggctgagacgcaggcctttcacagtgagtgtggctatataggaacaggcctaggcaaaggagctgagctggagctggtctgcagggacagctggcaggacaggtgcccccaggagcaccctactggagtggctcaggagcagagccagtgcaaacacggggcatgctggggcccatcgtgccatgctgggctcctgtgccaaataacactgatggaggaccagacccaagagggaagcccctctcccagccagctactgccgcttcccagctgtctgcagtcagtgctgagtagagagtggtgcagagccagccgtttctgcccacctcggcctcagatggacactctatccagggcccatgggtgtggcaaaggcccttcctcccacagatgccaggcttgcattgaggctgacagctttcctctgcctgctcctgctttctaacccttttgtccttcataagtatttccccaaataaacttcttgaatgtgtaaatctgtcctggcctttgattcctagaggccctgaaggaacgtgaccatcacctgacctgagtgacactgcaaagccctcattctttctagtggacgtggagctctctccaagcagataactgagccgtcagccacatcagaggccagggacatggccttcagaggctttggccatcatgcaaaaaacctggccaccctgaagcctctatgctggagaaatgtctgcagtgatcccacagagatgctgacaagatgcccaaggacccagctgctggagctttccggccagcatgccagccctgggaggagggaagccttcagggtggggtgcatccagctgcagctgctgcctgacagcagtggcctgacagatcccagcaagaaccacccggctgagcccagccaagccgtggcatgagatcatggcagtaacagatggtaggtgctgcatgctgtgaagctagtgatggcagctacacagcaggaggtcatgaaaacaacacatgtccagataaccagtgggtccatagaggtcactggaaacttagtaattgaaactgaataatgaaaatggcactgatcaaaatctgagtgaatgcagtgcatagaaggaaatttatagctttaaatgtttatattagaaagtaagaaaagtacaaaaccacctaagatttcatgttaatgtgcaagaaaaagagcaaattaaaccaaaagtaagcagaaagaaggaaataaaactgagtgccaaaatcaacaaaatggaaaatggcagaacactaggaaaaagggatggtcctaagtgaagacgtaagagcatgtgatgtgcagctctcgcatgactcctgattcaaacaaaccaaatgtagagacaacttcgaataacacacagcgaggaaaagcaggcagcctctgcccaacacagccaggagacagcctcggaaatcggagaaaatatttggaaaccatatgtctgataaggggttaatatccaaaatacataaggaactcaaacaacgtaacaggaagaaaacccagataacctgattgaaaaaataggaaaaggacctgaacagacattttttctttctttctttcttttttttttttgctgtgtcgcccaggctggggtgcaatggtgcaatgttagctcactgcaaactctgcctcctgagtacaagtgattgtcctgcctcagcctcccgagtagctgggactacaggcgcccgccaccatgcccggctaatttttgtatttttagtagagacagggtttcaccatgttggccaggctggtctcgaactcctgacctcaggtgatccacctgcctcggcctcccaaagtgctgggattacaggcgtgagccaccgcgtccagccaagcagacattttccaaaaatatatatatatctatttttatatatatacacacacacaaatgaccaacagctatacaaaaccaatgctccatatcagtaatcatcagggaaatgcaaatcaagactgcaataagataccccctcacacctgttaggatggctattctaaacagatgaaatgtcggtgatggtgtagagaaatgggaatgcttgtgcactgttggtgggagtgtaaagtagtaccgccgctatggaaaacagtatggaggtgtctgaaaaagttaaaaatagaactaccatatcatctagcaatcccactactgggtatttatccaatggaaaggaaatcagtatgttgaagagatacccgcacccccatgtttattgcagcactagtcaccatagccaagctatggaaccaacctaggtgtccaacaacagatgaatggataaagaaaatgtggtacatacgcacaatgggatactattcagctgtaaaaaaaaaaaaaaaaaaaaaatgaaatcctctcatttgcaactgtctagatgaacctgaagcatttatgctaagcgaaataagctggtacagaaagacaaaccccacgtgatctcactcatacgtggaacccaaaaagtcaaactcgccaggtgtggtggctcatgcctgtaatcccagcactttgggaggccaaggcaagaggatcacgtgagtccaggagtttgaaaccagcctgggcaacagagtgatacctcatctctacacaaatataaaataaaggccggggcctgacatggtggctcacgcctgtaatctaagcattttgggaggccgaggcaggcggatcacctgaggtcaggagttcgagaccctcctggccaacatggtaaaaccccgtctctactaaaacaaaaattggctgggcatggtggtgtgtgcctgtagtcccagctactcgggaggctgaggcaggagaattgcttgaacccaggaggcataggttgcagtgagccaagatcgggccactgcagtccagcctggcaacagagcgagactctgtctctaaataaataaataaaataaaataaaggctgggcatggtggctcacggctgtgatcccaggactctgggaggccaagctgggcagatgacttgaggtcaggagtttgacaccagcctgaccaacatagtgaaaccccgtctccactaaaatacaaaaattagccgggcgtgatggtgcgtgcctgtaatcccaactactcaggaggctgaggcaggagaatcacttggacccgggaggcggaggttgcgtcgagccaagatcgtaatccctgcactccagtctgggtgacagagcgagactctgtctcaaaaaaaaaaaaagcaaaactcaacccaagagattgaggctgcagtgagccatgtttgcgccactgcactccagcgtgggtaagagcaagaccctgtctcaaaaaagaaaggggagttcacagacgcagagtagactggtggttgccgggggctgagggctggctggggagatggtggccaaaagatgcaaaatttcagttgcaaggaatgagctcggggatctcttgtacgcagggaccgtaatcagtaacaatggattacattcttgaaaaccactaggagagactggctacggtggctcacgcctgtaatcccagtactttgggaggctgaggcgggtggatcacgaggtcaggagttctcgagaccagcctggccaacatgatgaaaccccatctttactaataatacaaaaattagcccggcgtggtggcacatgcctgtagtcccagctactcaggaggccgaggcaggagaatcgcttgtacctgggaggtggaggttgcagtgagccaagattgcacgactgcactccagcctgggcggcagagcaagactccgtctcaaaaaaataataataaaaccactaagagagtagatttaagtgttctcaccccaaaaagtgacaagtatgtgtggcagtgcatattaattagctcgacttagctgtttcacagtgtacacatatttcaaaacatgttgtacatgatatacaatttttgtcaatttaaaaattaattttttttttttgagacagagtctcactctgtcacccaggctggagtgcagtggtgccatcttggctcactgcaacctccgccttccaggttcaagcgattctcctgccttagcctcccgagtagctgtgactacaggccaccatgcctggctaatttttgtatttttagtagagacggagtttctccacattggccaagctggtctcgaactcctggcctcgtgatctgcccgccttagcctcccaaagtgctgggattacaggcatgagccaccacgcccggcctaaaaattaattattattattattattattatttttttgagatggagtttcgctttgttgcccaggctggagtgcagtggcacaatctcggctcactgcagcctcctcctcccaggttcaagcaattctctgcttcagcttcccaagtagctgggattacaggcacctgccaccacgcctggctaatttttgtatttttagtagagacggggtttcaccatcttggccaggctggtcttgaactcctgacctcatgatccacccacctcagcctcccaaagtgctgggattacaggcgtgagccaccgcgccccaccaaaacagttaattttttaaaaaagaacagcaacacacacaacctgggcaaacctcacgacatgtaaaggccaggccctgcaggtgcccattcacaagcagatcaggcccacaaatcctgttggcaacggtggggacgcacctcccctaccttaacccatagcagctacagggtatcttcccgtgtaaactgttgccaagcggacactgacaattctggcatgttctggactctactatgtacctcaatttttaaaagttaaaaaggaaataaaggggccgggcgtggtggctcacgcctctaatcccaacactttgggtggccgaggtgggtggatcatgaggtgaggagatcgagaccatcctggataacacagtgaaaccccgtctctactaaaaatacaaagaattagccaggcatggtggcgggagcctgtagtcccagctagtcgggaggctgaggcaggagaatggcgagaacccagggggcggagcttgcagtgagcggagatcgcgccactgcactccagcctgggcgacagcaagactccatctcaaaaaaaaaaaaaaaaaaaaaaaggacaatttagggagaaaatcagacatttgactatgaagcaggtgttagatattaaagaattctccctaattttccagttacaatatggtgtaaaccaaaaagcatctgaggcagctctcaatcaagtcagaggtttattttgccagagcccaggaaaaagaaacacaaaaccacaggaacagtctgtgatctgtgctttttccaaagagagcaagatttggggacttcaatatatacacatattttatgagacagagtcttgccctgttgcccaggctggagtgcagtggcacgatcttggctcactgcagcctctgcctcccaggttcgtcacgcaatcgtctcgctcagcaaattgtgctttcataagctacagcagacaagcgcagctgcctgtggaggcctgtggccttctacctgcagctgtttgctcagaaacaaaaaggcggtttcttgaatgagtcagtttccagcttaatttttccctttggcctagtgaatttgggggccctgaaattgtatttttctttcacaatggtattgtggttgtgtaagaaaatgtcttttttggctgggcgcattggctcacacctgtaataccagcactttgggaggtcaaagcaagaggatcacctgaggtcaggagtttgagatcagcctagccaacatgttgaaaccccgcctctactaaaaatacaaaaaattagctgggcatggtagcgggcacctgtaatcccaggtacttgggaggctgaggcaggagaattgcttgaacccgggagacagaagttgcagtgagctgagatcgcgccactgcactccagcctgggcgacaagagcgaaactccgcctcaaaaaataaataaacaaaagtctttttaaaaaagtttaacctggccaggcatggtggctcacacctgtaatcccagcactttgggaggccgaggcgagcggatcacgaggtcaggagttcaagaccaaccagcctggccaacatggtgaaaccctgtctgtactaataatagaaaaattagctgggcatggtggcacaggcctgtagtcccagctactcaggaggcggaggcaggagaattgatcgtaccggggaggcagaggttgcagtgagtcaagatcacatgccactgcactccagcctaggtgacggagggagactcagtctcaaaaaaaaaaaaaaggaaagaagtttaacgtgtttttagggtcaaaatgtctcaacatctgggatttgttttaaaattctttcagaaactcaaaaaggccaggtgcgctggctcatgcctgtaatcccagcactttgggaggccaaggcgggcggatcacttgaggtcaggagtctgagaccagcctggccaacatggcgaaatcccgtctctactaaaaataattagccgggcgtggtggtgggcgcctgtaacccaagctactcgggaggctgaggcaagagaatcgcttgaacctaggaggtagacgttacagtgagccaagattgcgccactgcactccagcctaggcgacagagtaagagactctgtctcaaattaaaaaaaaaaaaaggatgaacagtgctaacacctggtcagcccaggcagcaggcccgggggctcagtgtcctgcttcccagctcgggctccaggtgtgtgaactgttccaggcaagcctgcctgcttcgggacagcacctctacctctggctgggagctctgcctggccctcaacttgcatccagaaggcgaagcatggggaaccatgaggccacagtcgagggccaagtgtttggggtggtggcaggggttgtggcctcctggggaccctcccagtccccagtgaccctcagcaccaggctggccaggcccacgggcgaggaggaaaatgcacggcccgtgctcctcgcagccgcacccagtgtgagcacggctgagcagctctgcgggagtggtggccccgtggtcacagggacaggatcacaaaccaggatcttccaacaggctgggatctgaccacttccccggccctcacccccagcaccccctccagctgcgcatgcacatacgtgtaggtgcacacacacgtgcacaccctcctacaccacccagccagtccccacagcaggcagccaggatggaggcagcacctttccgcctgtgtctcaccgtgggactgggcttaggctgacttggtacagccagtccccaggacgggctgggcctctggccagggtcgggaggcagaggcaccgccccaactgagctctcagagctgggtagtgccccttcttgttctcctgcccctcagtgggtggctggtcctgctgggtgcctgggtccagcacagctgtcacaggccaggccaccagccaaggtgggaagaacagggtgaagacggcagagcccctgggagagcttcctgggacccgatcttcagcttgtgggcagcacgcaccccacctggctcttgccctgcaggctgcccagctttatcactggtggggtcattggtggggcagcccctcctggggcccagcaccacagtgccctctgtccccaggcctgcccagctctttgtagggtcctggaacgccccttctctgaccccagcgggaaatgaacccacctgtaatgaaagtcctgtctgtcaaccaaatgcagcccatgggcctggctgtgctctgcatcagctccagtaagaggatcaccgggcagcctggagggcaggttcgcctggcatgccagatttctccgcagcttgcgatggaggcacttgcagggaggcacatgtgtgagtgcaggacagaggagctttcatcaggcagaggctgcgtgttcataacatcccgtccaggttgctttgttttgaatctgaggtggttttcgactccactctgggcgtccacccaagaggtgcctgtggacacccacccgctcccccaactccatgcaacttgccaaccttcaagtagatcggtgtaactaccccccagtccgatggtgtgcaggaatgtgggggcagcaaggtcacagggcctcgggccaacccagggatgggggtagtttatacatttggggctttttcacaaaaagatgagggtgctgaagggtccctgaaggccccagaggtggcagggccgggccaggccaggcagtgagcccgagcctggcgtctacaggccgacgggaaccactgcacagtggctgtggccaacaggctgctcagagcctatcatttttagggcctttcctggaccttccactccagctcgctgtaggttttccaagcctcttgttctggcattgaccaaattgtcacccaagaagcaggccctcagtgcacctccagttcatccagctggttccgacagcttcaggaacagtccatggagctgctcccagcttcctctgcaaggcccctgccgggctcctctgcgcagtgcagaggctcattcaggcccagcgtggaaggcaagggggacggatctgagaaggcggggcttatctcccaggggcacagcagagtgagggatgggccgatgaagtgtacgcctgcaaggggcagcaagcagccccaagagcttaaactgtccagctgcagcaagtctgctggagcgaccaagcaacatgtgtcacctcaactgagggctgcacttggcagtcacatcttcccagacgggcgatcgccactcctgagaatactgcaaaggctcatcactgagaaagggaggttaccctcgaaccctcaggcatccacacatcacaactcccctccctgcttggctccactacaaaccctgagcaggcactgaggacacagccacctccacacagggcatgagaaggaacagcggccttcctgtgagtaaatgcagcaacccagcacacacagcactgccacatggaaagcttggttcaggtcacagcaaaatcccagtttaaggacacggctcgctggttgcagatagaaacttctagcaacccagaaaccaactgtgagagtttatgatgagggacgtgatcccaccactctgtctttaggtagacaccaaggcaacacatcaagtgtccacacctcagacacccacccaccccagcccggccctttccggtggctccgccagcctgctcacccggctacctggactccacagggtgagcacaatgtccacacttgttccgcagtttgctgctgcgtcctccttccatcactgccgggcccacttcactaaggagtgaacctgggagaaggcgcctggcccagatgtggcccagcagggatccaggcccagatggctgggctcagccctgtggagaccaccccctcccaccccgccccgcccccgaggaaatcctgcgcaggcatctgtgggcggagcaggtagcgttctccaaggtgcgctgtcacccctgaaaggaagatcggttccctgggaggagtctgctatcttcatactggttccatgtcttcaaataaacgtgcattactttataaccctagaaaccgaacttctgaggtagaaggggctccgaagctgtgtgcaaggcatgctgcacgtgaggggtacccaccacacgtcaggaaacgcccctgggaaactgtcaactaacatgcccgctcccctcagtttggccagaagcaaaccgcagagaacagtgccaagtttagatgactggaatttgtatttctgtttctgaataaacattttgtaaacaaaattattaaacacttggaaaatttcttcccaattaaagtcaatttgtacctacagacttaaaaataccacatacatggccaggtgcggtggctcacgcctatattcccagcactttgggaggccgaggcaggtggatcacctgaggttgggagttcgagaccagtctcatcaacatggtgaaaccccatctctactaaaaatataaaaattagccgggcgtggtggcacatgcctgtaatcccagctacttgggaggctgaggcaggagaatcgcttgaacctgggaggcagaggttgcagtgagccaaggtcacgccattgcactccagcctgggcaacaaaagttaaatcctgtcaaaaaaccaagaatgccaggcgcggtggctcacgcctgtaatcctagcattttgggaggctgaggcaggtgaatcatgaggtcaggagttcgagaccatcctggcaacacggtgaaaccctgtctctactaaaaatacaccaaattagctgggcgtagtggtgggtgcctgtaatcccagctacttgggaggctgaagcaggagaatcgcttgaacctgggaggcagaggttgcggtgagccaagatcgcgccactgcactccagcctgggagacagagcgagactccatcaaaaaaaaagaaaaaaaaaaaacaaaaaaaaacaaagccacacacacggactaaacttgcagagaaatgatgcttggaaaacagctgattactcagccactgcgcaccacggtggaaacaagcaggctttggtgtacggtgtcacaggtgaacacggcgagtccagggaatgagactccggctacacttctaagtcacagcagctgttctctcctgtctgtggtccttccacagacccagtctgttttccgaccaagcacccctaaagcgctcaaaagtcacattctctgagcagtttataattttgaaggctaccaaaacaggcactacaactactactaatgctgaacaaatgatgtttctaaaagataaaaatgctatacagaaacaaaatagtgctttagatttattcctataaaacacataccctttaaactagggtccatgaggattaactttcgacatcgggggctgtcagaggtcgtggacacccccaactccagccgggcgctgaacaatgtaaaaagaatttgctctgcaaccctgtgggggggggaaataaaagtaacccagcgtccatttaatgcagccaagtgcaattcctttccccaccttagaaagcaccaccagataatacagcagaactgatcctgcagaaaggttgctggagggtcaggccgtggtcgtaactaacaccacattcccattttgtttgctggataattttttaataaagtgaggtttacatcactgatatttaagaatggctatatgcacaaaagaaaacacacctttttggttaaggggtgaggaagttagagaaagcatgagaaacagggagcatgtggggtgaggcggggcaggagtggaaggctgcaggcacccccagctcactccctgcctgcggcagcacccatgacactacagatcaaggggttatgaatgacatggattcagatttctttcattctagacttcaacctagccttaaccttttgtttcagcaccagtctaacagagcagcgcaggcgtttctcatccagcagcaatgctacttcctcacccagggcaggtgcatgggctgaccctgatgggagcctccaggaacactgccttgagaaggcaccaccgaggggctatgaggtccctgaagaccaactggtgcctgtgatctacaaacagacaaatatttgacctttgtcttcaatgacatttacatataaatagacataaataaaatcctccataatttactcttaggtctaggaagatgtggctgtgtgcggctcctgattttcacccaggtctcactgcagcgcaggacataatgaagaagtatcacacacacatttaaagtaaaacatgatacattcacactgttgactgagactgtagtgatgctcactgcaaaaaacaaaacaaaacaaaaaacccttatttaaaccttaaaaaaatgaaacacaccaactgcaattgtttaggctataaaagttctaatgtagcagcaaaggatgtttatagaaaaaatatacttttaagaaaatagctgaaaaaatctaaagagataaggtataaaaagtttaaaaaatatatcttaagacaaaatactgcccaaaacatgtaaaactgaattgtaaaaattcacctatctaaaggtaaaaggaggttgatgcagctgcggctcaccgtcctctacagtgggggacacaaagagacacgaggggcccagggctgtggggacgtcagaagacaagaagccttccagaacagcctctgcctggcgctccacaggggggaggtgagtgggacgggcctagggctgcagccccactggtaatgggctgttctgggatttctcagaatcagcagacagggcagcaaggctgggccgctggcggcaggcgcaccctccgtgggagccagtgctcacgtgtcaatgcgtcagaggcggctgtgagcactcagggctcctgctcaggtctccaccaggatctccaccacgtggtccagctcgcccaggtcggacttgcagctggagctagggcctggggtggccggagccaagccctcgagcccttcgcaggggcccggcctggcaccccccatcatgcctgtcagtactgtgtccaggtcgtagtaggggctgtccacgtctgagaacagctcttccatgcagctggggtttttagtctccagcgtttcaaatatctgatcaagtgacttgtgaaagcttcctctgttttctcgagggccatccatctcccaggcgctgctctgcaggtgccttggtgcctgtgctgaggtgactgggcaaaggtcagaaactggaccctgtgtgtggccgtcccccaagccaggagcaggatgtgccccctcttgcccccacgctgcacggcacaggatctccgtggagaccaagcggtcgagcggcgcccgctctgcagcctggggtgccactgtgcgccacgtcccatcctgcgtcatctcctcttggatctgccggaccgtgttggcaatgaggactgagcggcacaggttgggctccacaagcatgtggcaaagctgcaacttcaccagagacatgtccaggagcgactgccgctgcaggctgtatgaggacactgtcttcaagccggccagggctccctccacgtcttcctcgtggccaacacatttcctcttcagtcctcgtgcaaacattgtgtcctgcagaaaccaaggaagacaccacttagcacacggcagactctctgcggacagcgccccttggatttcgtctgactgccctcactgtacgcaaggagcagcgactccgtaactggcagggacttgacagagctgtaactccctaacagagctgagacgtggagcccagtgggagacccccacccccagatcagctgccatcctgcctaagccaggcacagtcacgttgttagaaacgacaaacctctcaactgtaccacgacagtgttttatagcaaaaaagataaatgaactaaaaataggagaaatatataagagaaatgtaagtgttcgagagcttggctgaaaatctgtttcaaaaatctaactgtggtgtgtacaaaagaagagaccctggggtaacatgagattaatgtgaaccgtgccagcctgcagagggcgcagggcgggggccggacagggccgggcacacacacgtaccattctgacttccctcaggatcctgcctcggacaaagtcacttctgcgttcagaagagttagtgccttccccctcaatgctttcactaaaagcctctatatgtcgcagacagccgggctggaaagctgtgccaccaggaacgcgcaggggaaggactgcagggctgtatgctcatcccatgcagcgagtggtctgtgtttcgtgcacaattctccaagggacacagggtctcctggccgagcctatgtggccctggacagtcccttgctcccacacccgcccatgctgcctgccttagggatcacacccattccttggctccccccacccgccccaccagttcatttctcccaaggtgcacaggctctgcctggctgctttctacttgacatctctcaggtcaatgccctccactcgagagctctgaccagcccgtacaaccatggcctcaggggccacctcccctctcatctcaactcctttctcttcaaaggaaccaaaacatggcagggtatgtgtgtgtccggggcagggggggtgggttcctcaccagtgtgttgtggcagcccagagctggccaaggcagtgtttctcggcgtatgcctcagcactggcgctgttggttgaagatgcagattcctggatcttaccccagacctgggcaactccgggatggcacctaaggctcagccttgctgggcaggttccactaagacgcacagcacagatgcactagatggacattggccatgtctactctcagaagtacaagtctgtgcaaactgtttttttttttttttaactgattctaaattgggacatctctggggcactaaaggcagagcagacaggagggtgggctctggcttttgacagatgccattctgagccagtgccgcctgcggggagctgggaggatgacagctggctcagggccatactggccggcagagtctgacaggacaagcatctcacgcatgattaagtttctctcttctcatgcttgtaatgtagtgaaatattatttcaaataattcaagttatgcataaatagggttacaatcttttgaatatgcaaactttggaacttctttttctcttagtcaatctgatggctccctgtgaccagggtatacccaggtgctcttggaaagctggcgtatgggaggcacatgctgtctctgctcggggtctggagaccaaggatgggaagttttgcagtgcgggagaactggctgccaaacataccccttcccaggagcccctctggaggctcccacctgctggtcctacccttgaattaacagaagaaagggtccccctgttctctgaatttcccttcagtgtcacagatctcatccccgtgcctttaacacatgtaaattttaaaaaactaagtgacctcttgggcatttatcccagagaaaaagccaatgttcatgcaaaaaacatgttccagaatgtgcacagcagctttatttgtagtagctccaaatctgaaacaaggaaaatgtacccttcacctgggcacggtgacacacactctgctccattcatgccaccaaatcctactctgcaatagaaagaaatgaactgttgatacacaggacggatccttccacaggggcattaggctgagggagaaaagccaacctcagaagggtgcttgctatgggatcccatttatgccacattgtcatgctgacccagagctgaggggtggcagggctagaaaggaacctgcgcagggagatcttgggggtgagggcccttctgctcctgggctgtgggggtggccctaccctgactgcacagcgccggacacgcacacatgcgcctgcggcagccgtgtcatcacacggacctggggcctggctgtgcatcctacaaggatgccggccctggggagcagaggaagggcacataggacctcctgaacactgctctgcaacctcccctggctctacaattatttcaaaattaaaattaaaggaaaacttccctaaccctagcttatttcccctacagcacccatttccccagagcagcatgccagtgtcaccacaggcacagccctcaggctgggcaccgcctctcacacctgcatacaccagcttctcaactaattctaaatgaaggacagtttaccaccaaaacacatttacacatttctattacttttggtaaatattcgagttctttgtgtcagccacaaatttaacttttcagagcttttccatcccaatccattgtttaaatcactggcttaaaattgctaagtatatcgagaattaacataaggctatgtcaaactacaaaggacaccctgcgttggggaaaagattaagtcccacgggttcctctgtgggaagtcaatataccttttaggtttttagtttctctttcaacctatctcaatcccaagcctgcatagcaatggattaatttaggacccaaaccaaatcctcttgaacagcatgcattaagcccaagtttatagacagaagaacccctggctgcctcccctgactctggaaacccagcagcacaacccccataatgtggggcctacaggaggtcagcacgactgagcagggcaatcagggcaactcacagaaggaacaagaataccaatgggacaggccaagaagacccacaaccacactgggaaccagttcaagaagctgtcccaagctcctaggaccctctgggtcccactttcctttcctctgagtccttagaaatgccaggtcctgagtccaaacccaacgacagaccctcccgcccttttctgaaagccagatatggatactagaagcctcccactggggatcttaagaggatgaattcagtgcttggcctggtgctgtcagcggtcctaagggcagcactagcaatacgtgaccgtcagaaatcaccctaataacatctgctctgagcgagggaatataccaacaaacaatggcggaaccacatacagaaacagaactctcagccattatctgccgccatcagtcggaaaccagccctttaccttcagtaacgggccaggaagccaggttgccctagtcagacctgcaggaagcctggctgctttctctaggaacaatccaggaagctaaacaatcatttccatagcaagcagcccaaaatggccaggacatgattagtaaccgacaacctctccagtttttgtccctgcttccaatttaggaccaaccagagaaagccaaacatgttctaggccatctcacaggagccccacttctttgttgttgttgttgtgtcgcccaggctggagtgcagtggcgcaatctcagctcaccgcaacctccgcctcccaggttcaagggattctcctgcctcagcctcccgagtagctgggattacaagggtgtaccaccaggcctggctaatttttatattttcagtagagacttaccatgttggtcaggctggtctcaaaactcctgacctcgggtgatccactcaccttggcctcccaaagtgctgggactacaggcgtcagccaccgtgccaggccaggagccccacttctaactggccaccccagtcccccaagtcagcagcctccatcagccatccctgagcttccctggattccactgtaaagctctcctgttccctcacctgcctatgagtttctgccaatcacgagagaggagggccgcacccttgctaggggaagctctggataaacagcctctgcctgttctcacctggttgcttatttccacagctcaccatagacaatctggaagagcatcaaaaaccataaaacgaattttctcccaggatcccatccactcagaaaaacacagtcaccacctgggttcctcctttccagtcgtttctcccagcactttcctctctgcacaagggagggaagtttcacactactgacaattttcccaatcacaaatgataccagtttctaactttaggtgttttggtatttctagcatttggcttccttagcctcggctctttacttactagggtgatgtgcaggtacatttttaagaggcttgataaacattattaaactgcatcctaagaaggtggaacgctccaccaactttctcccgcactatttctgcacacttgctggtaaagcttcctcttgttttgccaagtctctaagccccacagctaagcgttccttccctcctccactgagctccacgtctgtgttcctaccctgttccacggctgctctcctgccaggaccagacaccctggcctccctgtgtaggtccttttctggccatgccacccttcagctctgggtcagcccaacaatgtggcataaatgggatcccacagcaagcacccttctgaggttggcttttctccttcagcataattctcttgagatccttgcaaactcttgtgtgtcaacagttcccaacagagtaggatctggaggcacagacggagcagagtgtcaccacaccccagctgaagggaactttttccttgtttccagtttggagttattacacataaagctgctatggacattctagaacatgtttttgcatgaacattggtttttcatttctcttggataaatgccaaagaaataatcgttttataaaatttaggagtgttaaatgcacaggcaatgagatctatcacaccgaaaagaaattcagagaacagggggaaccttttttctgtctattcaaggacaggaccagcaggtgtgagcctccagagaggctcctggggaggtggggggcggtccttggcctagtttcatcactctcagttgtaagcattctttttttttttagatggagtctcactgtcgcccaggctggagtgcagtggtgcaatctcggctcactgcaacctccacctcctaggttcaagcgattctcctgcctcatcttccctcaacttcccgagtagctgggattataggcgtgcaccaccacgcccagctagttttttgtatttttaatagagccggggtttcgccatgttggccaggctggtctcgaactcctgacatcaagtgatttgcccacctcggcctcccaaagtgctaggattacaggagtgagccatcacacccagccacaagcattcttttaggacttaaacagcccgggcacagtggctcatgcctgtaatcccagcactttgggaggctgaggcaggcggatcaccaggtcaggagattgagaccatcctggccaacacgatgaaaccccatctctactaaaaatacaaaagattagtcaggtgtggtggcacgtgcctgtagtcccagctactcgggaggctgaggcaggagaattgcttgaacctggaaggcggaggttgcagtgagcagagattgcaccactgcactacagcctgaacaacagagcgagactccgtctcaaaaaaaaaacacacacacacaaaaaaaacacttaaaacaagttgaatgtatacgatctggtgtattctgacaaaggaatgcaactcagcaacatacctcaatgatttatgcaacacggataaatttcaaaacattatgctgaataaaagcagcaagacacacacaaaaatatgtaccgtaggattctattgatctgaaccttcaggacaggcaaagctaatctaagttgtgaaaacacagaagggtagccaccatcagggtgggaaatgctacaaggggccagaaagaatcctccaggatgatggagattctctctcgccccttgtaggacttgtgtaacccagggacctgcatagatgtgcctgggttacacaagttctacaagggacgagagataatccccatcatcctccactgcatctcatcccatgcacagatcccattctggtaccaggagaatatccctgttcagtcacttcaaatcattcctctccaatgttccaaatctccagcagctgttaattctgtgttgtacccaatattttaaaatgctgacaagtttattactattaatacaaaaaagagtaaagctcacaggtgctttttacagtcacgtgaccccaaagagctgtcacccagaacatgtgttcaggagtgaagaggataaggttgggcccggagaagctggcctgtgaggatcaccctgaattgggttatatctgtgtttgggacaaagtcagcaagagcatggtcttaaccagccccgagggatgcctgggctgggcccagctccctgagggcctcctgtgtgacttctgcctgaggctgcttaactccttctaatatggaatgagaaagggccctataccataccggtggggctgtggagcctagctccctgctcaatttttttttttttttttaagacagagtctcattctgtcccccaggctggagtgcagtgatgcaatctcagctcactgcaacctccacctcccaggttcaagcgattctcctacctcagcctcccgagtagctaggactacaggcacgcgccaccacacccggctaatttttgtattttttgtagagacggggtttcaccatgttggccaggctgatctcgaactcctgaactcaggcaatccgcccatctcggcctcccaaagtgctggattacaggcgtgagccaccatgcctggccccctgctcagttttgaagctctttctacacatctagttaaatgcctaaaatcccaccaactccacaggttgttaccgggacagccaagccctcagtcaactcccagcactgccctcaggcttctaaaccaagcaccgaccagacagagaaaaacgaagagggccagacggactgaggacatgtccgacatggcaggtggaacagccaacaggccactagggacagagcaacctaggcccaccgaggcagaggccagcagggagcagccccgcagtgctgctcaggcaagcagagtacagctcggggactggtccttcactacagcagcagtggccacaccttcgtggctgagcaataccacgaggctggctgaaaacgcagattcccagattctgatcagtagggctgggacggttggggacagactcaactctgacctaacctgtcaccttcacagctggacttgcagccacttcaaagtttcgggtttttaagcaaatcatcaacaatttccattcctcacacatcagataagctttgaaatactttatcggaaaaacagggagaagaggagcaaggtctgcagtcttgagtactgagtgggagctccaccttccactacaagtctcctggaggctgttcatgaacaattactgttatgttaatttcaggtatttggttttttttgttttttgagacggagtctcgctctgtcgcccaggctggagtgcaatggcacgatctcggctgagacctctgcctttctggttcaagcgattctcctgcctcagcctcccacatagctaggattatgattacaggcatgcgccatcacgcccagctaatttttgtatttttagtacagacggggtttcaccacgttggccagctagtctcgaactcgggacctcaggagatccacccgcctaggcctcctctcaaagtgctgggaggtgtgagctaccgcgcccagccaattgcaggtacttttgttacttggaacgaaacacactccttcttttccctgaaaacatgttccagtggcaagttgagggaaacttcctagccccttttccaagatacagcctactactcttcctagaaaaggggtgtaactcactttgtattctggatttccaccctaattataaaacacggtgacacttgaaaatagagtggttgtacgtagaaagttgataaaacgtaagttttgtgaacaggcaatgtttttctgtggctcgctttgagagaacggttatctgggtcccgccgtcccgtgcgtcccacacgaaggccacaggagaagcgaggcagcggagaccctctattccagcaagctgtcggagcctttgccacgacgatcctgtttgcggggcgagaagcgtctgaagacgcggagggaggcttgcgtctgacttctgcaagtgtctcggggactttccctagtcccacctcgcaccgccggaggagcccagggaagacggcgctggccgacccgcccggggtctgggcctcctcccacatccgcggccctctccgcggccgggctccgacagagggggctgcggcgcgcctggcgttccctccgctgcaactagagccgaggtacgggaaacgccgctgcgtaccccagccgggccctcgtgaagcggctcccgcgtggggccgcccgcaggcctcggcaaagccccagctccgcgctccgcaaggaacgcagacggcggcccgggcccctctgttccccgggccccctcagcagcggccaccccgcgggggaaccagcgcccaggagggcggcgagggcgccgcggcagccccagcggtggtcccgggcgccgcctccgccccggacccagcgccaggagccacagactccgcgcaccgcccccaggctcctccgcgccctgcagcacaaaagtgcacgccgccgtagacgccctagcggtccgccgggcccgctcacctgacccgcgaggccgcccgccgggtcctctgctcagccaccgccaccgccgctgccgccagcttcccgccgctgaggaaggagcgcccgacggcgcggggcggggcgagcgaccgccactcggcgtccacaaagggtcgacgctgcgctctccgcgcgctacgcccgctgattggccactcgcgggccgggggcggggcctcttgttcaaacccacgcgggcggggcatctgtggcgcgtcttcccgcgctgcggcgacggccgttggggctcgcgcgcgccctcggttgccccgcccccgcccctgcgcccggccccgccacgcccacgccccgccggctcccaggtctccccgcgcccagtccggccccgccccgccagctcccaggtctccgcgcgtctggccctgaactgaacgcgcctgcgcctggggcccacgtggggccctcgggcgggcgtggcggggcaaacagaggtttggactctctcgcttctgcctggctcaacttctccgccgaggcatccgtgccggggtcgggaggagccgggcacggcaattcccgggcggtctgggctccgaggtctatccaagcctctccagagaccggggttatctccaaaggcttcctaggtttacacgtaagaaatgtaacgtgaaagttcaaagcaggggacacgtgttttaaatctcttagtggaaaaggttttaaataggatgcgagaacctgcaatcattgacttaagtaataccctgagcgcctgcagcaggcccggcaggcgtggctgcagctgagagccaagtgctggaagttgggggggaatcctcagatcaatccgcaggtgcggatgcgccaaggtcggtggtaaatgctgaaatgctgtcgggaaacctgggagtgacgtgggggcgctgctcacataggtctctaggataaggagcgtcttaaagcaccaaaaggaagagtggacgagaattcaggagaggaatggctggggcaaagcccgaggcaggggcaggaggcaggagcacgtctcagtgcagtgagaaagaaccctgtgatctcgtgggaaagttttaagtgtgaggggtggagggacttttgggctattctgggagtgggatggagactactggcatggtcagcagagaaggaactggaatctgaattgtgcttgaaaagaatcactgttcttatttaaaaaaaaaaaaaagggggtctctttcgcccaggctggacaacagtggcgtgattatggctcactgtatcctcgaactcttgtgctcgagtgattctcacgcctcagcctcccaagtagctgggactacagaagtgtgccactacaccaagctaactttttttttttttttggtaattttgtagagacagggtattgtcttgttacacaggctggtctccaactcctggccttaagtgatcctcctaccttggcctcccaaagttctgggattacaggcatgaggcaccacaaccaccaagaatcactgttggtaatagatttggaggaggtggcaggaaggctggaagtagaaaatcccattaggttactgcccaggtaaaagaaaatgggacttgataaaggtgactacctgagaatttaaagtttatgcatgtcaaagtgaaaagacaaatggggaaaaaagtttttcctggctgtatcccacataaaggttaaattccttaatatacagatattctgcaaatgcaaatgaaatctagatcaccaaagaaaagtggtttggaaatagtggcacccacctgtaatcccagctactcaggaggctggggtgagagaatcccttgagcccaggagttggaggctgcagtgaactatgattgcaccactgcactccagcctgggcagcagagtgagaccccatctcttaaaaaaagaaaagaaaagtgggcgtagaatataaacacagttcagagcaaagaaaatacaaatgctcctatacaggcgaatagatgctcagccccaatcagaacaagagcagtggaaattaaagctatgctggagtgctgtttgccacgggtcaaattggcaaagatctaaaataatgtctggagtaagataatatcttccagagcatattagtctattctcatgctgctaataaagacatacccgagactgggtaatttataaagaaaaagaggtttaatggactcgcaatcatggcaggagacaaaggaaaagcgaagggacgtcttacacggcggcaggcaagagagcgtgtgcagggagctcccctttataaaaccgtcagatctcaggaaatgtattcactatccggagaacagaacaggaaagcctgccccatgattcagttacctcctgccgggtccctcccacgacatgggaattataggagctacaattcaagatgagatttggtgtgatattttgacatgtatatacaaagtataatgatccatcaaggtagttagcatatccatcacctcaaacatcatttcttttgtgttgggaacattcaaaatcctctcctctacctattagaaaatatgcagtaagttactgttaactgtagtcataaaatattaacaggcttgctaggacataggaccagaaaaaacatagaagtctatggttacaccaagattggagtcatatttttcagtaactaatgtattcaggaaaattgatgacaaggagaactagaatccgttaaaaaaaagactcaaattgaagaaagagcatcagtcttacacagagtcttccaaatgataaaggggaactcttcttaccaatttgttctacagggctaacaaatttgatactaaaactcgaaagggacatgatgggagaaaacacacatggtattctctctcatgaacattgtttaaaattccaaaccacatattagcaaatcagatccaatgataatgtaaaaaaggtaactcatcacaaccaagttgggtgtactccaggaactggagtacagttgatttcacattgcaaggtcaacatgattcatgacaatagaatgaaggagaaaaaaagtatgaaaatctcagtgtagaagcatctagtaaaattcaacaccccttcatggtataatctttagcaaactaaatatacaagtacaaagttagggacagccccaagaccaccctcaagtttgaaattcattagaaggactcagagaattccctagaagctattgtactcgtggttatggttcattaccatgaaaaggctcattaaaattaaccaagagaagaggtgcatggggcagcggccaggagaggccatgcggagactccagttgttctcttagtggagtcatagtggtattgctggtgaaaatgtgtcactgggcctgagtccagagttcatttacttcccaaatgaatatatacatttattctattgccaggcaaaatcccaggatatttttgaaacctcacaaaatgctattaaaaatctagagaaatggccgggcacagtggctcatgcctgtaatcccagcactttgggaggctgaggtgggcgggttacctgagttcaggagttcgagaccagcctggccaacatggtgaaaccccgtctctactaaaaatacaaaaattagccaggcgtggtggcatgtacccgtaatcccgctactcgggaggctgaggcaggagaattgctggaacacaggaggcggaggttgcagtgagctgagattgcaccactgcattccagcctgggcgacagagtgagactctgtctcaaaaaataaataaataaacataaaaaataaaataaaaatctagagaaatacatgtggaaggctaccctatagataaagtaagaaaaaagaaaagtattaaggaggacacccacctctatatcagttaccttttgctgtgtgacacactttcccaaacttagtagattcaaaaggcagccttttgtttgctggcatttctgcggttggcatttcggctggggtcacagcatcctgtgtctcatgaggcatcagctgagctcactcaagtgtttgggtcttggcagagatgactgactcatctctgctctgtcatcctccggaaggccagcccaggcaggcaccaatacaggggctctttttatacttccctctgctctgctcatatgtgccaatgtccaggtggccaaaccacatgtggccaagcctagggccagtgtggacacgagaagacaattccctggaggacattattattgttactattattttgagacagaatctcactctgtcgcccaggctggagtgcaatggtgtgatgctctcaactcactgcaacctctgcctcctgagttcaagcgattctcctgcctcagcctccctagtagctgggattacaggcgcccaccaccatacctggctaatttttgtatttttagtagagacaaggtttcaccatgttggcgaggctggtctcgaactcctgacgtcaagtgatctgcccgccttagcctcccaaagtgctgggattacaggcttgagccactgcacccagcctattatcgttattgttttgagacaaggtcttgctctgtggcccaggctgaagtgcagtggtgctcactgcagccttgacctcccccagctgaagtgattctctcgcctcagcctcccaagtagcttgggctactggcacacaccaccacacctaaccaaacattactgtagtctactaattcttaccacatacttgaacatactgtaagtaaacttaaatatatacttagtaatgacagatattggtgtatactgtagtaaaattaaacaaatatatacagatgcttctccacttaggatgaaattatgtctcaaaaaccctattgtaatttgaaaatatcaaaaataagttgagaatgcatttaatacatctaacctaccaaacatgccttaagcctagcccatcttacacatctcaaaacacttagcttaatctacagttgagtaaaaccatcttaactcaaagcctattttataataaaatactgactatgtcatggaatttactgaatactttcacttttttcaccatcactgaaagtgaaaaacagaatggccggctgggtacttggaagtacggttcctactgaatgcgtattgcttttgcaccactgtaaagtcaaaaaatcgttaagtcaagcaatcataagtcagagaccatctgtatctacaagaatccacaggaaatactaaaatgaatagcgaaatggtgaaaatggtaaagctttctcctattacttcctcatctcctgactcatctccgctctgactaatttctacccaacgttgtactctaggacctagctattgtaagaaggcaagaaaaagaaagaaaaggtatgaagatttgaaaatgaactaaaattatcattaatttcagaaagttggaatttgaacgtagaaaatccaaaggatgctgggcgcggtggctcacacctctgatcccagcactttgagagaccaaggcaggaggctcacttgaggccaggggtttgacaccagaccaggcaacatagtgagaccttgtctctacaaaaaaattttaaaaattagccacatgagccgggcgcagtggctcacggctgttatcccagcactttgggaggccaaggcaagcggatcatgaggtcaggaattcaagaccagcctggccaatatggtgaaaccccatatctactaaaaatacaaaaattagccgggtgtggtggcacgcaactgtagtcccagctacttgggaggctaaggcagaagaatcgcttgaaacaaggaggtggaggttgcagtgagtggagattgtgccactgcactctagcctgggtgacagagcaagactctgtctcaaaaaaagaaaaataaaataaaaataataaaattagtcaggtgtagtgatgcacacctgtagtcccagttactcaggaggctgaagcaagaagattgcttaagcctgggaagttgagactagagtgagccatgattgtaccactgtcactctgggtgacagagcaagactgtcaagaaagagtctcagaagagagaaaggaagggagggaggaaggaggaagggaggcagggagggatggaggaaggaaggagagaaggaaggaggaagaaaggaagggagggagggaatccccagataaattgttcaaattaataaaaagttaatgtgtaaacaaattgtatactaacctaagaggatggatgggtttgtaataagcagctgagtctcagccaatcatagcagctgaatgtccaccagtcagaggctgaaggctgccaaaacatgaccaaacaaggcaaacaccaaatgtaaccaatcaggttatttctgtatgtcatttcctcttctctggctataaatatagcttgcagaaattgctgggtgatgcattctaaaccattttcagtctggactgtttcccaggtacacgaatgttttctctgcttacttaaactcagttatatttaacttgtcttggatttttattttttaatatagccaatacaggaaaatcaattctatttgtatatataagaaaccattggccgggcgtggtggctcatgcctgtaatcccagcactttgcgagtctgaggcaggcggatcatgaggtcaggagttccagaccagactggccaacatggtgaaatcccgtctttactaaaaatacaaaaaatcaggtgggcatggtgttgggagcttgtaatcccagctacttgggaggctgaggcaggaaaatcgcttaaacccaggaggcagaggttgcagtgagccaagaccacgccattgcactccagcctgggcgacagtgtgagactccatcccaaaaaaaaaaaaaaagccagaaaccattataaaatacttttttaatgatgtcatttgcaaaccactgaaaacatcagcactagggataaatctaacattgaatatgtaagacctctacacagaaaactacacaacattgccaagagaaatctaaataaatggaggaataaaccaggcatatggattggaagacttactcttgtaaagatatcagagacctcgaaatttatcttcagattcaaagcaatctcagtcaaaataccaaccttttatgggaattgacaaactgattctcacatttttatggcaatacaaagtgccaaaaagagccaaaacaaccttgaagaacaagaaagtggtgagctggacaatcactttggagatgtatggcaggatctgccagacctgagcacacaccgagcctatgacttagcactgcttgtcaggatgtgtcccgtagaaaggcatgcatatgttcacaaaaagatttatacaataaaatttatagcagggttactcatagtagcctggtgaaagttgtccgattcaaaacgggatcacttgtgacaatcccctggctacatggagctggggaagggcatgaagggaagtctcccgtgtatgatgtgcgcgattataagaactatcatgagatgtttccaaaccacaggtcactacacaagtcacacaaggacagctagctgcttatacaagaacacttgcctgacacgtggcctcacaagcccaatccaaaactgcgggagcctagccaactcccagactacacgtcctacctagcaactaccaacacttgccagtcagaactcaccagctcagagccaggcacagtggctcatgccagtaatcccagcatcctgagaggctgaagtgggaggatcacttgaggccaggagttcgagaccagcctggacaacatagtgagaccctgtctctataaaaaagaatttaattttaaaactatgaaaaataaaaactcaccagctcttataagacacttccagctccaatatactttctttcaaaataacctgtgtagcctacgctttccctaataaaaccctaaccttttcccttcattctttggacataccagagaccaccatggtctgtctatatgtcccagattgcagtcctacttcttacacccaaatacaaccttttatttaaacttagagattcaactctctgttttttttttttaacttctatttttggggggacagaggctcgctatgtcgcccatggtggagtgcaatggtgcgatctcggctcattgcaacttccacctcctgggttcaagcagttcttctgcctcagcctcctgagtagctggtgttacaggcgtgcgccaccacacccagctaattttttgtatttttagtagagatggggtttcaccatgttgtccaggctggtctcgaattcctgaccttgtgatccacccacctcagcctcccaaagagtgctgggattacaggcgcgagccattccacccagtgaaagctccaacctgaaaacaacccaaatgtccccaagagaatggacactggaggtgggtatgttcaacagtggcacacttgtgagatgagacgagcaaacattgctgcacacaaacaaatggatgggtcccacaagcataacgtttcgggagagaagccaaactcaggagtaatggctgcttccacagatggaaagctcagatgaggcagagggcaccgtgccagagaatggccctcaggcagcacggcagtctcccaggacctggagaccatcactgtcttgatctgaatggtggtgttgaatctgttttgtgtgctccctttcagggcattctgtgttttgacttcaataaataagtacattaagccaggcggggtggctcacacctgtaatcccagcacttcaggaggtcgaggtttgtggatcacgaggtcaagagatcgagaccatcctggccaacatggtaaaaccctgtttgtaccaaaaatacaaaaattacccgggcatggtggcacatgtctgtaatcccagctacttgggaggctgaggcaggagaatcgcttgaacctgggaggtggaggttgcagtaagctgagatagggccagtgcaatccagcctggcgacagacagacactccatctcaaaaaaaaaaaaaaaaaaaaaaagtacattaagtactatgtatcgtacaatgtatctatggctggatccccaggggctatctctgggtggtgccctggtggctggggctcaggccaggctagaaggttccatgtccgtctttttgttcctttggaattacctcccatgcatatgtattacctagtcaaggaaaaaaggcttctgtttaattaaaaaaaaatgcattcagcttttcagcctcgcagctgagccccttcacttgggagcagcctgggtgcatttgtgcacagttcagattccaggcaggacgctgctatggccctacccaccccctcatcactcatcctgactcctggggccaaccctggggctgtgggctgttgggtctgtggtagggtggagaccttaggcccatatgtaccaggaagtccccagagagccagtgaggagatgctcaggacactcctgtcaaggcaggccctcagcctgtgactaagcctcccagccatctttttcttttcctttatgttgtttaatatttttgtcacaaagagccatggtcactggcagagctgtcactatttaaatggtagaaaatgccccttttggggctgggcatggtggctcatgcctgtaatcctgacattttgggaggccaaggtgggaggatcacttgagttcaggagtttgagaccagcctgggtaacatagcgagaccccgtctacaaaaaatcaagaaattagccgggcgtggtgtattggtttgctttcacactgctataaagtactgcccgagactgggtcatttataaaggaaagagatttaattggctcacagttcaacatggctggggaggcctcaggaaacttataatcatggaggccatcaaaggggaagcaagacaccttcataaggtggcagaaagaagtgccgagcaaagggggaagagccctttgcaaaccatcagatctcttgagaacaaatgcactacgtgagagcagcatgggggcaccgccacccccatgactcagttacctccacttggtctctcccttgacacgtggggattatggggagtacaattcaagatgagatttcgttgtggacacaaagcctaactatatcacatggtgtcgcctgcctgtggttccagctactcaagctgaagtgggaggatcgctggagcccagaaggtcgaggctgcagttaagctgagatagtgccactgcactccagtctgggtaacagagccaacagattggctgcaataacagaaactgaaaggaaaataaatctcaggaccccaaaatcactaagccaacgggaaaagtcaagctgggaactccatcagcaaacctgcctcccatcctattcctaaataaaatagctacaaacataaaaaagctatgtccttccctcaaaatttgtccacagaaaattccttgtggacaaaagacacgcagaactcaagagtcctccctctgctccggtgagacaaacgcacagctgatggcttctttgccctattgtttcactaagctggactaaggcgtaagtgactattcctataaattgtgtattcaattaaaggctaatcagaaactcaaaagaatgcaaacttttgtctcttatttacctatcacctagaagcccccttcccgatttgaattgtcccacctttccagaccattgaaacgattctcctgcctcagtcttctgagtagccgggactacaggcacccaccaccatgttcgggtaatttttgtattttcagtagaaatggggtttcaccatgttggccaggctggtctggaactcctgacctcaggtgatccacctgcctcagcctcccaaagtgttgggattacaggtatgagccatgcacccagcctcagatacgttttggtttaccaatttggtaaccaacagaaaggactctgaggccgggcgcggtgggtcacgcctgtaatcccagcactttgggaggccgagacgggcggatcacgaggtcaggggatcgagaccatcctggctaacacagtgaaatcccgtctctattaaaaatacaaaaaaataagccgggcgtggtggcgggcgcctgttgtcccagctactcgggaggctgaggcaggagaatggcgtgaacctgggaggtggcgcttgcagtgagccaagattgcgccactgcactccagcctgggcgacagagcgagactctgtctcacaaaaaaaaaaaaaaaaaaaaagactctgagtggaggtgaccctgaccttcaacaaatctatcagtgattggtaccagcttgagctttctttacggctcaaaccaataggacaatttgctgaagactgggagcttccctccctccagagaatcccagatctcccaaaatttggttgagatctacagtttatttttctgtgcaactgtcagaggcgtgtgaaccagagcaactccaccttgaataggggctgggtaaaatgaggctgaaacctactgggctgcattcccagacggttaaggcattctaagtcacagaatgagactaggaagttggcacaagatacaggtcataaagaccttgctgatttaaaaacaggttgcagtcaagaagccagctaaaacccaccaaaaccaagatgaccacaagagtgacctctggtcatcctcactgctacactcccaccagcaccatgagagtttacaaatgtcatggtaacgtcaggaagttaccctatatggtctaaaaaggggaggcatgaataatacactcttgtttagcatatcatcaaaaagtaaccataaaaacgggccatcagcagccctcaggcctgctctgtctacggagtagccatgcttttattcctttactttcctaacaacatttatttccctttatgtactcgccctgattctttcttgtgcgagatctaagaaccctctcttggggtcttgatcgggacccctttcttgtaacacaactcctttttttggagttttacttgcttccaacaaggaaggcaagttttcctgcttccatgacggtggaaggcagataactcctttccggagttcgagcctgctttcaacagggaaggcaaatttgagttttcccctgcttctagaatggaagatggcagtcttcagcctgagacccattcctaggtaagtagcttaattgggttttcgtcttggctaaagttatgattaacaaccagctggtctcagtttctctttaccattagagtgctcagtaatcatattgttgggatcttttttaaaaaaatgttttccggtctttctcccattagatttgacccactctacctgccttggtcaaatccgaatgagaattccaaattatggggaacaaggactttctgaattacctaaaattcctcacagatgcaaaagagaaaaccaaaacaaaaccatactctcggtttccgcgttcgctccccgtcgcgctctcggtttccgcgttcgctccccgtcaggctctcggtttccgcgttcgctccccgtcaggctctcggtttccgcgttcgctccccgtcaggctctcggtttccgcgttcgctcccggtcgcgctctcggtttccgcgttcgctccccgtcgcgctctcggtttccgcgttcgctcccggtcgcgctctcggtttccatgtttgcttcctgtcttacttttcttccaccctgttcctccttccccttcaccaacttcagtaccaagaaaaaaatctagaggtgtctaatgactcaaatcctgtaaagaactcagaacaatggcaccactcaccccttttggggtgttctgttttcttggtggcgtttcaagagtcatggacaggtccttctgggtctaaggctctggctcctgctacattacctgtattctttggctttgtgggggtaccagagatgaccttgcgctatgagaggatttgagcttggcgtttataatcatggtgggcgagagctacaaagttaggggtggctgaggacagtttataggaagtggtcttggctgggattttttccccctgggaagttgttgtttaggatcctaattctagttcggaggtgcattttaaagggtcttctccattgccttgtatgcacatttgcatgaggaactcaactgttgttttcataggtaaatgagagattgagtttcctcagctccaaaaagaaaggacattttgcttttcccagtggaaaggtgctcctgggtgaatgggggccaagcaggagtgtccggggggttgacccgctgcgatgtgcgacggtcctacaggaaacccccaacaaaattagtttaaaaggttgtccaggaagcgcatgtaagagtggctcactccgcactttgagcccttctggaggtacttagacgtcctgagagagaaattgagacacttagacctccggagagagaaattgagacacgtgagagggcagcaatgactcgtggtgacactgtgaagtcccacccgcaaccagcacagtttgacccatgacacttgctaggccacaggtcacttcctccttttgagaaaaaaatgtgggaaacaaatcatctaagaatgaggaaagccaaggaaagcaacgcctcttgggcccccgtttggttttatgatgcctctgtttgcaagtgtttgtataaaatggaaatatggtctttctgtgcacaattacgtcaaggaaaatgcagcgcctgagggtcggcctgcaactgtcaagttcctaagtgggttttttttgttttttcttttgttttgagacagtctcgctctgtcacccaggctgttgtgctatggcaccatctcggctcaccgcaacctccacctgttggtttcaagtgattctcctaccttagcctcctgagtagctgggattacaggcacccgccaccatgcccaggctaatttttgtattttttagtagaaacggagtttcaccatgttggcaaagctggtcttgaactcctgacttcaggtcatatgcctgccttggcctcccaaagtactgggattacaggcgtgagccgccacagccggccaaagttcctaagttctctatctctctgctgtgttttccctgctttaagtctgctgttacttttctactgagataaaatccactgtttgcatccaaccatttctttttgttattgtttccgcaaaccaatgagtttgtattaatatcgcatggctagagttctaaagtaaaagctataggatttttgagtgtgtatgtgtgtgtttatgtgtatatacctgtattttgttatgtgtttttggccacaggtaccaaattggcttaaagttatagagtactcataaataataaccgaaatgcttttcaagttcatgtgacttaagtaaaatctttaataagctagctttaaaattttggtaaggtgatattagaacagtcttatgaattgtcggcatactttttttttttttttttgagatggagttttgctcttgttgcccaggctggagtgcagtggcgcaatcttggctcacggcaacctccgcctcccgggttcacccaattctcctgcctcagcctcccaagtagctgggattacaggcatgcgccaccacacccagctaattttgtatttttagtagagacagggtttctccatgttggtcaggctggggtctcaaactcccaacctcaggtgatctgcctgccttgacctcccaaagtgctgggattacaggtgtgagtcactgtgcccagccagcatacatttctatttgcatttattgatcaagagatttcattcttatccctgccaaataataaatggtgccaacatttggcataaagctcattaaactataaacccagcccaacacagaatgatcttggcttgggtaagttttcctgcttgtgtaatttttgataaataagacgttaatactgttttaatgaaaacagttaaatattgaattatttagtaaaataaccatatatttaatcttaaggtttctactcacctaaatatctgaaattcacaggctataaaatggttgacagggaaataactttacatgatgactcacagttttcataaataatgcaggtaaactattaatataaaataattaggtgtatgtaatgggatacatacttgtagacaaatgccataatttagaacctaaagtttaatattaagttaaatagcagatatttccttaaataggtatttttcaattaaaaaaactaagaaaacattctttctaaaaaatgtgtgttcttgttaaaagatgaataatttttgtctaatttatttattgttatttttatgattatatatattttttgagactgagtctctctattgcccaggtggagtgcagtgggtggcacgatctcagctcactgcaacctccacctcccgggttcaagtgattctcctgcctttttttttttttttgagacggaatctcactgtgttgcccaggctagagtgcagtggtgtgatcttggctcactacaacctctgcctcttgggttcaagcgattctcctgcctcagcctcctgagtagctgggattacaggcacccgccatcatgcccagctaagttttgtatttttgtagagacagggtttcaccattttggccaggctggtcttgaactcctgacctcaggtgatccacccacctcagcctcccaaagtgctgggattacaggcatgagtcaccgcacccagccaatttttgtgtaatttaaagcttatttaaagattatgtataaaacaaggtaaagggaaccaggaaataaaagagatgtaaagaaagttataaaaggccatggccaggagcggtggcttatgcctgttatcccagcactttgggaggctgaagtgggcagataacctgaggtcaggagtttgagaccagcctggccaacatggtgaaaacctgtctctacaaatatacaaaaattagctaggcatgatggcgggtgcctgtaatcacagctactcgggaggctgaggcaggagaactgcttgaacccgggaggcagaggttgcagtgagctgagatcgtgccactgccctccagcagcttgggcaatagagtgagactccatctcaaaaaaaaaaaaaaaaaaaaaaggctgggcacggtggctcatacctgtaatccagcactttgagaggctgaggtgggcattatcacctgaggtcaggagtttgagaccagcctgaccaacatggtgaaactccgtttctactaaaaatacaaaattagccaggcgtggtggcacatgcctgtaatcctagctatttgggatgctgaggcaggagaattgcttgaacctgggagacaggttgcagtgagctgagatcgcaccattgcactccagcctaggcaacaaggagcaaaattacgtctcaaaaaaaaaaagaaaagaaaaaagaaagaaaaataaagaggcatttttagtattaaaaaaaaagttggctcggtgcagtggcttatgcctgtaatcctttttagcactttgggaggccgaggcaggtggatcacctgaggtcaagagttcaagaccagcctggccaacatggtgaaatgccgtctctacaaaaatataaaaattagccaggcacaatggcacatgcctgtaatcccagctactcaggaggctgaggcaggagaattgcttgaacccaggaggcagaggttgcaatgagtcgagatcatgccactgcactccagcctgtgtgacagagcaagactctgtctcaaaaaaaaaaaaatgcttagagaaaaataattttatatgagaaagaatcttgtttggtgaatttttgtcctagaataaaatgactggttgttcatgaaagagggatgttcaggacaaaccagaaagtccaaacgtcatgaatggtctgtgtaaatcataagaagaggatttatggaaaaaacttttatagttgtcataattaaagggaaattgtttataatggtctttctagagattaggttttgatatttaaaaacttcctaaaaagttggtttgaacaatgaaattttcctaaggtattgctttactcttaataaagttacacaacattattatttttgtatgcaaagttcaacttcattgcacctctctgttttccgctttctctccccttttaataggcctgaaagaataactctgtccttcaactagtgtttaactcttgtaagttttttattcttcagcttctgtttattgtgacctgatgctagaaaatgttttgttttagagttctaaaggacgcgtttccttccaacataacgttctgtgctcttgctttaaattgttctatggatccaaaaattttcgcttatgacccaggaaacactcttcctattgtggaatgagaccaccacttctcctgttgtccttcccagcttctcccccacctccccttttccctagtttataagacaagagaaaagggagaaagcaaaaagttggaaagaaacagaagtaagataaatagctagatgaccttggcgccaccacctggccctcgtggttaaaataataataataataataataataataataataataataataataatgttaacccctgaccaaaactactggtgttatctgtaaattccagacattgtatgagaaagcaatgtaaaactttttgttctgtgagctgatgtatgtagcccccagtcacgttcctcacgcttacttgatctaccatgaccttttcacgtggacctcttagagttgtaagcccttaaaagggctaggaatttctttttccgggagctcggctcttgagacgtgagtctgccgacgctcccagctgaataaaaacctcttccttctttaatccggtgtctgaggagttttgtctgcgacttgtcctgctacactatgtgtaactaattcaagtaccttgtcatcagttctgccttgccggtgatctaaatggactccccgcagggaacagcactcatactgcagaaggtcttttcttttgcctttgggtaactggctttttacactttattgaaataattcctaagttgtgatttgcttagaaaaattgagattaaaatgtttttaaattaaagttattacatctgtgtaattttctgtacgtgcttttaaaatccttatgccattaagttacagggctttgactcctgggtctaaaaaggacaccaagtcctgctaatttttttttttttttttttttttttttttttttgagacagagtctcgctctgtcacccaggctggagtgcagtggtgcgatctcagctcactgcaacctctgcctcctgggttcaagcgattctcctgcctcagcttcccaagtagctgggattacaggtttgcaccaccacgcctggctattttgtatttttagtagagacagggtttcaccatgttggccaggctggtgtggaactcttgaccccaggagttcccaacccacctcggcctcctaaggcgttggaattacaggcatgagccacccccactagccaaagtcctgctaaatcttaaacactgacagcagttaaagcctcatcctcagacccgatagaagatgccagtcaaaataaaccgcgttcctgagacacaggccagaaatcaaaccaaaaccagttaaaacagttcagttcctgaaggcccagggactatcgcggaagaggcgggtgtgtggattgtaaggggtgattttgagagataagttaaccattaatgttgaaggcacactgatgtaagcccagcatatgggcctctgtgtcggattaacaaggttttcttggagtattaacccagtccttaataaaaggttataaaaggcttatggaaattgtattttatactcaacatgattaaaattgtatagattgggctaggtgcagtggctcatgcctgtaatcccagcactttgggaggaccgaggtgggcggatcacttgaggtcaggagttcaagaccagcctggccaacatgatgaaaccccatctctactaaaaatacaaaaaaattagctgggcgtggtggcgtgcaactgtaatcccagctacttaggaggctgaggcaggagaatcgcttgagcctaggagggagaggttgcagtgagccaagatcccaccactgcactccagcctgggtgacagagcgagactccgtctcaaaaaaagaaaagaaaaattgtatagattgtcgtgcacttggtttctcaagtcgcccacctggccctcttccacgtgtgctttccttcccttcattcctgttccaaagttctttaataaacattcacccctgctctgaaacttacctcagtttctccttctgcttatgcccattggtcgaattcttctgaggaggcaagaattgaggttgccacagacctgtacggattcactgccagtaactcagatacctttcaccagtaacatgtcaatggaaagaatcaaactctgtaaaacatttgaagagatttattttgagccaaatatgagtgaccatggcctgtgacacagccgtcaggaggtcctgagaacatgtgcccaaggtggctggggtgcagcttggttttatacaatttagggagacacagacatcaatcaaacacatttaagaaatacataaggccagccgggtgcggtggctcacgcctgtaatcccagcactttgggaggccgaggtgggcagatcacaaggtcaggagatcgagaccatcctggctaacacggtgaaaccctgtctctactaaaaatacaaaaattagccgggcatggtggcgggcgcctgtaatcccagctactcgggaggctgaggtaggagaatcgcttgaaccaggaagtcggaggttgcagtgagccgagaccgtgccactgcactccagcctgggcaacagagcgagactccatctcaaaaaagaaagaaagaaagaaatacataaggccgcgcacggtggctcacgcctgtaattccagcactttgggagtccgaggtgggtggatcacctgaggtcaggagttcaaggccagcctggccaacatggtgaaaccctgtctctacaaaaatacaaaaattagctgggcatgatggcaggcgcctgtaatcccagctacttgggaggctgaggcaggagaatcgcttgaacccgggaggcagaggttgcagtgagctgagattgcaccactgcactccagcctgggcgacagagtgagactctgtctcaaaaaaaaaaaaaaaaagaaacagaaacacattggtttgttccaaaaaggtgggacaactcgaagcagggagtggggagcaccttccacgggtaacacatcacaaggaatttccttgtgggcaatttgtgtgggaggtatgtagctttttaatctttgtagctgtcttgtttacaaataggattggagggaggtctgcctgccagcagttcccagtttgacttttcactttggcttagtgattttggggtccccatattttcctttcatactagcaaataccccaaaaccttcccacacccccgtggccacagttactttgctgttcttggtctcaaactcctggggtgcactctttctccaccagtggtgtgatcatggctcactgcagcctcaatctcccgggctcaatccatcctcccacctcagcctcccgagcagctgggacaacaagcgcacaccaccatgcccagctaatttttgtatttttggtagaggcaggattttcctatgttgcccaggctagtcttgaactcctggactcaggcgatcttttcactgcagcttcccaaagtgctgggattacagtcatgagtcaccatgctggcctcctgaggcctttatgtacctatgggcttgccagccgtcctccaccctcctctcctctccaagccactgggggccttgggccaaactttgtgggccctgccctgccctgcccaacccttgcacttgctcttcccaccagcccctcctcgtgagcctctgtgcatccctcctctccgccccctcccagtgttgcagggctccggatcccagccctcacaccgcccctctgtcaccgcctactccccaggcgcctctccagtcctggattaaacgccatccaccctgcaccaaaagaaccaggaggccactgcgtgtcagccgtgcccttattttaagcaccccagtttaggccgaattctaagaacatgtgctctcccagattcccctgcgccagcccctggaactggtgcctctgcggaggtgccactcccaaggtcgggcgagtttacacggcagagtggagcttaacgctaattcccaagtgggcctgacctagtcccgggagccttgaaaagaggacagttttctgtggctggtgacaggagggggagtcagggaggtccaagcctgggaaggcttcaaggtgcggatgctggtttgaagacagggcggggggcgtgagaaggaacatgagcaccccccagaagcagggagcagccatcagtgacaccacaaggaggcagggacctcctcagtcccacacccggcttcccagcgacaggagcgagcttggaaggggaccctgagctccagaccagagcgtgaccagctgccgcctgactccagcgtaagcagagacccacagactgcaagctaagaaaggtgggctgcttgaaaccacgcaatttgtggtaacaggagaggaagaccaccagctacctgaggctcctccgaagcactgggttcctcctgcagcctctttctttcacctccacctcccatctgcccgccagcgtcctcggctccaccttcacacacatcaggatctacccacctgcaaccgcccgcgctgctgcccagttcggaggctcacctgcacccttgggccgcctccagatgcttgtagctcttcctgagtatccaggcacttccacgacagccagcgggcccttaaatgcgagttggctgcattggcctctgctcaggagtccccggcacagccgtctcaggtgctcagagggaactccattgtcgatgcctggcttcctgggctcttgctccccgtggattctcaccacttctcgagcacctgaagtgctccctgccctgggcttttgccctgcgcctgacccagaccagctgcaaggttgctccccacttccactggtctggtctcaaaagcacctgctcagagaggccatccatggccctgtctgcagcccactcagcccttcccagcatagatgaccctggcacgttgtatactggtcttgctaatcttcctaagaaagcagtgacctggatacagttattgtctccattttccagatgaggacagcgaggcacagagaggttgggtcacttgtccaaggtcccagagagtaaagggcagtgctggggtctcagctcaggccctggggtcccaatgtccacacgtgaatcctcagcgtcatgcatgtgtctccctccaggcagagggcaaatttgcttgctgtccaagataataaagatggcttctccctctgggcagaaactgggcaggtttgctagcagtcctttaaatgactggtgtttcctaacccagggttccttagctgtgtgtacagcatccaccggagccactcctcattgtccgtggggctggggggctggggggaatatgaagctcgtgctgcctgctgtgctgtgagtaacaaagtctttgtctcagacccaggtgtctcatgtcttgcccatgttcagaacactggcaggctcactgttcacttgcaaacagagggaactctcagaccattcatttcttcctttttcctacttcccctttccctcctccttgagggccagcttttaacctgccaaggagccaagaaagagacgttggagagggctggggattgcacaaataagtaaaagcatcggggatgaaggatttgaggactctcgtttcggagaagggagttgcaaattaggaaagtggtcagactggaccaacttctggctgggtggattgaaattggagatatcagtacaaatccagttccaatatggatagctggaaatacagatgtatatctatgtgtgtgtatatatctatgtgtgtgtgtataggcatatgtattttctacagatctggaaacagtgagcacccctagtgcccagatcttggattattattattattattttttgagatggagttttgctcttgtcgcccaggctggagtacaacggcgcgatctcggctcactgtaacttctgcctcctgggttcaagcgattctcctgcctcagcctcccgagtagctgggactacaagcatgtgcaaccacgcccagctaatttttgtattattagtagagacggggtttcaccatgttggccgggctggtcttgaactcccgacctcaggtgatccacccacctcagcctcccaaagtgctgggattacaggtgtgagcaactgtgccctgccttctctaccattttgtgacacagaatgaaagtcctcaccagggccatgcccttgaacttctcagcttgtagaactgtgagctaagtaaacctcttttttttctgataaattatgcagtctcaagtaatcttttatagcaagacaaaatggacggagacccgcacatacacacatgagagagaagggtaagcctgacctcatagtggaaacctcaaattctctccccagaaacggtgtaataattgcttattcattaatgaatgcaaaatgcttactaattaacttttcagtggggaatggcggcagacaccatcatacccaagcgatgagggttatcatcaccagcgatggccagattggccccgtgggcctccggtaggttgctgtaagaggaaagtctcacttctgaggggttcctcctggaaatgaagaagccacaggaaacaggcaaggctagagcgagggccatcccacaaagacccataagacccacaaagactcactgagacagcggggaaattggcaggggctctgcggagtcgatggggacattggatcagtggtggcttcctgatttttcaaggttcactgcaattacttgggagagagttcgtttatttccaaaatactctctgagctgtttaggggagcaagcctggagtctgcagcttattctcaaatgccatataagcaggagcgagagaaggaatagcggggcaatgttcacagatggcgaatctgcaggacaggaatatccgggtctctttgcacggtgtttgccaccttctgtaaattgggattttttttttttttttttttttttttgagacggagtctcactgcaacctctgacttcctggttcaagcgattctcctgcctcagcctcccgagtagctgggattacaggcacacgccaccacgcccagctaatttttttttgtatttttagtagagacggtgtttcaccatgttggccaggatggtctcgaactcctgacctcgtgatctgcccgcctcggtctcccaaagtgctgggattacaggcgtgagccactgcgcccagccccaaaattgggaattatttcaaaataaaaagctggataaatgcatacacacaaggcagtatcgcgtattttccacgagtgcctgtgcaggcaggtaaggatttaggaaaggtctggaaggatgtgcaaaatgttccgcctgcgaaggttccgcggtggcggggacactgctccggctccgctcccgcccgcccgagcgctcggatggggccgcctctgcactgcgtggccacaggcgcggcccggctgcccacgggcgccctttgcagctgctgccccctggcggccgcgggcggctactagcgggaaagcgaaacccgcccggtccattcaagccccgctgcctggcgccctctagggtcgttcttgggaacgggcggacctttcgtcaacactttgcctgcaagatcccccattgggggaaccgaggaggaagttaaaggaagatgtgtgtttttgagcgctgctttgtgccaggctcatcttaggtgtgggacgtgtactatctgaattaataccccaccaggcctgtgggacagtcactgtcaccattcgcaaattatggatgaagaaaggaggtaccaagtggtggtatcacctgtccatagtgagctgtccctcaggagggtggccgccccacgcgaccattcagtgtgctctcattcacacgttcattacccaagagcactgctagcactgggggctggctcactcctgcgatcccagcaccttgggaggccaaggcaggcagattgcttgaggccaggagttcaagaccaatctgagcaacagtgagaccctgtccctataaaaaatgtaaaaattagctgggcagctgggcatggtggcacatgcctgtgatgccagctactcaggaggctgaggtgtgaggatcgcttgaacccaggaggcagaggctgcagtgagctgagattgcaccactgcactcaactccagcctgggtgacaaagcaagaccctgtctcaaaaaaaaaaaaaaaaaaaggatggatgtggtggcctatgcctgtaatccctcccagcactctgggaggctgaggcaggcagattgcttgagtccagaagttcaagaccagcctgggcaatgtggtgaaaccctgtccctaacaaaaaaaaaaccagctgggtgtggtggtgcacgcctgtggtcccagctattcaggggaccaggaggtggaggctgccgtgagctgagatcatgccacggcacttcagcctgggtgacagagcaagactctgtctcaaaagaaaaaaaaagtcctccatatgtggtcccccctcatgctgtctcttccaggcatgtcctcccacatgccaggaggctgcagggccaccaggatgtgacctccttgggctgtgctcccctgccccaactccaggcagtaggatcccagaattcccaacaaaactctccctgcctccctggcctatgcggcctctccctgggctgtcgctgtgaggcatccacagcccctgccatgccaggcagagtggggatggtcggaggggagcgggtgtggacgggacacagggccttccggagagcctgaggtgctgcttctgaactgctccttcccctggtgtgcaggtgtcttcgtcacagtaggacctgggagaacagttccataggtccgggggcttctctccagctggcgaggaggtgtgtggtcctctctccctgtcaccgttactcaggtaacgacagggcagtgagcagagcagtgttgcccctcctggaccctgtctgaagaggcaactgtggctagaggctggagggcagggcggcagggcatggtgctggaggcaggggtggccctcggggctcccctcctcattcccgcctccctgcgtgggtcacagcggccttcactgtggcctcctcactacctggggtgccccaggagcacctcgtggagggagtgcctgagtgaggtcaagcggggcggaggaaggggtcgatggtgagagagacagtgagtgagcccagactccacacagggcggcccctagcgctggccacctcagcagctcccaccagcagcacaagctggatgacagggccagggcctgtggtcagtggtcagtggctgatgacaaagccatgctgtgaccctctctcactgccagagcagacgcggggcggtgagcagccaggcaggcccgtaacctccacctccccagctgcgcccgtcctgcagggactcaacctgctgccctccgcccacagccctcgagggtctcagcattaagggctgggctgggcctcccttctgggtgcctggtcccatttgggcctcaccctgggcaaggtccccgtagctgcccctcccatcaggtaagccccaccccccgagtttcactctgagtggtttgtctttgcatagagcttccccacctgatggtgactgccgtgggtcccacaggtccggtgtccatttttaaatttcactgcagacattgcgctcaggcgccctctgaaaccgccacagaggtgtcatccccaggtcccatcgggcctttgtctcctggcctccccgtgtgcagtggtgcagtgctagctcactgcagcctccacctcccaggctcaaatgatcctctcacctcagcctcctaagcagctgggactgcaggtgccacctcacccggctatgcctggtaactttcctgccactgtgacaccagccagttcaggcagtccctcgcctgagccaggtactctgcgtgtctcagcctagccctgctgtccctaccggtgggtgagacggcgcccggtccccaaggctgggatctgacgtgggagcgaggctcttatttgttgctgtgtggcagcaaaagatgaaaaagtggactctggcttcagagctgtgagaaaacagtggtttttttttttttgagatggagtctcgctctgtctcccaggctggagtgcagtggcgcgatctcggctcactgcaagttctgcctcctgggttcacgccattctcctgcctcagcctcccgagtagctgggactacaggcgcctgccaccacgcccggctaattttttgtatttttagtagagaaggggtttcactgtgttagccaggatggtcttgatctcctgacctcgtgatccgcccgcctcggcctcccaaagtgctgggattacaggcgtgagccaccgcgcccagcctgagtaaacagtttttggttgtgtttttttgttgttgctgttgttttgttttttgagaaggaattttgctcttgttgcccaggctggagtgcaatggcacgatcgcagctcactgcaacctctgcctcctgggttcaagcgattctcctgtctcagcctccgaagtagctgggattacaggtgtgctccaccacacccagataatttttttgtgtgtgtttttagtagagacggggtttcatcatgttggccaggctagtcttgaactcctgacctcaggtgatctgcccgccttggcctcccaaagtgctgggattataggcatgagccatggtgcccagcccggtttgttgttttaagccaccaacttgtgggaactggttatagcagccacaggaaagcccctgctggacatcgttatgatcccttttgccccagccctgaatattccagactggtccagaacctcagccccaacttttcaagtccctggtcacggctgtcctctggaagcctaggggcacactcctctcaaggcaggagaaatgttaactgtgaaggttaaattggagaaatgttaactgtgaaggttaaattggagaaatgttaactgtgaaggttaaattgcattatttcttttatttttatgatttttttaataccaaaaaaaagagacaagattttgccatgttgccgaggctggtctcaaactcctgacctcaactgatcctcccgtctcggcctcccaaagtgctgggatgacaggcgtgagcactgccctgccttgtgcttttatttctaaacacattttcctaatgtatttttctgatgactctcaaggggaggatggctgttttggctgggtgtggtggtgcacacctgtagtcccagctactcaggaggctgagcggggaggatcgcttgagcccaggagtttgaggctgcagtgagctatgatggtgccactgttctccagcccaggcaacagagcaaggccctgtctctaaaaaaataaatattaaaaacaaaaacaaaaacaaaacaaaaacaaggaagagcaactgcatagctgcctgacaaaacgagagcgtggctcagccccacggccctgcgcggcctccctggaagcccctgtgctgtgccgggcactgggctccccatgcaggtgctgcgtctgcccggctctgtgctctgagtgcatgcgatgtgcccgaggtgtcggggcagggaggaggattgatctcgatggtgacccagtgaggtaggtgtcattggccccattttacagatagggaaaccagggcatcagtgtgacctggtctaggcaaggcctttgcggcagacccagatctgactcagccccgagggtgcagggagctggctttctccgccagacaagcaggccaactgctgcactcccccctcagtaaggggctaggggtggggaccccaccctgtacggacccctcaccagcatctccccgaggatgccgctggggactcctggcaccccttgcctctgctgtggctgtgtcacacctgtcctgccaactgttgttctgggcgtggacatttggggctccccgttgaggacgcctgggctgcgctctgggagccagcagctggccaccctgccccacggttccctagaggccctccagctcagcacagacccaaccccagatgagggcgcctgcccccttggaggtggtaggctgccctatgccctcctgggcgctgccacagtgctgggtgacctccagcatggtgctcactgacattctgaggcaggagcccagagggcccacaatgcaccaccgcatccaggcaacgcttgcagaaatgctccgcaaataaagtcatcgccactgatgcgaacagggcagccaccaggtacctctgccagcaggcgtgctacctgcccacagccaagggagccagccaggcaggctgctgatgaagaggccccactgcctgccacatgctctctgggctcccggaagcctggaggtgtcgctcctccccttggcatgcagccaccttccatgtgggaaagcctggggccagtggtcacggagggagtggcttcaggaacgagaaattggtagtttgtcttccagaggggacatgggcactgtggctggtgggctcagtgcacaggaaccacattgctggccccaggacccccaacctgccatccccctgccacacagtgggctcagcaggactcctcaatcagcctctttgcagggcatggtgaccctggtgggtgcacgggcctggagaaggtgtagtggtctgcaagggccacgggcgactgcagctcctcggtgtccctgctgtgggtgagcctggtgacgtctgtcttcatggaccactctttccaccccttatggattctggacacttcttggcgggaatggtccgtggccagcacgtagataatggggtcagccacgccgttcaccgtggacaggcacagaaacaccacagaggctgtgtacagcctttcctccaagccgcacatggcgttcctgtctcctctgtagtaggaaaaggcagcggctttgacgaggagaaccaggtggtacggggcgaagcagactaggaagatgacaaccaccgcgatggccgagtgcttcaccttggccttctgggcagcgcttaagcccatgctctgcttgatgctcctgaaaatccggtggttggtgaaggcgatgatggagagagggatggcaaagccaacggtgaacctggcgtagtagtacccggcaatcctgctgtccatctgcagcatgtcaaagcaggtctccttgtcttccgtctggaacaccgggtagtgaacgatcccgacgaggatgaagatgcaggcggagatgaggatggcggtcctccggcggcggcggccccgactctccagcgcgtacaccacggccacgaagcggtcgcaggagatgcagcacaggaagaggatgctgacgtagatgttgcagaagaagatgtaggcggtcaccttgcaggccagcaggcctagggtccagcggtgctggttgcggatatagatgacccagagtggcagcgtgcctgtgtacagcagctcgcagagtgccaggcagagcaggtagacggccagcacgttgccctgcagtacctgcagcagcgccagccacgcagtcaggcagttggccggcacccccagcgtgcacaccgcgctgtacaccacgaccaggactatcctgctctcttcgaaggacacgttgttgcaggtcttggcggagaggcccagggaggcccacggggcagtggtggtcactggggtggcgtttcctgtgggacagagacaagagtgaggacgggagtccctggaaaccacctgggagagactctactgtgggaagaaaggatagaagctttgtggtagctcagactagacacacgcaggtgtttaaaacatttccaaattgattttttagagcaattattagatagtggatctccaacctagcagcgtcatggacaaagaatgcaggctgggcaatactgaatcatttttcttttttcttttttttgaaatggagttttgctcttgtggcccaggttggagtgcagtggcacaacctcggctcactgcaacctctgcctcctgggttcaggcaattctcctgcctcagcctcccaagtagccaggattacaggcacgtgccaccatgcctggctaatttttgtattttagtagagacggggtttcaccatgttggccaggctggtctcgaattcctgatctcaggtgatccgcctgcatcagcttcccaaagtgctgggattacaggcgtgagccattgtgtctgggcaatgctgagtctttgtaactcactgaggttttcaaaaatgttgcttctggcccggcatggtggctcacacctgtaatcccagcattttgggaggctgaggcaggcagatcacttgaggtcaggcgtttgagaccagcctggccaacatggagaaaccctgtctctactaaaaatttaaaacaaatagttgggcgtgctggctcgcacctgtaatcccagctactctggaggctgaggcaggagaatcacttgaacccaggaggcggaggttgcagtgagctgagatcgtgccgctgtactccagcctgggcaacaagagtgagactccttctcaaaaaaaaaaaaaaagttgcttgtgtgtttgaaaagaatgttgatcctgtaattgctgtgtgagtgcttttctaagcagtctgttaggcgctgctactatgcccttccagcgctgacccactttgcctccacttcccacctggccccatagctgggcactgcctcatcctaattcctaacctgtagtctttttttttttttttttttttttggagatggagtctctccctctgctctgttgcccaggctggagtgcagtggcacgatctcagctcactgcaacctctgcctcccggattcaagggattctcctgcctcagcctcctgagtagctggcattacaggcatgcgtcaccacacccagctaattttgtatttttagtagagatggggtttctccatgttggtcaggcttatcttgaactcccgacctcaggtgatctgccctccttggcctcccaaagtgctgggattacaggcgtgagccactgcgcccggctaatctgtagtcttaccacatatttgcctgtgtgaactatcaattactaaaaaagataattataagctcctgtgggagtggtggatttgtccacctctccttgtattctcccagtgcttgctttacgtatttgaagctactgtgaattggggcataggagtcacagatggttctgtcttcttggtgaattgatcctcttattactatgtcatgtgatacccctcctctcggtggcaggagactaatgaccccacccaaaagatgtctgaatcctaatccttgggacatgtagatatggcaggttacacgggaaaggggaactaaggttgcaagttgaatgaaggttgctaactagctgacagtaaaataaagagattattctggactatctggtgggcccaatggaatcacaaaagtccttaaatgtgggagagggcaaaagaaaaggagatcaaagtgatctcagcaacctgcctcaaacacagctctccgaggtcagaaactcatcctttccagccagggggttgctagaggtcacgcagggtgtgcagtggtgtgacttccccaagctctgccagcgccaccagctccagtgtcctggctgcccactctggctgagttcatgcttctgggccttctgtggttacagatcatggagtcccacctccaggtcagcaggaagccgcagacagacctggcctcagcacctgacggacggacagagcgttgccaaacttattgggccacagcagccccgggcggggcaaacttcagctgtgccctggcgcgaggtcaggggtccctgggcactgtccagcccgctggcctcaggaaccttccacatgcaaatgtcgtagtttccttgacctccctcctgtacttgagggcctgttgacctccagcacgatggggcaagtcaccccgaacggggtcagccctgcggccccattgtgtcgctctttttttttcttttttttttttttgagacgtagtctcaaaaaactgtgttgatgcccaggctggagtgcagtggcgtgatctctgctactgcaacctctgcctcccaagttcaagtgattctcctgcctcagcctcccgagtagctgggactacaggcactcgccaccacgcccatctaatttttgtagttttagtagagacaaggtttcaccaggttggccaggctggtcttgaactcctgaccttgggtgatctgcccaccttggcctcccaaagtgctgggattacaggtgtgagccaccatgccaggccacttgtttttgtgcatttaaaaaattcagctgggcgcagtggctcacgcctgtaatcccagcactttgggaggccagggtggggagatcactagaggtcaggcgttcgagaccagcctggctaacctggtgaaaactcgtctctactaaaaatacaaaaattagacaggcgtggtggcaggtgcctgcagtcccagctacttgggaggctgaggcaggagaatggtgtgaacccggaaggcagagattgcgccactgcactccagccagggcaacagagcaagactccatctcaaaaaaaaaaaaaaaaaaaaaattcggccccatgggccgttcattccttcaatcccaacgctttggaaggacaaggcaggtggatcacccgaggtctggagttccagaccagcctgaccaacatggtgaaatcccatctctattaaaaatacaaatattagccaggcgtggtgggcacctgtaatcccagctacttgggaggctgatgcaggagaatcccttgaacctgggaggcagaagctgcagtgagccgagattgtgccactgcactccagcctgggcgatagagtgagactcaatcgcaagaaaaaaaaattgaaaaagtggaaaattgtggcaaaatacacataacaaggaatttaccattgtaaccgtttttcagtagcattgggcacattcacattcttctgcaaccatcgccagcatccgtcggcagaaccttctcatcttcccaaacggagactctgccccaggaagcactcgctccgcatttgctcccagcccccaggcctccattccactttgtctctgtgcgctgggctcccctgtcacctccccacgtgggtgggcatctctgcgtgtcttcagcgtgtgtccttccgtgtctcacgtgctccactcaccacagtgtcctcaagctccctcctgttgcagcgtgtgccaggatttcccttcctttcaaaggcgggatggtattccattgtattcagtgtgtcctccagggtctcgccaaaaatataaatatatatatatattccactgtgcccttccatcttgagcaatcctgcacgtgtggcgtgtggcgtgtggcgtgtggcgtgttctgctcagccacgactccgctgacagacgctcggctgcctctgtgccttagctgagctgctgagaatgacggtgtcaagaacatgaggagggctgttcacgtccctgctttccgttctcctgggtcagacccacagttggcattgctggatctcacggcagttccgtctcatctcgtggggtgcctccgcgctgttctccacggtggtggcgctggcccaccttcccccggcggtgtgcagggctccggtctccccacagcctcgctgcgcttgctgggtttctccgggtgagtgtcgtgtcccttgctcaccttcctccctgggcagagggagagagtgggtgtgactgggctgcctcacactcagttgtcaccacttcgcccaagacacaggcctgtggcgggcggcggggggcagtgaaggcagttctcgggtgggaggcccaacgcctgtgtttgcactcactgttcttcacccagatggctcttttcccatcaaacgagtgccccagccccgctgtgcgagtcctgagctcagaggaagtttcgggccccctacacggccccgtctctttcatgacaatcacaggccctgggaggcagagccagaatccaaaacacaaggggagatgcaggcaagacccggggtggccagaggggtccctcccacctcagcctgcacagagccgctctggtctgttccctccccgacttcctacggctcccccaccccacacatcgtcgcccgtgcggtctcagtcagggcctcggtgcccctcagtcccgcaccccctgctccaggcctcacgcagccttgggaccttcacctctggacaccaggtccgtggtgtctgtggctctgtgcccatctggtgaggaggctgtcccccgctcccccgcctcctgccacaagtgacctcctgggaagagagccttcctggtgggtcagaagtaggggcaacggcaccaggagacgcatggatgcggggggctggtggtcagctcctcatggcccagaccgtgcagggctcccctgggacctgtgggacagccccctgactcagtactgtgtcgccctcccaggagccaccaactatgccctcattcccgttcctggcttcccagaacttcacgaaagaattatgaaatcagtccttcatttctccatgtagcacctctagatttattattgctgagctagtttttatctcgataatctatttttatgcgttaatttttgaattatgagacaacatgcttcatggaaaaattctcatgggcttcctcttacatgttcaaagtcggagaaggctctctcacctggcatattttgcgggttccaatctcagtgtggctctaagataagctttctaagtacatgtcatgcgtcttgtcggtcctatcaagacgttcactctgagagtttaaaatgacctggaaaaagagtaggttgaaattgttttagggaaatcagattgagtcacaagttaacccattgacaaacggctagtgagtatttactaatttactaagtggcccgttgattcgtaggtgttttttaaatgttgagaatctgccgttgcatcccacatgagaaacacaagcaaggctccaagccaacaggcatcaaaacgtcacattagccactgcgactacatacgattcttttttttttttttttttttttttcttgagatggagtcttgctctgtcgcccaggctggagtgcagtagcacaatctcggctcactgcaacctctgcctcccgggttcaaactattctcctgcagcagcctcttgagtagctgggagtacagtcgcctgccaccacccccagctaatttttttttttttttttttgagacagagtcgcactctgttgcccaggctggagtgcaatggcatgatctcggctcactgcaacctccgcctcctgggttcaagcgattctcctgtcttagcctcccaagtagctgggactacacacacgcgccaccatccccagctagattttgtatttttagtagagacggggtctcaccatgttgggcaggctggtctcaaactcctgacctcaaatgatccacccacctcggcctcccaaagtgctgggattacaggcgtaagccaccgcacctggcctaggtactcttcttgtttgtcaattatacctttataaagctgggagagaaaagaaagttgatgagctttcacagaaaacataaaaatagctcctaaaggccaggtgtggtaactcatggctgtaaatcccagccctttgagaagctgaggtgggaggatagctggagtccaggagttcaagaccagcctgggcaatatagtaacaccccacacctacaaaaatataaacaggcatgatggtgcacacgtgtagtcccagctacccaggaggctgagttgggaggatcgcttgagcccaggaggtaggggttgcagtgagctgtgactgagctgctgcactccggcctggctacagagagagaccccgtctcaagaaaaaagaaaagctcctaaaatctgaaaaatgttcaactccacttctaatcaaagaaatgcaaacatgaatatctgaaagacagtcttttaaaatctttttttggcctatcatgttggcaaaaataaagaccttttaaactcatagtgtttgagagtaggcaatgggtgcccgtacacgggactgacggaagtatgaattggctcgcagcaaaattttgcaatatgtttccaaaaatctcaaatgtgctctacttttgacctggctgatccccttctaggaatttttcctggctacccgaggtgtgacgtgcacatggcctggaagctgtgtcacccacagcatgaggggcccggaggagggaggcatgatgggcgggcagcagatggctcagggcatgcaggggggtggcgcaaggcgcccaggggcctgtccctctgcttccttccctaacctgaggtgcctctaaaacaggcaccaccctgaccagccaaagagggtttgcagggaggagagcgccctaaacccatcctcagatggtgtttgtgcctctcccacagccctgcaaagcctgagggtctcgctctgctgtttccgggccctgcagtgcagggatagaggctgagcctggcggctgcctcactagctccaatcctgcctccctggtgccaggcccaacccccaccccatgctgcctggtgctgccctctatcagccgagaccctcatgggaagccagcaggtgcagtcagtctcccagtgcacactcccctcccagggcagggccggcccggctgcgggcagagcccctacacagcaaggcccctttgggcccgaggcctgtatgttgagaggctggccaggggcactccctggagccacttgctcttcccgcccatcccacgtggctcttgcaggaattctctggaagctgctcaaaagtgaggcagaacccagggacacccacaccaagggctctgggccagcaggtggggctgcctgtgtgttgacatccccagctgccctttcaagtatatttctgtgaaaggaaagtatcttgggccccttcaagctgggaactgctcagcgccgatctgcctggcgttctattcagtcatccctctgctcactgagacagatgcatattctgatgcctcctttggagagacttatcagaaactgaaaacaatgcaaccatttgtctctcgcctacctgtgtaggcgagagacaaatggttgggaagccccctccctgcttcgagttgtccccacctttctggacggaaccaatgtacgtctcacatatattgattgatgtctcttgtctccctaaaatgcatgaaaccaggctgcgcccgaccaccctgggcacgtcatcaggacttcctgaggctgtgtcacagacgcgtgtcctcaactttagcaaataaacctcctaaaatgattgagacttgtctcgacgttttttaacaactggaaaaacaggaagccacaatgttctcctgagattacaggaagcttgttaacttatggagaattttaaagcaataccttgaaaacacatgaaaaagtgagacactgagtcaagaaagaaacaagaaaagccatctccaaagtgatgcccccttggcggtgggtggtgtgggccggaggggttcctgggctacccattctgccaccaccctgccactggctggagtaagtatgcactgctccctgcatctcgggccagccccctgagtggagatggtggggcagcgctgagggtcttcagactctccctcgggtgcctgtgtgctgggcgctgccctcccagctgctgctctgccaagatccgtgtggccctgtcgtctggctgctgcgcccagctccaaggcccagcaagagatgcagggctctctggccatgcccaaaacagaggggtcagtaggtgaggaagcagtgagccggaaccaggagggccaaggaaggcagacccccagccaggcagggggcccaagtgggctgggggcatgtcagagccacctgagaccagtcctgttccttctgagccccgggggtgtggggggcccgaccagcctcacactgggcctggcttccctcctcagctgccgagtccccttcagtggccctagaagcccacatactcttgctcgctggtgtctactccgattctgcagccgccccctccccacctttcaaattctgaataacacgaggcagggacctctcctgtcaaatgagcaggagtgagcacatggagccactgcctgaggcccctgggccccatcagaacgcctgagccgcccaggaaggggctcccggggagtctgcctccttcactttaactggaccaagggttctggaaaccctcccaaacctgggaggatgaactcttgctggtccagggctgtgccgcccagtcacgccaatgccagccggcaaccctgggtcagagggctgcaagcacttctgcaaaaccaaaggaagtggcagctgcagtggaaatgcacgctcccctcccgggccccagccgcaggcagaggctcacagcgaggcccctctgggatccaggcctgtatgttgagagcagagactagccaggggcagagccggagccaccttcccatccagctggtcccatgcggcccatgcagcgtgagctgctgacgtccagatcccgccacgtgcctgacctttgggcaccacagcctggcgaggatgcctggaaagagtcagtgggcccagcaggaggcccggtgggaacaacccaaggcagggcagccggagagccgggtccactgggacgtcccgactccctcgcaccgaggtccagctcctcaccacgcatggccaaccaggcttgggcgccgggggagccctgcaccagccctttgcttatcagagcacatccaggctttgtctggcattccctgccggacaggcccacagcctcaggcagcccaccggcctcttccgagggccttcctggaccagggtccggggtcccgccagcacctgctcaccatccttttgccgcacctgctactcctactgcccctgggagcctctgcctcccctcggggtgagtgagctcaggataggggctcagggccctctctccggccagcccagtggccccacccgccagctgcagtgtcgcggtctgtcctggcccggggccagggctgtttcctccacagaaaggggcgtggggtacagcaggtcacccacatttcaggccctgctcttcctcggggagggtgcagtggggcccgggccctctctcagcttcccctggggctgggtcttcaagtggaaggacaaggccaggcagaggcttcctgtgttgttccactcaggaagcaggcaccaccctcctggggggggggagtccctcctgggctgtgcatggggaccgtcccttcctctcatcgccccagctgtctggcccaccagtggggctcctctcagctgtggggtgggtgggagtgactgagccctgtgggaaaggtccccggtgcagactttcacttctgaaacagcagcaaggtgctcccagcctgccggaggcttgggtaggggatagcccaccatgctcacagcaccagcaatgccagcctggcctggtggactccaggggactctgttcttgatctgctctgagggactatgacaggcagaggccccgctatcaccatccaactccaactggattcagggcagcgtggccagacatgatggccatggtgaggtccctcggatgactccagccacaagaccacagtgtgtgtgggcccaggtcagcctgacacccccgtccacccatccctgagctccagctgcatctcctgtccctgctggccctgggcccctgcctccacctcacatcagcaaatgaccaagcccctcatcacccagcctccatgctgggcaaatgtgtccctgtccagctccatcttcaagccacaccttggcagcccactgaggccagccctccactgctccctggacttctctctcctgtgtccaacccgcctttctcccactcagcgtgtcagctccgaggctgctctgcctcacactttccgtgcttcttccatgaacccatgttttctctttctttttttcttttgccttttttgccttttctttcttttctttcttttcttttcttttcttttttttttttttttttgagatggagtcttgctctgttgcccaggctggagtaaagtggcgcgatcttggctcactgcaacctctacctcccaggttcaagcaattctcctgcctcagcctcccgagtggttgggactacaggcacaccaccacgtccagctactttttttgtatttttagtagaaacagggttttgccatgttgcctaggcaggtcttgaactcctgggctccaatgatcctcctgcctcagcctcccaaagtgctgggattacggtgtgagccactacgcccagcttttttttctttaaatactattaaaattgttctctctctctctccctaaccctctccctctctctcttgctttatttgtttgtttgtttgtttatttatttatttggagacagggtcttgctccctcatccaggctggagtacagtggcaaaatctctgctcactgaaacctccacctcccaggctcacatcatcctcccttccgagtaactgggactacaggcacctgctgccatgcccagttaatttttgtacttttattcttagagacgaggtttccctatgttacccaggctggtctcgagctcctgggctcaagaaatccgccggcctcggtctccgaaagtgctgggaatacaggcgtgagccaccatgcccggccaatgaatccattttccagattagagaagcaccacatgttcctgggatggacatttcaataacaggatctagcatgacctcacccagccactgtccctggagctctctggcctgcaagttgctgtgctcctccagtcttttaaaatctattttgtaactttttttttttttttaggctgagtttctctctcgttgcccaggctggagtgcaatagcacgatcttggctcactgcaacctctgcctcccgggttcaagtgattctcctgcctcagcctctgaagtagctgggattagcaggcgcctgccaccatgcccggctaattttttgtatttttagtagagaaggggtttcgccatattggtcaggctggtcttgaactcctgacctcaggtgatccgcccgcctcggcctcctaaagtgctgggattacaggtgtgagccaccacgcccagcctgttttgtaacttatgatggaacttttcagacagacacaaaaggacagagaaggagccctggcccctgccatgtgcagggagcagttcctcattccagcccatttgtcaaaaacagctcctcaggctgctgaggtctgtcttgtggactatctgtaatttctttctttctttttttttttgagacagagtttcgctctcgttgcccaggctggagtgcaatggcacgatctcggctcaccacaacctccacctcctgggttcaagtgagtctcctgcctcagcctcccaagtaaatgggattacaggcgtgtgccaccacgcccggctaattttgtatttttagtagagacagggtttcaccatattggttacgctggtctcgaactcctgacctcaggtgatccacctgccttggcctcccaaagtgctgggattacaggcgtaagccaccgcacctggctggattgcctgtaatttctaagctgtttcacggttgctggccattcctagccatttccgtcttttactcccacctgctttggcaccaggcaaacctatgacctcttttctgccgtcacgtttgagacaaaccctagggagggaaatgtggagtcaccagctccaacctccctgctccaccacacccatccaaagcccattgtcaactttcttatttttcccaatttgatagtgttgcccaggctagagtgcaatggcgcgatctcggctcactgcaagctccgcctctcaggttcaagcgattctcctgcctcggcctcccaagtagctgggattacagacgtgtgccaacacgcccggctaatttttgtatttttagtagagacagggtatcaccatgttggtcaggctggtctcaaactcctgacctcaagtgatccgcccacctcggcctcccaaagtgctgggattacaggcatgaaccaccgtgcccagcccctatcctcatcttcttccaggagcctctgctctcccacctcggcctggccaatctcctgaaatatcattttgtgctcagcccaactggccagtcttcagtggtcagtcccagtcccttgcagtggtacagacccacgtcatgcacttgacagaaggtattgggccccccgccccgctgtgcctggtgcgccgaacgccactccaaaggccggtgacctgcccagctccaggatcttgtcacgtgactgggccaactgccactcaccgcagcacagcccccactgccctgcttttccctctgtgtaaccccacaagcagcacaggccccacagagagaagcccagcccttcagtgccccccgaccaatcacggaagcaagtggccaaggagagattccagggacaaagtccagccccctgactcacccccatctggaccagtagccagggaagccttttccagaagaaagtctccaggaaggtggcggtgacaaagatacaatggaaactgttgtccctctcccccaaatcctccggccccatcacatctgtggtcactgggggtcctgggttctctcgggagggaccccagattaagaaccctcaacaaagcctccatctttaccaacaaatcacctttgccttcagatccccctctgcccgcctccagctcccagcccccagccccatcccagagcctggccccccaggcccactccccagcacgcagagcccagcgacttacccagggccccgcctgcgtggctagcctcgcacccctccctgcagtcctagctgaggtttcaggaagtagcaggggtctaattatgttctgtctagaactcccctaaccacaaacagggctgagctaggggttagccaaccgggctggggtatcttactggtgatgacagcatggcctcgtcaccttcctgagggagggagtggcaggaaaccccagtcttacctcttttagcaatagcagcactcagagccaggctccactcactcaggagctcccaggcaggtgctggggcctggcgcggcacagcggctgtccgtgtgtccccagacaggcaaggcaggacaggggtcctggaaaggctgcagggaggggtcctggaaagacaaaatccagctcctctgcagctcaggcctggtgttgcccactctcgggccaggcaagcacggagcagggtgacttcccagaggctgtgtcctcccaggagtccctgtccggggtgccaggagtagagaggctgagtgcgcccactgcagccccgggaccaggatggcacctgcatgtcctggaaggctcggcacagccactgcacacaagcaccctcccctccccgcctccctcttcctacatggggcagggccgtgtgggaagaacagcctactgcacactccacattcctcccccagccctacctcaacccctcctgcatccagaaccaagcctggcctggcccaggagccctgcgggtgggcttctctgtgaggggccctgtgggaactggagggtgggcaggcagggttgcctgggacagtccccctcactgtggggcttccggccatgatgggcccagtttccttggacaaagccagctggctgtggacagcacctacaactccactcacctccaggctgcttctgagtttcagggcacagacccaccctggtgcccactcccgagcctgccaagctccatccaagccaggctctttcagcagtggggacagggccgggctgagggaaggagctggggaccacaaatgtctccaagcgacactgcccagcaccgcagcagggacggtcactgagcgaagaagccgccatcctgggtgggtacacccacggccaggagaggccggtggaggccgagcccccagtctacactttcccccagacacgtggatcacagctgccccctgctgcagggccgcatggctggaggctgcctccgaacagcgatttcagagggttttgtgtgggtggcagtggagtccctggaaagctgggctttcccattgccctggcggggaggcgcaggtctcagggcagggcctaccttggctttccagaaacacttgcccaggggacagtgatcctctaggggatctggtgcaaacacacgcctccacaggccactgctcatggggtcactggcctcccgggtctttgggccagggcagccccaccctcggagcagcaatagacgaagcccacatcaggccagtgggggtgatggccagggacagctgtgggttcctgtcgctggccccagcagcctcctaggacctgccccgtcctgcgccccactgggtggtctgtcacgttcaccaggcctcctctgcgcccccggtgaggggtccaggagtgacatgcggacccggctcaggccattgtcaccctccatgccttctggcctttgccaggcagtccgggaatagccgattcaagtgaggtcagttgaatcctctctttgggtccttcactggggtctgggaaaggaaagttgggtcccttgggtggcaggagctgtgggtatgaactggggggttggcagccgtgtaccggctcccctgcccctgccaggtggagaagccaggctggggtggagggcaggcaggagcctgggagtccaaacactgacagcctgggggtgtggactggccctgcctattcccaccgggccttcgggaccagtggaggctgccccgggctgtgcggcacctggggtgttgtctctgagaagcccgtcagggagatggctctccctgctctgaccccagcaaagcgattcatacccagagaatccctcaccaacaggagagcaggtttcagacaggaagtcacccgaacatcccacggctgagtcacgtgccagaacagctccctgcggcccagacacagcagtggtgaggtccaagctgcagacatggggtacaacttcacatcccgatgtgtgcaccagaaaccgccctgctgtccggtgggttcaccagccgttctcctggcctgtctggaccctgcagaagccaaagctggtgattgcttgctaatttgtccagtcagtctgggaaggcctgggcccagggggagacaaggccaggaataagggaagggagggtcagagcaagaaatgtccagggggcaaagttggaaggagctggaaagatgggacgagggacccaaagagcccctgtgcatggggccagtgtggtctgctctacctcccgggcagacacagggccttgctcttgtctggccctaaaaaaccctgaatggccagctctggccttccccacctggtgcatctggagcagaagttcccaagggctaccttgcatgtggggtgcggctgtcccccaagccaggtgtgaccacgctgtgggggcttgtggggctgctcctctggtgacggcggcagggttgggtcgggggcctttgctctataactgtagagagacagtggccggaagggtaggctttgagagtgggggccccaggcctcccagcctcccaggaggacaggtgtggcgggcagatgcccagatccctgtcggtcccgtcgcccaggctggagtacaatggtgcaatctcggctcatgcaacctccgcctgcctggttcaagtgattctcctgcctcagcctcccaagtagctgggattacaggtgtgtgccaccacacccagttaattttttgtatcttttaatagagatagggtttcattatgttggccaggctggtctcgaactcctgacctcatgatctgcctgcctcagcctccaaaagtgctgggattacaggcgtgagccaccacgcctggcttttttttttttttttttcgagacggagttttgctcttgttgcccaggctggagtgcaatggcaggaacttggctcaccgcaacctccacctcccaggttcaagcgattctcccgccttagcctcttgagtcgctgggattacaggcatgtgccaccacgcctgactaattttgtattattagtagagacagggttttgccatgttggtcaggctggtctcgaactcccgacctcaggtgatcctctcaccttggcctcccaaagtgctgggattacaggtgtgtgccactgcacctggccttctctcttgattattaaggactcatagatttgtattttatggtaaaatacaagatgaaaattacacgagatgaaaattaccatcttagccatttctaagtgtaccggtcagtggctctaagcacattcacgctctgcaaccgcccccaccgtccattttcagaaatttttcatcgtgtaaaactgaaactgtcctcactacacagtaacatcccattcctccctgcgcccagccccttccactttctgctctatacacgcggctactccgggtacttcatcgtaagcgcaatcacacagcctttgtccttttgtcctgatgtctggcttattttacttagtgcagtgtcctcaagtctcattcttgcagcacgtgtcagaatttccttcctttttgagggtaaataacatcccttccatgtctctgtgtttagccattcaggtgttgatgggtggatgtcgcttggctgctgtgaatatgggtgtgtgggattcatggacttttatatcttccaagtgtttctgtccaacctagtcattattctttttttatttttattttttcttgagatgacgtgttgccctgtggcccaggctagagtgcagtggcatgattttggctcactgcaacctccgcctcccgggttcaagcgattctcttgcctcagcctcccaagtagctgggattacaggcgcccaccaccactcccagctaatttttatatttttagtagagacggggtttcgccatgttggtcaggctggtcttgaactcctgacctcagatgatctgctcacctcggtctcccaaagtgctgggactgtgctcggcccctagtcattattcttgatgatgctcaaattgtcccagatttgacaagtcacccactctgcctctgtgctgatgactatagggcaaatcctgtgtgtcagtttccaggcacggagcccccctccatcaggtgtgtctgtgtattcacgcctcgccgggcccccctgctcagatggtgattccatccctccctccatcaggtgtgtctgtgtattcacgtctcgccgggcccctctgctcagatggtgattccatccctcggaagaagtcttcccagccttttctgactccttgttcgctcccttggaggagggctctgtcctggcctctcccacccctgggtgttagtgatgcaagcagggggtggggaccggatgacaggccaagtgggaagaggaaaggcggaagtgtcctgaggtttctgttgggggacagctgctctggtaagaaggcaagaggccccaggtctcagccagggaaggggtttttagggaaattttgaagacagcctccccgagacagaagaggcaggggaagataggggcttttgagaagtgtcaacccaagaactggatcattctgaaactccttgttgccagcgcatgttcctttgaccagggcatacccccaatgtgaatcatgagtcatggtttcaacagtcatagtgtgtcctagtgaggccagggagaggctgcctgtgaccccagaaaacccagacgaccatgcctaacccacctaatccacagagtttcctctttctcagggctggcacgacagcctccacagccatgggaagcccccagccttacctcatggtcccagatggcaacttgatctccagccttcacatctgtgttccaggaatgaggaaggagcgaaggagagcagggcacggcccgtcccctgtgtggagaattcccggaattcccacccagttcgcctgctccatcttccctctttcctgggcccaacgtagtcttgtgaccacatctggcagcgagggaggctaggaaacgtagtctttgatgtcactgcgccagctgatgctgggtgttctcctaatcaggaagggggcgcggagtcggcgatgtgtgctgcaatggcacacactgtcaccagcttttcttccacccagcaagggcaggtccctggcagctgagcgaggggcacgctggccaagcccagggactcaattaccccaaatgagaaaagggtcaggggatgttgaactgggaagaaggaggtggagccccgaggccagagaagctgggcgtatgagagaaagcttttcttccatactgtaactcacaacgcctctggcacttcacttctggggttaggttaagggctcagtcacccgtgactgccctgacttcagacaccagtcatggaggggtgggtccccaggttacccactacttctgaatgccttggctgtgacaaatgggaggtctgatgactctctcctcgggttcagtcatttgctagaacagctcacagagactagaacaactgtttgtttcctactactgaattttttttctgtcatgctctctctcagcagaatgttttatattatatatatctatttttattttacatttgcagacaggtctgcctctgtcacccagactggagcacagtggtgcaatcttggttcactgcaacctctgcctcttgggctcaagcgatcctctcaccccagcctcccaagtagctcggactacaggcatgagccgccacgcccagctaatttttgtattttttgtagagagagggtctcaccatgttgcccaggttgattttgaacccctgaactcaagcgatctgtccaccttggcctcccaaaggcgtgagccaccgcacccggccacttctggcttattactaaaggaaacaactcagccagcagagatgctcagggcaaggtatggggatgcgggtggagctcccacggcctctccgggcgcctccctccgagagcctccacgcgtgcaccaacccagacgctctccaaatcccattgttctgacttttcatggaggcttcatcacacaggcttggtctccagcccctcccttccccagagcatggcgggtgaggccagaagtgtcaagctgctcatcgtggcttggtcttgctggcgaccagcccccatcctggagctacccaggagcccagcaagagctgcctcattggaacaaaagatgctcccatcacctaggcaagtctaagggattaggagctctgtgtcagtaatgggggacagagaccaaatatatatgtcttatgatgtcataagaggagccaaaagaggagaaaaagatggaggaggaggaggaacacccagtgggagcgggatttggttcattgtgaaggaattttctccccacgggaaccccgggaaaacccacatcaagcctttgcacgcaggattggtgtcaaccaccaaaaccatccatccacactcccgccgtccatccacacgcccgcctgcccgtccacacgcccgcccgcccgtccacacgcccgcccgtccgtccacatgtctgaccgtccgtccacatgcccgccgtccatccacatggccgccatcgactgacgtcagcagacctcagtattccctgtctccatccacatcactcgctcttccagggcagtcttgcctagggagatgaagatggcaaacaaccttgctgttcagctcaggaacttccaacatgcaatggacacttctgtaggaggcatcaagccgttcttggtgatatctgtgtcttcatcacgtgctggttgcacgggtgtttaggtaggaactctctgtggagctgtgggcatgactgtgtctgtgtcttcagtagagttgagaggtttgagagcagtcatgaggattaacagcagataccaggaggctgctcgctggtcctgtcaacacggccatgtagtcaggatgccagctcccccaccaagtcaactttggggagcttggcagagccgtgactccaggaggcatccctggactctcgaagccccctgctgtgtgtgtgtcagggggctctgagcccagtgagtggctgtccctggggcaggcagggggcacttgaggtgccacagaggacacggaccgtaggaaccacgagaggggcggatggcccagagccagggtgtggatgactgccctgggcagctggggtcgggaggcagccttttcacttcaatgagaatggtgtgcagctgggatgggacagcctctcagaaggagagaagggacgtaacagaaaggtatggtggggacaccagaaagcagaggtgcggacagggcactcccttgctctcacacctgtgggatcatcccatccctggccggctccagctctgcccacatttctcattcctcctttgggtctcatcagagtccccgcatcccgcaggaagtgcccccacaggcaggcctgggtggagctgggtagtcttcctctgtgtccccctcaccgcccccgcttcccagctccaagcaggaggctatgtccctgccgcctctgcccctacaaatggacggttgccagctgaaggaatgagcccaatcccggctcctgctccctgcccgtgggatctgggcaagctgccggacactttgggcctcagtttcccccttacaatgtctgcctttttgtggggtccttgggagctccctgttgttggttacaccagtggagtggacagaggctcagcctaagggtgtttccagaaaggccatctgctggaggggggctgggagcatccctggagacagagagctttagactagctgctggggtgggtgcggtggtgggagtggagctgctgggggcagaaaaaggggcttccaaggggcatgcgggttctggcaagctgaatccctcaccgtaaaccatgcacctgtccaagtgaagaactgctccagggctcgcctgggccaagaaggggctgcagggcaccctacgaggccatggtggctaaagataggctgagcaagccaagggccctaagccggcagccaagggtggcctgggggctgcagtgggggcctgggggctgcagagccggcccccagcctctctccacctctggcctctcagctccctgagggtggtgtccacggccagctgctctcccctcagggtggaagacctggggaagcccccagtctcaagctacagccttgatttctggaacaatcccaggacaggactctggcccatcaggttctgcagcccaccctgggcagagtggctcctcttctgggcagcccatacctagtgtggtcgaggctgggttgcccaggcctggccagacgaatctgggtccttgtgtccagctgggcctcggagcctgccacgcccccggcaccaccacccccctaataaactccccttcctctacctgtttcctccaccagcctctgggtcttgctccctgccagggtccaactcacagccacctccgccactgctcccgcggtgaccatgcgtccacggccccccaggaccatgcttgtcattctcttgccctctctgcttggcgcggggtttggctgcagtctgggctgctcgatgctcccggggcaggggctattcccctgtggtctcaagctctgggctggcaggggatgctccgagaacccatctgttacctggagggtccaggagagattgaagcaggtccctgggggcttcccagagctgggctcctggctgtcccctctctggggactgtcactcccagctctcctctctaggaactggtggggaggaagaccctgcagcagtgggaggccaaggttggggggtccaccctcagtgtggggtgtgggtggctctctggggtaagggcttggtatcatgtggccccctgaaccccagagctggcccctgaaaattctcctcaaccgcagagtacacccctccacctgcagctcagggcccctgccccgaagctcaccctcctcagagaccctcccctggggccccaaggaagggctgggcctggtgggggctgcatccttctcattgcccttcacagcgtggggggctgatcccctttggaatgcacttccctagggaacccgcctcgagcctggctgtccccccaacccctgtggagctgggccttggggcgtgtccactcgccctgtatctgctcctgcccccggcggtccctggtctccactgaccatcctttttcgtccctgggggggtagcagcagcaggcaaaccccggccgaacagtccctgtgacactccttgagggcctggagccagctggagccaacaggtgccacatccagggccagcttccaggactcaggaaggagcgacgtgcagccggctgcggtggctaggtggggccagggatgctgctgaacgtcccaccacacccaggagccatctgcccaggcacagctcttctgtgaagtacctgctgggtgccaggtctgggcggggacccacagagtctccacaggtgggggacttaccctcctcatggccctgggcctcctttgcagccccgctgccccgagctcccccagaccctccctcccacccccacagcccctgccccgagctcccccagaccctccctcccacccccacagcccctgccccgagctcccccagaccctccctcccacccccacagcccctgccccgagctcccccagaccctctcccacccccacagcccctgccccgagctcccccagaccctccctcccacccccacagcccctgccaagccctcagggcctattctcagccgcttttaggaactgcttgttttgccctaatggtgctttgagacaggaaaggcccaagataagggccaccccccaggcctcagggcgggggatagggatggggcggggcagcggagggagcagactgctccccacaggccctctgcggatcagcagaagtgcagctgcttcccctgcccccatccaggccagcaggagctcagcacggaaacccttatgggggaacccggcccagtggctcccaacaggcacctccccttccccgtgccagtgaggggggggtccagtgtcccccgttccacagaggggacagttagggtctctggagacatctttggacttcacggcagggaggggtgccactggcttctagtgggtggagaccaaggaagctggaaaatgtcctgcaacacacaggacagcccctcccgccaccacaaagaagtttccagccccaaatgtccaggcaagaagtcctggtagccttcgggcagccaggggaaagctcagagctgtcctgttttagaatcattgttccgacgcccccacgggagggctggcggctgggagggtggctgggagacggctagtgccaggaggccacgcgatagaggggcagcccttgcgtccctgccagtgtccttcagcccgggggaagcccctaaaggtgcagtgtccaggttggcagctgaggccaggacagcaacccagacaccactggggagacagcaaccccaggtggaaagcaccctggctgatgccagcgctcagcacccatgctggaaacattttggttccctctgcaggctgtcggggttccagccaagctcagctgccaggggtctggttaacaatccagggtcagggacccaaggcttctgggctgcgggacccctcactgtcactaataaaggagggccagtggagtcggggctgaccccacagaaactgggggtttctggcagacagacctgcaggcccgcggcacgccccaccccgggcagcttctgaggtgggggagctctctgcctccaaggacccacagtcctgggagggggctcctcccgtcagcaggccctggagaaaggccaccatcaccaccctgggcatgcgggccaggcccaaatcctggagcaggacgggaagctttgcagaggggctgggcttgagcggagcccgctgaggcaggccagggcatcccgggccgaggggacagtgagggcaaaagcagggaggggtgaggggtgacgcagagtgggcaaggccatgggccaaggaggctgggccaggagacggagggcaggggagcaggagggctcagggctgtccgtgggagaggaggactgggggagtggacatccccaagccacagccaccctcaggctgtgggagaggcgaggcctagaggacatccagcctgaaggcactgcacaggacatcgagagggctcagaggatcctagggcctaagggctaagaggccacgtgaggctggcagggcagagttgcccgcccacggcgggggaggatgaggggcaggccagagggcgggtggggggcatttaccaggtgctcagagttggtggagtccgggcaggagctggagggctgaggaacagcctgtgcatgtgaacacgggcatgccagtatgtgtatacgtgtgtgtgtgagaatgcacacacgtgtgtgcgtgtgaaaggagttctgctgcacggctctgaccggcccgcggcagggcagtggagggcactcctttgcctcacagaaaatgcaggaggttgggggggtgctccacttcctgccccctcacctacagactccacagccttggcctgtgtcccctgctcaggggtgtgacttccttccggggtggaggaacccaacacccgcctggacagggcctcacccccaaagctgcatcttctagccccctcaccccaaagccacaccttccagccctgctcgtgctggcacccatccactgcctcacccacctgagagatctcatctttacacacatgcacactcaacacacaggtgcacacacacaggtgcacacacacactctcacacaggtgcacacacactctctcacatacacaggtgcacacacacacacacacaggtgcacacacactctcacatacacaggtgcacacacactcagacacaggtgcacacacaggcatgcatttgcatatgtgtgttcagacacacactcacacagggacacacacacaaacccccacacatggctccaggccagccaggagcatgggtggccacaggcccggacccctgggccatcttactgctgtgagaccccaagcaggctgcctcaagtctctgggctgggctccctcagggcaagacgggggtgtggaccggacccacggggcccgatgccatgtgcaaactgctcagaggtcctgggggcatcttcccagctgcagctgtgggctccagctctggcctgggcacaaggcttgcctcggcctcagccaggcagctcctgtcaatcctccaccttcagagagagcagttccatcgtcagcagagccccttccttcggctttgaggcaggcaggctctgaggttgctgtcctctggcctctgtgacttcactcgaaaaacgggtccttccagcccaaaatgtctgcatgggaagattatcttttcttagaattgctttttttttttttttgcataaaaaaatcttaatatacatatccaaaaaatgcactgtctggtgttcagttctacaggttttgacaaatgcacaatcacgtcatccactcccacagtcacgattcagaacagtctcgtcaccctcaaatccccctgtgctgcccccatccccaacccctgcaaccaccaatctattttccttctctctagctttgctttttctggaatgtcatattaatgtaattaatcaatcaaccaatatgcagtttagtcaatgcatttaattaatgcaattaatcaattaatatgcacaataatgcttattagtacagatagtaaccttttgaatctggtttctttcacaaagaaaaatgcattggagactcatgcatgacatttgaattgatggcctcttcctttttgttgctgaatagtattccattccacccatgggctgcaggtttgatctactcaccgactgaagaacagtggatttgcttccagttttgttttttttttgttttttttttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtctccctgattacttgagattagggagtggtgatgactcttaacgagcatgctgccttcaagcatctgtttaacaaagcacatcttgcaccacccttaatccatttaaccctgagtggacacagcacacgtttcagagagcacagggttgggggtaaggtcacagatcaacaggatcccaaggcagaagaatttttcttagtacagaacaaaatgaagtctcccatgtctacttctttctacacagacacggcaaccatccgatttctcaatcttttccccacctttcccccctttctattccacaaaaccaccattgttatcatggcccgttctcaatgagctgttgggcacacctcccagacggggtggtggccgggcagaggggctcctcacttcccagtaggggcggccaggcagaggcgcccctcacctcccggacggggcggctggccgggcggggggctgacccccccacctccctcccggacggggcggctgccgggcggagacgctcctcacttcccagacggggtggctgccgggcggaggggctcctcacttctcagacggggcggccgggcagagacgctcctcacctcccagacggggtcgcggccgggcagaggcgctcctcacatcccagatggggcggcggggcagaggtgctccccacatctcagacgatgggcggccgggcagagacgcccctcacttcctagatgtgatggcggccgggaagaggcgctcctcacttcctagatgggatggcggctgggcggagacgctcctcactttccagactgggcagccaggcagaggggctccccacatcccagacgatgggcggccaggcagagacactcctcacttcccagacggggtggcggccgggcagaggctgcaatctcagcactttgggaggccaaggcaggcggctgggaggtgtaggttgtagtgagctgagatcacgctactgcactccagcctgggcaccattgagcactgagtgaaccagactccgtctgcaatcccggcacctcgggaggccgaggctggcagatcactcgcgattaggagctggagaccagcccggccaacaaagcaaaaccccgtctccaccaaaaccagtcaggcgtggcagcgcgtgcctgcaatcgcaggcactcggcaggctgaggcaggagaatcaggcagggaggttgcagtgagcctgagccgagatggcagcagtacagtccagcttcggctccgcatgagagggagactgtggaaagagagggagaccgtggggagagggagagggagagggagagggagagctgcttccagtttttagtgattataaataaagctgctgtgaagatttatgtgagtggcatttctgggtgagaaatggccaatttcttttccacaacggctgcaccattttgcattctcaccagcagtagatgagaatttctcgtgcttcacatctgtgtcagcatgtggcattgtcattttacttgtgtgattatgttttagccatttcgtgactgtgcgatgggatggcatcgtgctttcaatctgcactcgcctaatgagaaattatgttgagcgtcttctcatgtgcttatctgccatctgtataccttctgtggcgctctgtttgcgtggctgtgcaatgggatggcattgcgtttaatctacactcgcctaacgagaaattacgtggcgcgtcttttcatgttcgtatctgccgtctgtataccttctgtgactctgtttcttcagatctttagcctttttttttcctttccttttctcttcctctctttttcttttttgagacagtctcactctgtctcccgggctggaatgcagtagtgcaatcatagctcactgtaacctgcaattcctgggcttcagcaatccttccacctcagcctcccaagaaggtaggactacaggcacatgctaccatgcccagctaattttttatttttatttttgtaaagacagggcctctctatgttgtccaggctggtcttgaactcctggcttcaagctatcctcccaccgcagcctcccaaagtgctaggattacagacataagccaccacacccagctgttagcctttttttttaagacagagttttactctcgttgcccaggctggagtgcaatgacgtgatcttggctcactgcaacttctgcctcccgggttcaagcaactctcctgtctcagcctcccaagtagctggaattacaggcatgcgccaccatgcccagcaaattttgtattttttttttagtagagatggagtttcaccatgttggtcaggctggtctcgaactcctgacctcaagtgatccgcccacctcggcctcccaaagtgctgggattacaggcgtgagccaccgcgcccagcattagcccatttttaaactgggtttttttttttttttattgttcagttctgaattctttatatattctgaatggaagtcctttatctgataaatgatctgaaaattttccaccagtctgtggtaattattatcttttaaatctgcaacttggcctttttttgttcatattatttgtgtctttcctttctttgctccttcttcccagaactgttgatccattttgttggataatttttttcgaagaaccaatttttgtcttcattgttcttctctattgcatctttgctatttcattgatttctgatcttatttttatctccattttctcaactttctgggcttacactgtttttgcttttgtttacctcccaacttcctctttttaaaattcattttttaaaatttaaggtataatttacatacagtgcaattcactcctctggtatgcacagttctgacttgacacatgcgtttagctctgtaaccaccagcacaaccgaactgtaaaacatttccatctcctggccgggcgcagtggctcacgcctgtagtcccagcactttgggaggccaaggcaggtgcatcacctgaggtcaggagtttgagaccagcctggccaacatggtgaaaccccatccctactaaaaatacaaaaattagccaggcgtggtgacgcacgcctgtagtcccagctacttggaggctgagcaggagaatcgaaatttcgccactgcactccagcctgggtgacagagtgagactctgtctcaaaagaaaaaaaaaaaattgccatctcccaaaaggttccctcatgcctcttcacagtcaatcctgccccctaactttctgagatggagacagcttacaaaccttaagatttcttcttttcactgtaagcatcagtagcaatgcttctggaagccccgcttctgtggccccccacaagctgggtgtgcaatgttttcatgatcatccagttctgtttgtttatttatttactgagatgaaatctcactctgttgcccaggctggagtgcaatggcacgatctcggctcactgcaacctctgcctcctgggttcaagtgattcttctgtctcagcctcccgagtagctgggattacaggcatgtgctaccacacccggctaattttttgttatttttagtagagatagggtttcaccatgtggtcaggctggtctcaaactcttgacctcaagtgatccacccacctcggcctcccaaagtgctgggattacaggcatgagccaccacgcccggcccagttctgggtttttaaggtttctattatgatcccttctttagcttatgttatttagcagtgtacatacgtgtgtgtgtgtgtgtgtgtgtgtgtgtgtgtgtgtaaaagtcttgtctataatttccccaacattgcatatttttaaacatatagcaacatgaaaagaatcacacagtgtaaccccactcaccacttgaattctagttaacaatttactgtacttgttccttcacacatctctgcatctacccatccatctctctatacacccttccactcctctatccaccccttcacccaccatctacccatccatccatctctatccttcgatccctctatccatccatccatcccccatcaacccccatccccccctccagccatccatctatccatttctatccatcctcccctctatccacctatccattcctctatccacccctccacccatcccccaggcatccatccatccacccatccatccatctctatccatccttctatccacccatccactcctctccacccctccacccatccatccatctctatccatccttctatccacccatcccctcctctctccacccctccacccacccctccatcatccatccatccacccatctctatccatccttctatccacccattcactcctctctccacccctccgcccacccctccatcatccatccatccacccatccatccatctctatccatccttctatccacccacccactcctctatccacccctccacccaaccctccatcctccatccacccatctctctatccacacatccatcaatccctctatctgcccttccactcctctattcacccctccactcacccctccatccatccacccaccactctatccacccaaccgcttctctatccacccctctacccacccctccatcctccatccacccgtctatccacccatctatccctctatctgcccttccactcctctatccacccctccacccacccctccatccatccacccaccactctatgcacccatccacttctctatccacccctccacccacccctccatcttccatccaccatctctctatccacacatccatctatccctctatctgcccttccactcctctatccacccctccacccacccctccatccatccacccaccactctatccacccatccacttctctatccactcctccacccaccccccaggcatccatccatccacccaaccaaccatctccatccaccactctatccacccatccactcctctatccacccatccacccacccctccatcctccctccacccatccattcctctatccacccctccaccctccatccacccatctctctatccacccatccatctatctctctatctgcccttccactcctctattcaccatccacccatccatctctatccattcatccctgtatccacccacccactcctctattcatccatccatccatccttctatccattcctgtatccacctctccatccatccatttatccacccacccatccctctatccatctttccattcctctatctacccccatccatccatccatccttccacccatccacccacccatccctctatccagccttccactcctctatccacccctccatacatccagctctatccatccattcctctatccatttgtccatcttttcatacatccatatatccatccctctatccatccactcaccactgtatccatccacctctcctccctttgttttccctacaagccccacgtcctggggggctgactccaactgggggtgctgcttccaagcctcatgccttagtgaattggagaccagcagagaaaggcctgacagccagacctaagggctgccacagattgctggtgcagcccacccccacatccatccaccacaggctgaggacagggatgtcatcctctccatgggcacagggctcctcccaggagccagcagaggccaggcttttctttggactgtgcagagtgtgcactcccaggcctgctgagtgacccttttccacgcagattcagagagggctcacagaggcagacgtcaaagcccagctttgcagggtgagtggagggagagcttggagaggctgagccctcgatagctggaaccagaggggagtgagggcaggccttggacatccttttgtcaaagtatacattttgggtttggctatgtctaagttactctgtaataaaagtcatttattctgcccagaggtctgtggcagttctgccatcaagtgatggtgagtctcaggacagggaggacacaacacatcccacctgtccagtgaagtgatgctcagtggccggtcccagggctgggcttggacgggagagtggggacgctttgtccactaatcactttctaagtcaccacagccttgggacagccataccttgtggtctctagggatcctggtgttctggcctgaggtctgaggtcaaacaaggtctgtgctctcacaccaaccctccactggcaagcaggacccagggagggggtcaggaggcagctgggtgctcccctgggacacaggcctgccctctgccttcacttcccacagctgcccaagcccatcatgttctgggcctcacccttccacatctgggaccctgaacagccgcctgtgaacaccgacaggaagaacaggggagcgtccagcattgaggcacgcgaagagccctgacccctggcccttccctccagctacctgggacagcctgaaaccagcctgaacccagcgagggaagtctcggaccctggagacgaccttgtgttctccctgcgcgatggtgaaactccaggcactgccacagcttgggagagggggtccagccagccctgctcctccctccatggagctggccctgggagggcagacagctggtagtgcccactgcactggaggcagcagcccctcagactctgtgcctgcagcccagccttgggaaacagcatactgggcatggggcagaggcccattcagttccccggacactgaataactaatgacccaggctcagccattcattagaaattttcttgattcagagaaacccccatcaccctcagccggaaaatctcttggtcccctggtcacagtgattgaagtacccccgaccacaaccacacaacagggagtgatgtgggggagtcctgggcttctagaggctggttgtggcttcctgcctcagtttctttgtgggcaagaaggcaccagaggcctgtgacctcccctgctctcactgggactggcccccatcaggtttatgcagtgaggcgcagaccctcagcaaccgtgtcctgggccttctccatccccaatccctcccatgtcacctcccgtttcccattactgccaagctccagtgcctggggcaggaggacaacccatgcagccagccaggccatgctggcagaagctgctggtgggggcatctgggcatgctcaatggcaccccaagagctaaaatggactctaggggggtggccaggccctggtgggggaggtacactcccactgcccagatccaaacccgatggctgggccctgacctgcagggtcccaggctcaccagcccctcctcctctaacaggccggtgctcagttcctcttcccctccggagagacccagcttcccacagcctgtttctctgggggacaattccctgcagcttgggaattctcaccgtcccacctcccattttatcttctcttctttctctctctcgctctctttttttttttttttttttttttttgagatggagtctcactctgtcacccaggctggggtgcaatggcccaatttcggctcactgcaacctctgcctcctgggttcaaatgattctcccgcctcagcctcccaagtagctgggactacagggacccgccatcatgcccggctaattttcgtatttttgtagagaccgggtttcaccatgttggccaggccagtcttgaactcctgacctcaggtgatccgcccacctcggcttcccaaagtgctgggattacaggcgtgagccaccgcgcccagcccacctcccattttcttagaagaaactgagacacaaagagcctgagaaagttgcttaaggtcacacagcccatcagaggcagggtgcagggtgaggcacagggaccagaaacttcttccacctgatatctctgagacagcggcctccctgttcccctcttgccacagtctctccaggataaggtgagggtgtcaggggcctgggtccccacttgcgaccccaccgggctgctcctgggacgggctgtgcaggccaggagactggcggacctaagaaactgagacgtgtttctcagctcccccaaccacgtccccagccccgccggtcccggagctgccctgccgcctggtggctgcggctgcgctgcgcccgaccggcccgcgctccagggcatccgacctccagttcccccgcccgcgcccgggagtgcgccgagagcagcagaggtcgagacagcagcccggaggtggtgttacccgcaacctcggctcctgcgctcggggccgcttctctcctgggtgcagtcagctctgcgcgggggaccctcagcacgccgtccacggacacggctccctcggccacagtctcctccccgccatcagacgcactgcagacctggggcctttgtttcccaggcagggaaatgggcgtgctgcgcccacgggcgcagggaggacgggggagcccgccctgggggcctggaggattcgcgtggcctccgcggtccagaagtactcctctcccctagcgatccccaggattctcttccccagttccctccctggtctagaaccgagactcacagctccccacccctcggtcccgagttccctgtcccctccccccaggccgggaaccacccagtcccctccgcgcctccccaacccccagcccagagcattcctgcccgcaccgtacccttcaatctccgcccccggccaggagcctccctggcccttcccgcccggcggggcaggctccgggcaggcgggcagcctcgcggcggcggcatccgcgcccaccttcatgccgccgcaggctggagcgcgcctgggcctgtcgaggccgctggcggagcagcggcggggcgggcggggaggctgcgtctgcgcggcccggaggagcccccgcagaggctggagcgagcccaggcaggctggggcgctggcgcggggcgagctggcgggggcgggagagctggcccagcgctgggtttcctgggtcccagcacgcacgcgcgccttagtggggcgccggcccgcttcccaggcagatcgcccttggcctcgcctctggctcttttatttgcacaatcaccccgaggtgggtgatgctattgttcccacttttcagattcgaaagtcgagacacaactggaattcgtatccaggttccagacaccgcccgtcctcgggcagaggtttgcgcagaaacaagcatcattcctgaccttagggacctcaccgagcctgcctgcgggcagggcagggaggtgctgagaattcgggtgcacgtgccagcacccggggccccagagctcccctccccatgaagccctccctcagccccctccctggagaaatggcgagccatctggaaggaggtcgagaggggacccgctcccgccaggacctctcttctgggagtggaggagtgggcggaggagaagggttcctgagtccccaacccggtcccaggccctgggagccgcccctcgccccctcgggaatctagttctctttgccaaaccgccagcccgggcggagggctgggggcgggggcgaagccgagcgcgctgacacacgcgcctggaattcccaggagagccggccgcggcctgtgacctcttctgctcttggccggccccagccagcggggccgaggggaggacaggctccctccacgggggtggggcgcacacccacctcgttcctcctgctggagcccgccctgtccgtgtccctccccctcccaggcagcctgcctggaggtagcagtaccctctgtgctccggacccaggcagatgtgaactcccctcactccacaaccaccagagacagcccggggcagaccctgtccagctcctgccccagggccttgagcacattaccaaatgctctgtgcctgtttccccatctctgcaaagggtgctaacggccatctcagaatggctcgttgagattcaaagtgtcttgtaaatggttgttacaattgcatggaaggtaaactgaggcccagaggccccaacaccacagagccacgtctactcaccagcccccagcccccaccactccccgcacagtgtcctccatcatgctgtgggttttggaggttcagagggcacccagctgggagctcgaggcaggctgagctgtacacagtggtgtgaatgggcgtgcatgtcatgcaaggcagtgtgctgtgtgccctccacgtgtgaaggtgtgtgcctgtgtgtgagtgctggtgtgaacatgtgtgtgtaccctgtgctcatgcaagtgtgcatcgtgtgtatgctggaagcagtgtgtgcgcgcacgcatactctgggcaatccactcctcgggtgtggtgttgtgtaaacagtggaggtctcagatgccagtccctggggacactgggcccccgccccaggtttggctggcccagcttgtcccctcccctgatcagcccttgccaaggagtgctttgccatctgggggctagagggagttgtggtgggttcagcgccctgcaagggcaggcctgtgccctgagagcagatggtccccggcttaccctccaggccaagaagtcccccagctcaggtgacagcagagcccaggaaggagggccagccaggtcagccaaccccagggaaccccccaccccgacggcgctgggcactcaggatgggggactccgcagaagccttaaggactgacagtccagggagctggggtcctgccgtgcagacacactgggggacccaggtctgcagggactcgctgcagaaccaggagtcccagggcacacgagcctccctgcccaggttgctggcaagcccctggggtgagtgggggcccagctgccccgccctgagcaggctcaagcccgcttcccagatcccccctgaacccactgcccgcgaagcagggtaggagatggagcaggggaccacaaactcacaaactgagacctgtcccttcaccctgggcccagagaccaggcagaccacttcccacccagacccagagcccagaggggtctcatgggctggcccaccccaccacatccccgtatggcctccgccctgacagctcccgaaggccagggatgctccctcccctggtgtggggggctgggatgggtgagccagggcccccacccacccctagccttgtcgctcctgccgcaggttcctcagcacctgcccatcacagcctgctgactgacaaggaccccatgctgcaggaggcaagctggggcccaggagggaccgcagccccgggaggctcctcattcattcacatctccaccaaagaagccccacggctgcccagtgccagacctggcctgatgcctggatggctgccactgggatgatcagggtcaagtagtgtgggcctttgagcatcctggagagggcggggaggcctctagaggcacccagggtgcaggtctgaagagggatgggctcagctggccaacacacggacaccttgggcctggcctccacttctcccagcctggctgcccacactccccaccctagcagcgggcagtgtctggcgcaccagtcctgctccccctgctgccatcctccgggggatggtgtccttgggccctaatgggcttcaactgcccatggaagccctgccaaggtcccgacttgcagcctcctggcgggaccaatgtcctctccaggcccttcctgcatggaccagcccccaggggcattgctccaagccagcagcccctctgccctggcctgcagccctcccagcgcctgctccaggcttgacctctccctcaccttctcctccttcagctcctatcacccaagggcacagaaaggcactgtcgcaccaccagggggcgccctgcctcaggggcgggcttaggacacagcagtgctgcttatctgggagcccaggggctggggacagaagaggctaactgacctctggctggtaccttccgggcttcaggacaactcagccaggtggtcactgtgggcccactccccagatgaggaaacaggccagagaggaggatgccaccggccctggctcttgggagtgggaggtctgtgtctccaggattcctccaagccaccaatttgggaaagtcatctgacctctctgggcttccgtttccccacctgtacagtgggggtgggaaggcatcactgctggggctgagcatgggactacaggacagagcttggggccctggctccagcaggctggtctccagcccctgggagcagggacccaccccacccagcacaggtgcctaaaggctgttgtctccgccagcaggtgaccctgcacccatgggtgggggtccacagggccaactcagccctgcacctgccagctgaggacaaactctcctggggagcttttgggctgtggccagaacaagcgaggctgcctttgagcggctgcctttctgctttctgctgtgtgcgtgtgtgagcatatctgtgtgtgccaggggcctgggctcggtgtgacccctagcaggtatgccccagctgtcaacaccctctccctcctgtggtccccactggccccagatggaggccgagtcccccagcccagagcgccccgggggtcgggagtgcccactgctttgagccacagaaacccaggccccaacctcctcaggacccccaggcctcctgggccaccaggatgcaaaccccacctccaggcaaggtggaagcccatttggcagctgaggccctggtgcctgaggccatcaagggaggtcagaagggacaaaggccacggctcggccgagaggagggtgccgtccgctctgctcaggcactgggccgggtgccagcagcaccacgttcccacgctctatggtgccaatcttggcaccccagccctgccccacccttgccttgcagggaccagggcaccgggaatgtggctgtggattccgccccctggggccacggattcctgtctcagtgggcgggggtggaggacggctttccaccctttgatccttgccagttccagggagcgaggccacgcccaggccctgccagccaggccacaggggaggccaggaggcaggcccaggcgagacagagctgactccctcagctcaggaaccccagctcccagggcctgggcctgctccccaggtgccccagaagctcctgcctcacctcttgccagctgggcacggggcctggtgcccagactaatcgggcagagaccagcactgggcaatggcccagtccccaccttcagcctgtgatggccacagcaaccccttccctcacctccccagtctgccacagggcacagagtcccagcccctctccgccagcctggcctcacatgctcaccctcctgccctagcaccccccattcggcagccacaactgccccacccagagactcctgggcgcctggtgctgttcaggacactggcctgctcagcatcaagacagatcccagaatgtcctgggcttctgaccacaaaggagccagcataggctaaagcctggcacgcggctcagaaccctcaaccctatgtgcttgtttcctgctcccccagcctctggagccggctgacagctaccccctcagtacaccttcatgcgtccccgacccctgttcaagcaccactgagcaccccaaccagtggacaaggggacaaggggtcccacaggaaacaggaccaccctctgagcctgggggaggggagagcaatctcaaaatcccacgtgggaggggcccagggccaggagtccagataaaggaggggcccaaggaaggatctcgcccgggctcctgagaggcaggaggatggctccactctgccagccgtcctgatctgctaagtggaaattacagtcattagcgtcccctcccagaggcccgtggtgccctgtgggcctggaacttgccccaccccctctgccacatatggcccagggagaaggcgctaaaggtgagcgccggctgcagggcggaggactctggcctctgcggggccgagccacggagccacctggcttgcggggatccctgggacccagccttgttctactgcccacttgacgcggcgggcaccctccttcctggtgggtccttactcccaaccctggcctggccatgggattgccagggtctggtggggggggggtccctttccaatggggcgccttcctatgcagacagaggagaggggagtggtcaggctgggtcctcaaggtgcccagacaggggtgcgaggaggcaagtgctcaccggagcagccaggaacgctccctggaggagggggcccggaagctccctggctgcaagagtggattcctgagcaaaagctccgcgggtggagaaagagagtatggcgggggccacgggggtccgagtcccgacacgcggctgcgcactcgctcccctgcaccgcgggcggggctggggccggaaacgcgcgcggcggcctcggattcctgcgcggtgggacaagcccgcgcctgcgcgccgcccggacagggcacgtcgcccgcgaggggggtggcgggcccaggaggaggggaccccgacagcccctcaccgcctgccggggcgggccgccacgctggacgggggcagcgcggggcggggtcggggggcggcagaaggcgcctttgtgcgtcgcgtccccgagcgtgtcgcggcgggcccggcaccggccccgctccagcgcccgcccccggcccgcgccccgggccccgcgcgcatacctggcgaggccacgaggggattctgcgggccgagccccgcctgggctgcgccgccgcaggcgggagaggctgaggattcttttgggaagcccctccgccggctgtaaccccagggccgtgccaccctcctgatcaccgcaagcatggaccccccagcacgctgcgggtgggacaggcagggcccctgtggggtggcttgactggcctggagttggggacgaagtccccgggcttggtcccccgagggcttggttgggcgtcccggggtaggtggctgccgcggcgatgtgggcggcttgcgtgtggccgatcggggtcgctgctgagccccggagagcggagggtccaggctaggctgggggagcgagaggcgagggcggagccgcggaggtgtgggcggctttcgtggtccgagaggccccaggttcccggcagggcggggaaggctggggcggggccagagccggagccgcgaagccgcgatggagagggcctggagggtgcgccaggagccggcgtcagggcctgcctccatctcctccaacccccaccccatttattcctgtaacaaatccctaccgggagctggcacagcagctgtgcgctggggacacacgagatgctcaccctccctgccctccaggagcttggactcagctgaggtctgcaggggccagcaggagcagggccgagggccctggtgggaaggtcgtggcccactagggaaggctgggcccggggggtcaggtggagggcaggctgagctgcgagctgtgtcttcagcctacagcaaggccaccactcccagcgcctggcctcctcgctcccgaaagctcagctcagcctacatgtgccgacccctctgtcccccaggcccaggttgggcactggtcaggacggtgctcccagagggacccagtaacaggaggagctagggtgagagcatgagggtggggggagcggcagagaggagggagaggcaggaggtgctcagggcaggagtgtctggagtgaggagggagaggcaggaggtgctcagggcaggagtgtctcgagtgggtctggacaggaacaggaagggcattccaggcagaggggcccaaagaagcaaaggtgcaccagggagaaatgcccgctgtgctccaccacagtggaggtgcaaacctcagcatggaagatgaggctggagggaggggcctgggctggaacatggccaggatggcagtggggagccattggagatgtttgagccggggagtgacagggtcagattcgagttttggaaagataacatcttgagccattaaacagatttctaggatttcaggtttatttatttatttatttagagactcacttcactctgttacccaggctgtagtgcagtggtgcgatctctgctcactgcaatcactcaaggccaagtgattctcatgcctcagcctcctgagtagctgggactacaggcgtgcaccaccatgcccagctaatttttgtatttttagtagaggcggggtttcgccatgttggccaggctggtctcgaattcctggctgggattacaggcgtgagccaccacgccctgctggattttggattcttgatacgtatcatcaaccactctccagagtttggccagcttcacgctccatcagtggtctcaccatagaccttctaatcttgattgtgttggctggtgtctattttctaatggtgtttggttttggaacctgcatttctttgaaaaagagtgagcatgtgcattttcccagatgcctggtatccaactgcacttctccatgtgtgcattgtcccctgagctggcaagaagatcctactagttggtctgcatgccatgccagctcggccttgcaccctgggggcccaggtaactagctctcaccaacagaaagagatgtgatggacatcacctgaggccagaccctaagacctctgtgtgccccctccgtgtctcctgtctgcagctgttgtccacaccaagggtggcctacagagggaagtgaggaccttgggacttcctccaggacagccctcgctgtccaaatctccacctgctgcagagctgcctccagtcaagcccttgtttccagctttctgtgccctaaataaacttctgctgggattgagccatcagcattctgtggtgggcgtcgctgctgcgaggttgccctcgtgcacacaagctcctcacaggtaaaggtgatctgcctgtggacatacttgttacagaagtttcccacctgctgtgcgcatcttgcctgtgtgcagtcaccattctttatgcagttggtgcctccatctgctcctgtgtggtttcttcttttggttcctttattatctctcttttggtgctgtttcccagggacttaactgctggaagtttgataaatcctcaactctcaaattcacccttttctatagatttaaacagacattgaatgtttcacctagcattggggcagaaggaaggtgcaggctcggcccttggcccttctcggccaaattgatctcgcgcccttgagaagctccagaatgagtctgagaagcctcaccggggctgatacatccctccaaggtgggggtcgggagactccctggccaggggaggcctcccctgggccagctccaggctttgccaggcccccttggagcctgcaccagccgtgcccaccaggcacaggccagcacgcacggaggctggcaggtctgtgagcccaggattaggggcccacagaggcagacccaggggtcctggaggtcacagacaaggccgtcagcttctctcagcccgtgcagcctggccctggcccaccaggccaaccttgtgtgggtgtgtacaccacccccatcccaggggccacaccccacctggctcccgtcccatggctgccccagggaggtcttcctctcttctctgcccacaattcaccctctccctgagccctcttctctcacctgggatctgatctttcctcctggacactcatgatgcccacagcttggtcaccagctctgtgctagagatcctgacaatccctaagccccttccccagcctcggtctccccatcccgggagcagggcggtgatgccaccctgtacatgcctctgtccccagccccggctcttctccaaagtgcgacgcgggtctccagtggcctgggacctccatctctcagaggcacccctcccctggcagttcaggctcaggagccacctctttccctccgtctctgatcaattcaacctcctaaacgtctatccactctgagccctgtcccattcctggctccccaactcaccttgtctccatcctggctgccaagagagcatctcaaacacacatctgacttgccccctcctctgctctgaagcacacacaccattgctccccagtacctgcaagatcaaacccaagctgttgttgtggccacaacctcaatagagcccacaccccgtcaggctatgtctggctatttacaggtccgcccacccgggttctgtgccccacactgaaactcaggtgttactgcttctgcaaaccctgtcctgcctctgcccccttctgagtcccacccagctctaccccctcctttgtgcccccgacctggcctgtgtctgcatcagttgagaagcccttgcctctctggccttccccggctgggtttcagggccctgccatttcagccccaagccggagtcaaatactgtgtttccccaaaccacagcaaggagagccctcaccaagagcctgcagaatgagatgctcagcccctgtctgggatgcagcctcccagagaggcggagtgactggcttggtgtcacacagcacatccaagtcccaggtagctaaacagaagggaggagccctgggcctgtgcccttcaagtcgtcctggaagctcaagctgccctctgggctcagggagccgactccattccctgcaggtccagcccgtccccctgcctcccaaccctctacaacacacacacgtacacacacacacacacacacacacacacacacacacacacacctgaagcagcttggttgagccaggcattagacaggcaggctccagcacgccctggcatcctggcccagtggctgggaagatccctgacaggcctggtcagcacccggcatctcaggagctcaggccctggaggtctgaacagagagcaccagcacggcccactgacctgtgactgagctgtagggccaaggggccagggcgtcctgtccctgaaccacgtagcccagcaggggaggggctgccacaggaaggccaggtcccagcattgcttatggggagggcagagggggccagggcagctcaatgcagcgctgggccagctggggtgcaaggcaggcctcgaggggccatgacacctgccacggcccagagcctcccctaggcctccaaactgcaggaatgtgagcactggaacctggcaagcacggccagggcaatggtgggcacctcccgccaggcccctccacacagggctgaatggcactctctagcccagtcttctgacatggcctggaaagagatttcaggttgcttagttttttgtttttgcttttttttcccccataaaagataggtggatttcaagattaattcttgaatattttataatttttgttcttttggaaaatgagctcttccctgttattttttttttttactggctttaaagaatgctattgacttctttgtattgggcccccttgttgacctctgatcagtgctaatagttaactgttggttatttgggaaattcaacattaagcaaccatgttaccatgaaagacacggtaatataactttgccttccttgatattgctcctcaaaggctgatttctttttcctgtctcgttgcatcggccaggacttccaggatgatatggaagagtgactgagagcagccgcccggtgcttcccaaccttagagggaggtcacgggcagtctccctgcgatgctggccacaggtgtgaggaagacagtccttataggaaaatgccctctcgttcttattctctactttaaaaaatctttaaatcatgagtataataaatgttatcaaatgccatattccacatcaatataatgattacaattttttttttgagacagggtctcgctgtgtcgcccaggctggagggcagtggtgtgatctggactcactgcagcctcgacctgttgggctcaagtgatcctctcacgtcagcctccaagtagccaagaccacaggcaggcgtcaccatgcccagcccccatgatgactttacttttcttcttgaacctggtgaatttctgtgttaacatgtctgatttgaacccttctgatattcctgagataaactttatgtgaccttggtattctgttggattttggttagctgatacttcaagatttttataaaactgggttgcaatttatttgtgttcccgtttctagctgtctatgagcttcatcaaatgggcaggaccactttcccttaacttctccttttctggaacaacggacatatcctgtggattatctgttccccacaggtttgggatatgggtgctgtgaatgccactgtgctgggggctttgggaagtgtgtgtttgttttcgtgcgtgtgcggtgggatacaggtgtggttactactttgatttctttctttcttttttttttttttttttttgagatggagtctcactctgttgcccaggctgaagtgcaatggcgcgatcatgactcactgcaacctccgcctcctgggttcaagcgactctcctgcctcagcctccagagttgctgggattacaggcacccacaaccataccctaaattttgtacttttagtaaagatggggtttcaccatttggccaggcttgtcttgaactcccaattaccaatttcttatgtgtccttttgaagactttctaagtacgaccaacctagtaaagtgagtcacccaccactgttttgtttgtttttgtttgtttgtttgttttttagaatggggtttcaccttgttgcccaggctagtcttgaactcttgggctccagcaatctaccctcctcagcttcccaaagtgctgggattataggcatgagccaccatgcctggccccaccactcattcttaacctcttcttctttgcctttctctgttgcagagtcctggaagttaaatgctctatttcccagcctcccttgcagctaggagcagtcatgtgactccattctggccaacgagatacaagaaacacttgctgacaggtgcaatcagaaagcgtttgcttttccagtaacatgtaggaccagtcacctttttgcatttcccctttcttcttgattcgaacattgcattgccgtcatgtttggagatgagtcagccatcttgcaaataggaggcagcaagactgagggaaatgccatcctgcttcagagggcagaatggaaagagaagcctaagatggcaatggtacggttgggcagctgagtcaggactggggccactgcctctcggtttcaagggagaaaaataaacccctgtttgttggcctcatgctaggttggattttcttttacttaaagccaagacatttctaacatacaaaaccagacacatgtgcatgccacacgtacatcacaagtgatcacatgctgtccgactagcacctcgatttttccactgaaccatcagtcttgcagatcatcctttatcagtgcctggcaacttgtcttgcccttgttttcttgggtttttgtttttgtttttgtttaagacaaggtctcatctgttgcccaggctggagtgcattggcacaatcatagctcactacagcctggaccttctgggctcagcagtcctccgtcctcagcctcccgagtagctggtactaaaggcatgtgccaccatgcccggctaattttcacatgttcttttagagactgggtcttgctttgttgcccaggctggtcttgaactcctggactcaagcagtccccctgcctaggcctcccaaactgctgacactacaggcatgagccactccacccagcctcgtttttgttaatggcagtataccaccactctggatgtgtaatatgatttatttaaccagcctcatcgaccttttgagttgtttccaaactctttgctattgaggtaggaaacagaactcaactctggaggtagggctcagacactggaccaaattgaggactacctaagcaggtccagggcagaggcacctccctataagacacacccaccagtgtgccatgtcagtttaccactaccatggcaacatctagaagttatggcatctttccatggcaatgacctggcaacccagaagttaccaccctcaccctagaaatgtctgcataaactaccccttaatttgcatgtaattaaaagtgggtataaatctgagtgcagagctgcctctgagcgctgctctgggcatactgcctgtgggtggccctgctccacaagggacagttcctgtgttgctgccatgcatggctgctctgctatgcacagcagcttgcctctgaattcttccctgggtgaagccaggaaccctcctgggctaagccccgatttgggggtgtgcctgccctgcaccactgttatggacaatgctacaatgaataaccttgcacatacctcacttcacacacgagaacatatccataggataagttcctcgcagtgaagattgttgtcttatgatgttcaaccactggatctgagaacacgatatgcctttcattctctcaggtctcctttcatgtccctcagtggatttaaagtgttcttctttttgattgtacatgtttctttttaggtttattcctaggttttatttttttttttttggtgctgtggtaaatgagatattttttctcatcaatattcctgctcacaagtcattttttatgtagatgaaggctaattatcatgttactttcgtcccagccacaaaactttttttttttttttttagatggagtctcgctctgtcacccaggccggagtgcagtggtgtgatcttggctcactgcaagctctgcctccagagttcacaccattctcctgcctcagcctcctgagtagctgggactacaggcacctgccaccaggcccggctaattgtttttgtattttcagtagagatggggtttcactgtgttagccaagatggtcttgatctcctgacctcgtgatccgcccacctcggcctcccaaagtgctggaattacaggtgtgagccaccgtgcccggcctccagccacaaaacttaaatattgtttgtcatagaaattaaattgattctcttggattttccaaggacttaatcatgtcatctgcaaaaagtgatattgtatttcctcctttgcattttttaaacttaatttctttctctcttccaattgcaaaaaaattaaataacagtgatgatagaagacaccttcctgagctttcaccttgacagagatgcttctagtatcttccccatttgacacaggagtagctttgaggctgacataaatgaatggcagcacattgagaaagtattactgagaatgcaagttgattctgggcacgacgagtaatgagatttatacttagcctcctgccataaacaacgataaagttgggccaaatgtataaggcagttatgtacaggaattggacaactggtaggactgtgatagctgagagaagggaaatacctgaagtgagtccaagtttgccctgtctttttaccttgggttttcctaccaaggtatgagagataaagccgcagcagagatcatcagccagcgatcactggctgggaaagcagagatcagtgctgaggtggctacgattggtagagcagggcactggaggggagggtgctacgtagaatgagggtgcagaggctgcatgggggtccctcaggtccctggatgaggccaggctgtacatgtgcaaggtgatccttcacaaggcctagcgggaagctgctgctgtggggctgggagctgacagacaagcccagcagtgtgcagtgctaggcgacattgcagttcttgcccagctagggtggagaaacctcaccaagcccctcaggcaatcagttgagaaatcagaaaggccatggcttaagaataagaatcgcactccagaataatggccaaagcacagaactaagaacacaaccaaaacagactcacccttacaaagcataaaatcaagcctgcagtgatatcagcaaaatgatggaattggaagctctggactctccttttcaaaaccatgaacacatcaactcaacaacaattcctgaaaattccctttgcaagaaatccagaaactagctgagcatctcacgcattccaggtaagcatgaatctactcacattgaaactggcagggaaattcaagacaccctcttggcataatccctacccccagcacagtgccatatgactgagaggaaatcccctagctcccagcttaccatggagtgagaaagagatgagctgtgtattcaacacctcaacttttctgagggctacctagggggctgacttctgtgttgcctgtctcagagtgcggatgggacgtagcataaccccactgcctcagggccatggaaagagacctggtgggatgatctaaagtgcaactagtcaccacagtccaactcagcacagagtgaacaggaaaaacaacaaaaacacaccttagattcaggcttctccctagggaagaaaagagttggacagaacacccaacaatccagttttctggaggctacctgaggaacttctttcagtcacttgtctaaaatgctgacaggacttggcatactccagacacccgggggctccagaaaacagagaaagtgggttgggccagcaggaagtttagagaggcccccagaatctttggcttggctgattggtgagggtctcctcctgtacctggccagttcgtgaaaacttgacagaggcctgctttgttgaatgttcagacagcaacagagaaaggcaagaaaatgaagaaacagggaacaatgtttcaaacaaaggaataagataaatctccagaaactgaccctagtgatatggagttatatgatttatcagacagagaattttaaataactatcataaaattgctcactgaagacaggaaaacaatgtatgaacaatgggagaatttcaacaaagagacagaaaatgctaaaaagtaccaaacagaaatcatggagctgaagaatatgataactgcactgaaaaagtcactagatgaggggaacagtagactggatcaagcagaaaaaaggatcagtgaactcaaagaaaggtcattggaaattaatcataggagcaaacggaaaaaaagaaaaagagtaaagaaagtagaagggacttatgggacaccatcaatcagaccaatagatgcattaagggagtcccagaaagataagggaaagaatcattatattcaaagaaataacggttgaaaactcctcagatctgtggaagaaaatggacacccagattcaagaagcccaaaagatcccaaataagatgaactcaaagacatttacagcaagggacattaaaatcaagttgtcaaagacaaagaattagaaagcagcagggaaaagtgacttgtcacatttaaaagaatctccataagaaataagctaatttttcagaaatcttgcaaaccagagggaatgggatgacatactcaaagtgctgacatttttaaaactaccaagcaagaatactgtgcctgggaaaaaactgtctttcagaaatgaagatgagcgacatactttccagacaaacaaaagctgacactgttcttcactatgaacttgccttgtaagaaataatgaagggagttatttcactggaaatgaaaggacaataaacagcaacatgatagcataagaaaacataaaactctttttatttatttgttttttgtttttggttttttttgagatggagtttcgctcttgtcgcccaggctagagtacaatgacaccatctcagctcactacaacctccacctcccaggttcaagcaattctcctgcctcagcctcccaagtagctgggattacaggcatgcgccaccacacccggctaatttttgtatttttagtagagacggggtttcaccatgttggccaggctggtcgtgaacttctgacctcaggtaatccgcccttctcggcctctcaaagtgctgggattacagatatgagccaccgtgcccagccacataaaactctttgacaagggtaactatatacacaaatacagaatactgtattactgtcatggtggtgggtaaatcacttttagttctaacataaaagttaaattacagaattattgaagataactacagctaaaaatattttaatgggtgcacaatataagtcgatgttaattgtgacatcagtaacataaagtaggaggaatggtaaaagtgtagaatttacttatgtgattgaagttaagttgttatcagcttaaaacacactattttaattataagatattttatgtaagcgctatggtaaacacaaagaaaatacctatagaagttacaaaaaagaaaaggagaaaggaatcaaagcatagcaacacaaaaatatcaacaaacccaaaaaagaaaacacgagaagagggataaggcacaggaaaacaggaaaagaagacagaaacaaaaacaggaagtcaaacgctacctgattccgcttatgtgaggtatctgaaagagtcaaactcataaagtcagggaatagaatgttgtttgcctgccaggagctgggaggagggggaaatggggagtttctaatcaatgggcataaagtatcaattacgcaagacgaataagttctagagatctcctatacaacatcgtccccatagttaacattactgcagtgtactaccctacagaggagtgcagatcccatgtgaagtgttcttatcacataaaaataaaagcttgagataaggaaaaccgaggacatctacaagcatattcattgcagaaaaccgaaggctcagagaagactaaagtcatttgctgtggttgtaaaatatttccttctagtcctttctatgcttacatagccattgtcaaatttttacaaataagggatggtatcagagatattattttataatgtataattttgctcaatttacaattaagaataaacatttttctttttgagacagggtctccctgttttccaggctgaagtacagtggtacaatcatagttcactttaacctcctgggttcaaacaatcctcccacttcagcctctcaagtagctgggattacagacacgcgacaccatgcccagctaatttatttttattttttaattattttgtttgaaaagacagggtctcacgatgttgcagaaacttgtctccaatttcggggctcaagcaatcctctcgccttggcctcccaaagtgttgagattacaggcatgagccatatgaatgttttgataacattattttctattatcacaaaacaaccagccaggtgctgtggtgggtacttgtagttccagctatccaggaggctgagatgggaggatcacttgagcctaggagtttgaggctgcagtgagccatgatcacaccactgcattcaagcctaggcaacagagtgagaccccgtctcaaaacaaaataaaaataaatttaaaaacaagcagaagccgagcttgatatgttcaagatgattttccagtacaatagaagtaaacagaaatagatctccaggtgaacagatgttggaattagcagaccttaactttaaaagatctattgtaaatctgtccaaagattaaaggagcaaatgaggaaaatgaatagacaaacatgaaatctccatggtgaaatcaaaactataaggccaggcatggtggctcacactgtaaccccaccgttttgggaagctgaggtgggaggattgccttaggccaagagttcaagaccagcctgggcaatatagcaaaaccccatctgcacacacacatacacacacgcacacacacagagtcaggaatggtggcacaatcctgtagtcttagttacttgggagactgaagcaggactatgacttgaacccaggagttcgaggctgcagtgagctatgatcaccactgcactccagcccgggtgacagagcaagaccctgtctccagaaaagagagaaagagagagagaagggtcaggcatggtggctaatgcctataatgccagagcattatcaaggtgataaagaaattgtggtagagccctaccatgaaatactacgtggcaaaaacaaaaatgaatgactgatgtatgccacaacatgaatgaacctcaaaaactttagattgaataaaaaatgccaaacacaaaaaacatgtgtacttaatatttctattcaaatgaagaataaatgaattcatttgactataatcatgaattcacaggcaaaatgaatctgtgttgagagaaatcagaagagtgattacttatggggttaggaataatcttcaagaggcaaagtgactttttggggtgatggaaatggcttatactttggggctattgtctgcagtggtgcatacatttctcaaatctcattgaattgtacacttcagatctgtatattgaaataccatcttccaccaaaaggaattagggatccttgaaggaatggctagttactaggttggttcagggaacatataaggggagcctggaacactgtgtttatcagagagtaagttgtgcttcaagaatgaaggggcctgtgtggtggtgcacacctgtaatcccagatgcttgggaggctgaggtgggaggatcccttgagcccaggacttcgcgaccagcctgggcaacatagctagaccctggttctacaaacagttttgtaaaaatcagctgggactcgctgggcgcagtggctcatgcctgtaatcccagcactttaggaggctgaggagggtggattgcctgagctcaggagttcgagaccagctttggaaacatggtgaaacccgtctctactaaaatataaaaaattagccaggcatgttggcgcacacctgtagtcctagctactcgggaggctgaggcaggagaattacttgaaccagggaggtggaggttgcagtgagccgagatcacgccactgcactccatcctgggtggcagagccagactctgtctcaaaaaaaaaaaaaaaaaacagaaaattagccgggactggtagcaagcacctatagtctcagctacctgggaggctgaggtgggagggtcccgtgaacccaggagctgcagctgcagtgagccgtgatcacgccactgtacaccagcctgggtgactgagcaagactctgtctcaaacaaacaaacaaacaaaaaaacaaaggaaggcggcatgtcaaaaagacacagaagctagcttaaaggcactcccagtggccaaatctgggatgatttgagctataaaataaatactgaaagttacaattagaatgcattgaataaataagaattcatgaatccacactgataggtattaattatatgacttatgaggactaggatatttgcatagtctcaatataccttctcacaaaattctcagtaattacagagggagagagagcagcttcacattctgagaactgatcaaggtgcagaccgtgtgtaacagggcaaagtgaaatgtgtgttcacctgatggggtgccctgggaacacagcctgtcttctgagatgttcctaacaacaatgtacatcctgaatctaacaatgaggaaacctcaggcagatccagactgagaaacatcctacaaaataactggcgtgtgatttttcccatgtgtcaaggacataaaagtaaaggaaatcctgaagaacaaatccaaatggaaggagactggagagatggggcaaccaaatgcagtgtggagttccaggcgggatcgtgtgaggaaaatgatgaaatctgcagggattttatcaactagaaggcactgctctatcagcgtcagtttcctgactttgtttggtgttttttgtttgtttgtttgtttttgagatggagtgtagctctgttgccaggctggagtacagtggcgcaatctcggctcagtgcaacccccacctcctgggttccagcgattcttctgcctcagcctcccgagtagctgggattacaggcgcccgccaccacgtctggctaaattttgtatttttagtagagacgggatttcaccatgttggccaggatggtctcgatctcctgacctcgtgatctgcccaccttggcctcccaaagtgctgggattacaggcgtgagccactacgcccggccagtttcctgactttgagagttggatttttattatttaggagaatattcttgctctaaccacacactaaagtatctgagggtgatggggcatcgggtcagcaacttactctcaaatggttccagaaactaagttgaaacttttctgtaggtttaggattgttttaaaaatctgtccatttgactgtatgtaaattacctcaacaaaataaaatatgttaaattttataaaatgcctcttcaagtatctaaggagaggttaataatttctgccttctgatttgttaatatggtgaattgtattaaaatattctccattaatgagccatcccggctggccgcagtggttcacgcctgtaatcctggcactttgggaggctgaggcaggtggatcacttgaggtcaggagttagagaccagcctggccaacaaggtgaaacctcgtctctactaaaaaatacaaaaaagtcctggtgcggtggctcgtgcctgtaatcccagcacttttggaggccgaggcgggcagatcacctgaggtcaggggttggagaccagcctggccagcatggtgaaaccctgtctctactaaacatacaaaaattagctgggcatggtggcatgtgcctgtaatcccagctactcaggaggctgtgacaggaaaattgcttgaacccaggaggcagaggttgcagtgagccgagatctcaccactgcattccagcctggggagagagagagagactgtctcaaaaaaaaaaaaaaaaaaaaaagagccattcttaacattgcatgattccatggtagacgtcactcggtttcagagtttggttgtgtgggttttttttgttgttgtttgtttttttaagtgtatgttgttgtttttttctgtcaccccggctgtagtggagtggtgtgatcatagctcactgtaacgtcgaattcctaggctcaagcgctcctcctggctcagcctcccgagtagctaggactataggtgtgcaccaccacgcccaggcaatttttcaaacactgtagagccaggatcttgttacgtttcccaggctggtctcacctggcctcaagcaatccttccgccttgacctcccaacacacggggattacaggcgtgagccattatacctggccccagagtgtaatttttaaaaatgtgctgcttgatcctatttactaatatcttatttagtatttttgcattgtcgttattgcaaacgacaataacattgcagtgattgtcattacggcctgtaattttacattattgtgctacattttggagttttgttatcaatattattattatttttttgttttgtttttttttttttagtaaaggacatatcatatttattcatacacatgctggaattattggtgcagacatttaaatacattttctttgagaaagtcctttttttttttttttttttatggagtttccctcttgttgcccaggctggagtgcaatggtgcaatctcagctcacaacaacctctgcctcctgggttcaagcaattctcctgcctcagcctcccaagtagctgggattacaggcatgcaccaccacgcccagctatttttttttatttttagtagagacggggtttctccgtgttggtcaggctggtcttgaactcctgatctcaggtgatctgcccgccttggcctgccacagtgctgggattacagtcgtgagccaccacagctggcctgggaaagtccattctttttttttttttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccaggcagaggcgcccctcacctcccggacggggcggctggccgggcggggggccgacccccccacctccctcccggacggggcggctggccgggcagaggggctcctcacttcccagtaggggcggccgggcagaggcgcccctcacctcccagacggggcggctggccgggcggagggctgagccccccacctccctcccggacggggcggctggccaggcggggggctgacccccctacctccctcccggacggggcggctggccgggtgggggggctgacccccccatctccctcccggacggggtggctggccgggctgaggggctcctcacttcccagtaggggcggccgggcagaggcgcccctcacctcccggacggggcggctggccgggcggggggccgacccccccacctccctcccggacggggcggctggccgggcagaggggctcctcacttcccagtaggggcggccgggcagaggcgcccctcacctcccagacggggcggctggccgggcggagggctgagccccccacctccctcccggacggggcggctggccaggcggggggctgacccccctacctccctcccggacggggcggctggccaggcggggggctgacccccccatctccctcccggacggggtggctggccaggctgaggggctcctcacttcccagtaggggcggccgggcagaggcgcccctcacctcccggacggggcggctggccgggcggggggccgacccccccacctccctcccggatggcacggctggccgggcgggggggctgaccccccccccccccacctccctcccggacggggtggctgccgggcggagacgctcctcacttcccagatggggtggctgccgggcggagaggctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcagccgggcagaggctgcaatctcggcactttgggaggccaaggcaggcggctgctccttgccctcgggccccgcggggcccgtccgctcctccagccgctgcctcccgggcggcgctcgccggcgcggcggcaaagactgagacagctccgctgcccgctgaactccatcctcccggcggtcgggcggcggcggctgcggtcggtcgcggcagcggctccgcttcatatctgcagctggggcccgcgggcgtcagcgccgcgactgtcctggctccgcactgccccgggccgcagcgcagccgcgccaaccaccagccgcggccaccatggccggacgggctccctaagccaccgaccccagcccgcggcgccttcgacccttctggggcctccggcgccgcgacttcctctgcctgaaatttcttttttcttttccttttattttattttattttttgagacggagtcttgctctgttgtctgggtggagtgcagtggtgcaatctcggctcactgcaacctctgcctcccaggttgaagcgattttcctgcctcagcctcagcctcctgagtagctgggactacaggtgtgcaccaccacgcccagctatcaatattattttttaaatatgttatttttattaatagatttcttttcttttctttttttttttaagacaaaatctaggccaggcgtggtggctcacgcctgtaatcctagtactttgggaggccaaggcgggtggattgcctaagctcaggagttcgagaccagcctgggcaacatggtgaaaccctgtctctactaaaatacaaaagaaattagctgggcatgacagcatgcacctgtagtcccagctacttgggaggatgaggcaggagaattgcttgaacccaggaggtggaggttgcagtgagccaagattgcgccactgcactcagcctgggcgacagagtgagctgtttcaaaaaaaaaatttgttttaacatttttaaaaattaaaaatggggttgagtgcggtggctcactgagcctgtaatcccagcactttgggaggccgaggcgggtggatcatctgaggtcaggagtttgagaccagcctggccaacatggtgaaaccctgtctctactaaaaatacaaaaaagtgggggccaggcacggtggctcacacctgtaatcccagcactttgggaggccgaggcgggcagatcacgaggtcaggagatcgagaccatcttggctaacacggtgaaaccctgtctcttaaaaatacaaaaaattatccgggcgcggtggcgggcgcctgtagtcccagctactcgggaggctgaggcaggagaatggcgtgaacccgggaggcggagcttgcagtgagccaagatcgcaccactgcactccagcctgggcgacagagcgagactccgtctcaaaaaataaataaatacaaaaaagtagccaggcgtggtggtgggtgcctgtagtcccagcttcttgggaggctgaggcaggagaatcgcctgaacccgggaggcggagcttgcagggagctaagaccacgccattatactctagcctgggcaacaagagcgaaattccatctcgaaaaataaataaataaaaataaaaatacaaaaactagtctgtaatctcagctgcttgggaggctgaagcaggagaattgtttgaacccgggaggcggaggttgcagtgagccaagatcacaccactgcactccagcctggattatagagcaagactctgtctcaaaaaataataataaataaaaggttcacattttaaaaatggtctgcatcacttcgtgtgcttagatttttaaatctcttcagagatctgctataatattattataatcattcattataatattttctgtaagaataatgtcgtaaccaaggcctgatttatttgcttggtgttcatcaaaatgtgctcttgtaatgtaaacaatctttttgatatctgggattattttcttcttgttgtatatttcaactttctcttcttttttttaaaaaaataagcgtgactctcaggggatgtctgcacgggaacccatgtctctgctgccccacaaacacagcaagagccgcgagcacgcgaatgcatggccaagttgggaggtcagaaggagggatgggaccaaaggagggagtgtgtgtttttttttgtttgttttggtttttttgagacggagtctcgctctgtcgcccaggctggagggcagtggtgcgatcttggctcactgcaagctccgcctcccgggttcacgccattctcctgcctcagcctcccgagtagctgggactacaggtgcccactgccacgcctggctaatttttgtgtttttagtagagacggagtttcaccatgttggccaggatggtctccatctcctgacctcgtgatctgcctgcctaggcctaccaaagtgctgggattacaggcatgagccaacacgcccggccagggagtgtgtttaagaagtcacgtggcacacggggtggaagcagaggtagatggtccgcctgggtgctgaaggccctttcagaacacaaagagaaattaggagaatgggcagtgcaggtttttgggaaaagagctggtttttgttgaaaaagcagaggaaaccccagacattgcatgggtttaggccttagcctcaccactgtcgagagcctcctgcccaggagggccaaattctaacctccaatctgcttggtgaggaccttaagatcctttccaccctggcaagccacctgccagggtgagctgagaaatcagccaggggagcagagtcacttatggccaagaggaattgttctggggtttggttagtaagcaggagaaagaggagaagaaaactgcgtatgggggttgaatgcctctagcagaagaaggtgaggcatagaggcctcttaccactagggaacatattggagtcacgcagcaaagtatgttaacagcagaagttacccaagtcacagagcaccaacatatgctattggtggcaggaatccgagctaccggtggtgagtctgtaggggtctgcagcaacctcaattcttgcctcctcagaagaaagaatttgactgtggggcacaaggcagaaggagagaccgaggccagtttcagagcagaggcaaaggttcattaaaaagttttagagcaggaaggaaaggaaggaaagtgcacttggaagagggccaggcgggcgacgtggagggcaagtgcctcttttctctccttgattgggttttctcattgcttttctattttattttgatttcatccccaaataattagctcctagacttacttatttgttctaaccaacctgagtccgttcatttttgcttctgtctttacgatctgaccctttgggatgtggtcgcccatcatccccatggcaggcagggagccgttttgacagcagcatctccctctctcactcccacctgtggaggacagcctcgggactggcccaaatgccagcatttgctctcctgcctatttcccaggccgtggtgaggggcttttcctcagggtcttcatggggagagtcaggggatgagtgcctctctcctcactttgcactccttcctctatgtcatgccaaggcacttcagcggctcagcctccaatgatggaggtgactctggagctcaggcttcaatcaaccaacgaagaaaaatgttagagacacttccagctttttctttttttttttttttttttgagatggagtcttgctctgtcgcccaggctggagtgcagtggcgcaatctccactcactgcaagctccacctcccgggttcacaccattctcctggctcagcctcctgtgtagctggggctacaggtgcccgccaccatgcccggctaattttttgtatatttagtagagacagggtttcactgtgttagccacgatggtctcaatctcctgacctcgtgatccgcctacctcggactcccaaagtgctgggattacaggcatgagcccccacgcccggccacttccagcttcttgaactaaaaatattgaattcagaatctcttgtaaatgcacacagctcaacagactctaatctttaagtttgtgcttccctcccaggtctagtgtttgcagaagccacccacccccacacacacacccccagtcttctaacaatataaatgacaaatcttgcaaaccttttgatgtgtaagccttcttttcccaaattaggtttgtgctgatacccctgggacatgccgggatctgattgtaattgcaggtttggaagtggtgaggttggtagtggtggagtgggatggaaatcagcacctgcttgcaaagtaaccacatcaggtgaggtcacagagaggtcttcaaacaatgcaggaccagacccatcaaacaggggctacttctcttggtgtgattgtcagggtatgcagctcatcgcccccctcctgattctggggtccaacaccttcccagtccatgccctgattctcacagaagagacctgagggagggtgaaagtccggtctacattggcattcagcaaacctcccaataatgccctgaggctgacctgagggcacaccagactcaacagccttaagagagaagagattctttcagtgatgatggaaaccttgttctctgaccaggccttgagctcagcatttgaaaagcccaactgtgtcatcttgtttcctgagactctccagtgcagctcagagcagccacctcagcccacaggcctgtgcccctcctgcccgctgtactgtgctgccatcaccagacccacactgcacaggagcttcactctaggtgagcacaggtggttacttaattaactgtctcaccaggtgccacggactccaaatatcccttcatcctcatggcccccaaacccaaccaggtcatagaaaccatccagaatctcacccaccaaggtctgttatctgcagtcacttctggtgtcaaatactgtaggagtcaggattcagctgtggataacaaaaacttatcctggctactttgggtagaaagggattgaatcaaggcagaatggagagaattaagggcactgtgacagcaggaagagcagggtttcagctgggcctcagccacggctctcacagtggtactccagaattgtcctgctgtggtagattagaaatggccacagatcctttgcagctcctgcagtcaagaagtagatccatttcgccgcctcccccgaccccctcattagggactgacttgtgactagctttgaccaaagaaggtattgaaagtaaagctctggagctcctgctctggtgctcttggagagctgggacaatgtgaacaagtattggtgaggctaagaaactgggtaagtgttgaagcaccccagccccaaaccaatcaactgataaacctgtgtgtgatgccaataagaaccagctagatcccagctgacccaccgactaactacagaaccaacagctgagcacagatgcaagcgtgaacccagccaagcccagcagaaccatcctgctgagcccagcccaaattgtcaacccacagaaccatgacctgaatgcatggtcattgagctttgggatgattcattacacagcaaaaagatatccaatgcgcctctccaggaagcttccattcctgccacaatccagaaactggggaaaccataagatgcccctatgtttggctccaggaccatattcccctaggcaagacaaataacagcaaaatgaatatcctatgacatgaggtctaggggtgagactctgaggcttctgttactgccgcctcagaaatgctgaccatctccctgtctgggcttgctagtggaaaacgagggaagcaacaatgacagattctacctcatttttcccatccaactgtcaccagagggtgtctgttggaggggcacactccatggagcccatggcagctgcttatctaatccacagcctcaacccagccctgtcagtactgaaccagattttcatttccaccagtttgactcatgggcctcacttggtctgaatttggtgtgtgtatgtgtggggggagggatgggctatcattcgtggtcctcctcaacaaccccaccacaaaagcacagaagccacaaagaaagactgacagacctgactacacaaaaattccaaacttctgatcagttaagagaaccacagtgaacaaactgagggacgcttcttgcaacacacatcccaaaacgatggacagattcaaccataagcatttaagacttttactcagcaaagactccaccaggaactctgaatttgcaaaaaaaatatatatacatttgcaatatacatgatggaagaaatgacagatttatccatgtaaaaattaaaaatatctcatggcaaaagacattatagacaaacatagccagtgcaacctgttctaccagcttggggtacaaataaggtcacatatttttgttcttcataggagccccacccactcccagtgctggaaagggaactctattccctctctgggtgagctcacacagagcacagcctctgtgcagagcagcgccactgcccccaccgacatcttcagacgtgttcgctcttgacacggtacacccacagtgatagagccatccctcaaaaaaacctgcacacaggcggctccacagcaacagcttgaaatgtccgtcactggggcaccgggagaatgttctgtgcacaggtgcttcctgacaacggaatccttgctgtggttgggaagactggagtggacccctaggccccaggcaaaaggctggtttctcctgcccaagacgcctgaacaggcagggccgagagctctgtttataaccccaagcgccagaagtgctgattttctaaaataagggtaaaatgcatagccaagttgggaggtcagaaggagggatggggccaaatgcagatgagccgatgtggaaccgcaggggcagggctgtcggacccagctgcgtctgggaggtactgggctctggggacacagccaggccacaggctctgcccagacagggactggaactgggctctgcacaaggctgggcctgtgagggtctgtcccgcaggaagggggacaagagagggcagaggcgcccagcaggggcacccttccagagttggcatagcatccttgagaatcctgtctgctctggggaggctcatgtgcttcttgtccatgtatgtgctcacaggacatttggagaccaaattcatgccaaggagagaggtgcgggcctgggacctctcccccttgtgtgcaggtgggagcttcatgctgagtgacccggaaaggggtcaggatgctctgtcagctctgtggccatggccatccatgtagcccttttatgcatttcttacctgcaaaatgggaatcataagagtatcaccagcaaaacacctgtggtgctgcgggttaagtgaattatttttgcaaagttttcagagcaagatctggcatagagtgaacactgtgaagcatttgttaaaggaatgaagaaatatgacgtggttagctagtctctgaggccgagctctggagtaaaattcctttccccattcagaggaaaggatccacccactaagaggtgggaacatctacaaggcatagaggtgcagggatgagctacacaggacaaaaccgttccagtatcccattcactaagccctctcattctttctcagctacaccagaggtgtgctggcgtcttgacctcagtcagtgagggccactgagtgcatgtctcggctgtctaaccaagcaaaccagtgacccctcctcactggtgagcaatcacccacaggccagcagctccaataaggaaatacacatggataagcgtgaccggatccacccttggaagctgctatggactgaatatttgaatccccccaaatgcatatgttgaagtcttcacctccaaggtgatagccttaggaggtgagttggggaggtgaatacatcataagggcacagccttcatgagtgggtttagtgccttttaaaagaggccctaggaagctgttcacccttggccacgtgaggacagagtgagaaggcactgtctatgaagaacaagccctcaacagacacggaatctgccagcattttgatctcagactttcagcctccaaaactgtgaacaataaatatctgttgtttataaaccatttagtctatggtagcctcttaaagcagaccaaacagacgaagagagaagccatccccacactcaacccaagagtttctacccatatgaattttggggtgtcaaccatctctcattgggtttagactttatatgtgtccccatggggcatgctgggctctgccttgagttacgaatctagaggcaaaaagggatgctgaggctgttgtgagaagggagaatcccccagcaaacaactgccttgggggaggtgattacagggcaggcatgaagttagggggtgcattctgcaagactgcccttacttctgacacccactgtaggtttggagggttcccaagatcactctgtggttcaacaatttaccagaagggcccacagaactcactgaaagctgttatactcgtgtttatggttgattacagcaaaaagatacggattaaaagcagccaaaggaagagacactggggtcaggggccagcagacaccatgtgcaagcttctaggtgtcctctccctacagagctgtagatggtgtgacttcttggtattgatgtgtgacagtctgcatggagtatggccaagcagggaagctcacttgagcctcagtgtccaaagtctttattggactccatggttgattgcctttgtggccaacctcagtctctggtccctctggacattaggcaatcccatgtgacctgagactcccaccataaatcacattgtaagcgtagactctctggtgtggcccaaaacctccacagaaacaaagaccctcttattaggctggacatcctaaggacctggagattagcacccaggagctgaaggcaaagaccggacttcctgttgggcaaggttaaaaatctgtaccactcacctgtcaagcaaaggaaggccagtctacaaaggaaggccagtgtagacacagtctacacaggggaggagaggctactttgctagccagggagtctggagggcggttggaagttcaagttcatcagactcattccaacccaggtaatattctcattctgattctcaggaccctattcttctccagatgatgcaaactttcacatacatgacctggtgaggctctagattcagctttccttggacttctgcaacctccaaggccaatttggggtgactttcaactaagtcagtgctgaggctacacgaggtaagtggttagggccacgatagatgctccatttttggtcatttgtaaatgaagacgtttggcaataggattggcactgactttcattaagttccccagtgcaggcatcagcagctgcccaatcctcattcctcatagtcatcattcacacctgtgctaaaaaggtgagagcaatggccacatttcttcaccatccccggatccacactctgtaccacgtggccttgcaatgcttcctaccaacaggggtagtctctttccccatgtcttgtatctggtgcgtggaccccagaactgtgtccacagagtgtgttagacacgtcacgtaacagtcccaggactggatctcaagaccccttgagcaagtgcagtcctgtccactgaaaattacaaaatgttgttgaaagaagatctaaatggagagacatcccatgttcatggattgggcaactcaacacggttaagatagcgataattcccacattcatctacagattgattgtggtccttaccaaaattccagctggctttattttgttttgttttgtttgctttcctagaaattggcatgccaataaagtaccccaaatagccaatataatctttaaaaaaggtcaaagctggaagactcacacgtcctaatttcaaaacttactacaaagccacagtaatcaagacaatgtggtactagaaatatgatagacatacagataaacggaaaagaactgaaaatccataagtaatcttttacatttatggtcaatcgatttttcaacaaggagccagcccagagaatgcaagaaaacactcaaatcttatatattccctaaaggacttatattaacaatatgtgttgcctgtatcatacaactaagtaagaagacaaacatcccaatttaaaatggctgaaagatttgaagagctatttctccaaaggacatattcagatgctttcagaaatgcttggcaacattagttaatagagaaatgcaaattataaccacaagataccactaggcacaccctggggtgcctgtaatcagaaagacggataagagttggagaggctgtggagaagctggaaccctcgcgcattggtaacaggaatggaaaatggtgcagcaactgctttggagacagtttggcaggttcttggattgttaaacatagagtcaccatatggcccagcaatcccactcctaggtatccacccaagagaaatggaaacatatctgcacatagaaacttgtacatgaatatttatagcagctttattcatagtagcctccaaactggaaataacccaagtgtctatccactggtgaatggagaaacagtgtggtctattcatgcagtgggatatgatatggcaataaaaaggaacaaagttctgatacatggaataacatcacattatgctgagtggaagccatcagacacaaaagaccacagatcttgtgatcccactgatacaaaatgtctggaaaaggcaaatctacagagacaggaaatgaatggaatggttcagtccccggggaccatgggtgggaacagggagtgactgcaagggtgtgcagcctccttttggggtgacggaggtgttctaagcttagcgtcgttaccattgcatgactctccatttgtgaaaagtaattgaattgtatgccagaaatgagtgcattttatcagacgggatcaggcgcgttcagggtggtatggccgtagataagagtgtattttatggtatgtgaaatatatgttaataaagctggaaagaaagacaggaaggaaagagagaaagaagaagacagggcagcggtgatcactcctccctctgttcctgccgtgctgctatgggaacgagcccaggctagagtgctggaggatgagaggcattgtggcccggtcactcccattgccccagctgaccttcagccacccccagaggtgatagtgagaccaccctaaactagtcaaccctcaactgacctgccaggtggccacaggctcataagcaagctcagcaaagaccaggtccagatcagcagaaccccagctgagccagagcctttcaagcaacagtaagtgcccacttaatgtcttcagccacggaggtgcacggctgtgacacagctctggctaactgatgtgccaccccaacagcctatcgcagcatttcattgcagacaacgccaggtggtaatttgggtgaatgttcgcaggggtgatacaggccatcgcattccattttccatcagaatgaggccatcaccacgttcgagcccagtcttgtgaaccaaccccagattatcatagagtcggactccgtttttgctctttgactgctgacaactttcaggtaagcccctccccagcaaccttttgccctgcgtctgagcaagccaataagaaatcctgtgttgtctctcccttggcaggaagttcaaaccgctcaagctccagccccggccccggccccaataaatatcaaagcaatgcacgccctctttgctcagccattcgggactgcttgtgcctgccctgcctcctcagaaagctcattatctgagcaacacaacttcccatacactctgagggtgtgagccttcttcagtctcaacatctggacccctgggtgaagcaactgcagaatgcaggtcgggattctccacagagcacagatcagagtccttctcttggatgcactcctgatgctcagtgtggatcagctcgggtgcagacaggaaacagaaaccactctgcgtgtttctaacagaaagggtttaatacagagaatctgtacagaatacaaggggataggggtgttgctcaaagaccctgacccatgggaagtagctacgacgcctgtaggaacctgagctagacatcccacctgctgcacagccacgaccagggatgggctttgggtggcctccaccctgcaaatcctccatcatctgagcctgagctcctctgctacgacgtcactttgagacagctgctgctgctgccaaggtcaaaagcagagtggtccttcctagcccctgcattctaaccccacataagtgcctccaagtacagaaccccatggaaatccatctggcagtgggtctggggaatgtagttttcagacttctagccccagtggtatggaggagagtgagaagagctggtaagggctgagtagccagaaacaacacctgctataaatcctacagccacacaggcagaaaaatcaagttaccacaaggagtgaaacaacactgaccacaagcttctccacagcaatatgcaaggctgaaggacagcagtgattgaagcattttatacctgtcttttcaaacatgtcagaatccaggtattagggcacctatgagttcttatttctcacacacacagttggaaactgggcacggtggtgcacacctgtggtcccaactactcaggaggccgaggcaggaggatcacttgagcccaggagttcgtggctgcagtgagccatgatcatgccactgcactccagcctgggtgacagagaaagaccccatctctaaaacaaacaaacaaacaaacaaacaaacccacttggtattgaaatgtaacagcaaaattgaagtgaagcccgtgtaggaaatcctggattgcccaacaaacagtatcctacacacacccttaggcacaagcaaaacagggacaagaaaagggattttttttttttgagacaaagttttgctcttgttgcccaggctggagcacaatggcacaatctcagcccactgcaacctccgcctcatgggttcaagcgattctcctgcctcagccttgcgagtagctgggattacaggcaacccccaccatgcccagctaatttttgtatttttagtagagacagggtttcactatgttgaccaggctggtcttgaacttctgacctcaggtgatccacctgccttggcctcccaaagtgctgggattacaggtgtgagccgccatgcccagccgaaaagggaacttttatgaaaagtaatttgacgttgatattcatccattcgtgcatgcagtatctgctgggtgtctgcaacataccaggtcacacctggggacaggacaggggaaatccagtctgtctctgccctactggaccttgggttctgggggcagacagacaataaacagctccagcaatgagaggcaccgtggggctgtgaatcacagagacactcccgcgaccagggaggggtgctgggcaacaggcagaggctttcagacgcgagggagcaggcaagtgcactcacctggaggccgcccaaggagccagcaggagccagggcagggtggaggtcggggagctggaccgtggggtgacctttgaggacttgggctttttctctgaataaggtggaaagccactggaaggttctgctatttccagaggagaggaagaaggatgaggaaggtgaggtctccctgcccctctagctgctcaggttaggatgcacttggtcaggaaaggccgctgtaaggagggcccctctgtttcccatgcttgggccctgaggggctgctcggccagggaaccgcgtgcggagaaaattgacactgagcatcagctgcacttcaataatttggttgaactgcacggaattgctgacaggtggctgttttgacgaaaaagaggcaatttcataccattcaatcaagcaggatgaaaggccgcccagctgcggaggttaggtgggtgagcagaatgcgatggactgggccctggccagcaaggactgacaggagggcgagaaccaggtgggggaagtcgcctcctcgtccctcactatggagttgcttgactctgtccaaagtccattagttcaatgcctgcagccatttgtatttagacaacggcacaaaaagtgtcctttaacatgacactccatgctataggacaggaactcacacagaaccctctttccatttgttgacactcagataaatcgcccacaggatgcctggaaaagccgtgaggatgacgctcgtagtgcagagccaggtgcaggaccgggagctgtttcacagacagccccatggctctgccccaaatcccacagcctgcctagcgggatggggaagacaggaatgcccgtactgtagtagaagtcagcagctctttttggaagtagtttggcagcgcttattcaaaatgcttcattgtcctgcaacccggcaatttcatgtctaggaaacagcaggttggcttggatgactcaggcaacacctccatcattagcagagctcgtgtcagttttctaaaagacagaagccagaacaagtaagggaatttagcaaggttgtgggatataagagcattaaacaaaaatcaaccgcttttttttttttttttttttttttcggagacagatttttgctcttgtcgcccaggctggagtgcaatggaacgatctcagctcactgcaacctccgcctcccaggttcaagagattctcctgcctcagcctcccaagtagctgggattacaggtgcccaccatcatgcccggataatttttgtatttttagtagagacagggtttcaccatgctggccaggctcgtctcgaactcctgacctcaggtaatccgcctgcctcagcctcccaaagtgctgggattataggtgtgagccaccacgcccagataaatcaattgtatttttatttacttgcaagaaacaattggaaattgagaaattttaaaacaccacccacaaaggcatcacctagtatgaaatactaaggataaatttgacaaaagagacgtcaggtgtataaactgaaaactacgaagcatgaactgcacacctaaagatggttaggatggtacatcttatagtatgtgattttaccacaataaaaaattaaatagaataaaaggacagaaaacaaaacaaaaatcccaaaatattaactgtggttgtttctgagtagtgggatgatggatttttcccccttagtttctgtattttgtccttttcaaatcctctctaatgcacaagtgttacttttgcaaaacaaagtagcaaatgtaagaagccacgtgtgctcctttctgcttgcagtataatttcacaaagccctgactcttccacaatgtgtagctctccagaaagatgctttgaagacaaagcaggacagagcgcacggcccccacatctcttgcctgagtcactacattccttcaaagataacatgacccctgccaggagcggtgcctcacacctgtaatcccagtgctttgggatgccaacgtgggatgatcatttgaggccaagggtttgagaccagcctgggcaacatggcaagaccctgtctctattttaaaatttttatttttatttttgagagagtctagctctgtcacccaggctggagtgcagtggcaggatcttggctcactgcaacctctgcagttcaagtgatcttgggttcaagtgattctcctgcctcagtctcctgagtagctgggattacaggcatgccccatcacacccagctaatttttatatttttagtagagatggggtttcaccatactggccaggttgatctcaaactcctgacctcaagtgatccacctgcctcggcctcccaaagtgctgggattacaggcatgagccacagtgcttggccttaaaattttttttaagtagctgggcatggtggtgcatgcctagctgcttgggagtctgaggcaggaggatcacttgagctcaggagtttgaggttacacagtgagctatgatcagacaaccctggagaatcggctctgagtcccctcatggtcaccatgattgttgattaaattaaaaaaaatcaatcactgcgctccagcctggatgacagtgcaagactctgactctaaaaaaaaaaaaaaaaaaattattgcctcttcctacacataagatgaccaacacctgaaggggttcgtgatgatgccgctgtcatctataagcagatgtactctaccaccagacctcgacgggactctgcttcaatgtcactcccgagcatgtttgatgtgctcttgtgcatattaagcccccactctgtacacaagcagtgagctgaaacactgtgttggagcagcctgacagagctgctcccaggctataggcctcaatctgtagtcctcagtaagacttcagaataaaactaactttagttatttgaaagcttgattttttctcctttagtcaacaatcatggtgaccatgagggaactccaagccaactgcccagagttgtccaaaacatcaccaggacccggtgccttggtaccagcatgggccctttgagtccctctgggtccccagtggttaaagaccactgagtgagtctctcctcacacatagctggtggtcttgagatttatttacacatagttgctacgactccttgatgaagggggaagttcttccttgcgacttctgtttcttgagaaggggatttctcctagctgaaacactaggaagaaatgatcacgtgaggtgtctgattggctaggttgtgcccgtgctccccctttccgtttgactctgtaagtaaacctcagcaggacagaagctcttaaaaatctatgagagtttgacctgagtcaactccaaagaccgggaatatttgctccttccagctggattctgatttggcaaccctcggtgattagagggctcgtggaggtgttggaggtgcaatccttgcaatgcacagaggtcccataggaaattccttgtcacaagcaattgacaatcggctcttctgaggccccacaagtttttagataaccagagggagaaagagagacaatgatttaacactgaaatgaccaaaaattggattttcaaacattaaggcatgccaggttttctgggactgcagccagctacatactattgcccattcttgtccacttgtttaaactgatggacaaataacatcaaagaaaattcagagctcaagcaaccaatctgcagctagagttattaacatgtagagtcttctaagttctctctcttttttttttcttttctttctgaatacgttgaatctgctgacttttcttttctttttttttttttttttttgagacagagtctcgctctgttgcccaggctggagtgcagtggcacaatctcggctcactgtaagctccgcctcccaggttcacgccgttctcctgcctcagcctcccgagtagctgggactataggcacccgccaccatgcctggctaatattttctatttttttagtagagacgggatttcactgtgttagccaggttggtctcgatctcctgacctcgtgatccgcccaccttggcctcccaaagtgctggaattacaggcgtgagccaccatgcccagcctgaatctactgacttttctagtgctttccagataaaactcattgtttatggtgttactagttcaagactacctggagattttgtttttcttacagaattcagccagttctaactaaaatgtagacactgaatttttaaccctaaactcatgtaaaactaaaaaaaaaaaaatgtaaaaggggtgttaaaaatcaaactgccatggaaactgctttacccaaaatttgggttcacagccttcattacattactcattaaagcaaataaagtttagccacgtgaacatgtcccaattttgtcagaaatgtaacttggggccaggcgtggtggctcacacctgtaatcccagcactttggaaggccaaggcgggtagatcacttgaggtaaggagttcaagaccagcctgaccaacctagtgaaaccccatcctcactaaagatacaaatattagctgggcgtggtggtgggtacctgtaatcccagctactcgggaggctgaggcacaagattcgcttgaacctgggaggtggaggttgcagtgagccaagattgtgccactgcactccagcctgggcaagaagagcgagagagtctgtctcaaaaaaaaaaaaaaaaaagtgtaacttggatccaaacatcttttataaaccagtgagtttcttattaatgtctcatgactaaaattctaaaatgaaagctgtaagacatttgtgtgtgtgtatgtgtttgatgtgtttacaaatatgtacatttattatatgttgtgtctacgtagtaccaaatgacttataaataaatgagtgctcataaattagtaagcccaaatatttttgaagttcatctgacttaagtaaatctctaagaaataagatgggtttgaaattagtggtaaaataaaagatagaaatgtcttcggaattgtcagcatatgtttttgcctgggttgagtggtcagacaggtttatatgagctaataaatatttaagatgtcagggtttagcatgaaggctataaaactataaacccagccagaaacagaatgatctttatgtaattttttataagaaaaattatttcatattgttggtttaataaaaacagctaaatcttctgagttatcagaaaaatagccatatatatttaactttaatgttcttacttaggtgaacacctaatattcacaggctgtaaaaatggttagcaggaaaataacttataaaatgatgattcactttgtctaatatctcagtttttataattaatctagccaaagaccttatcttgagggtctagaaaagcaatttactaaataagtaaatgtcaatgggataaatgcctataaataaacttttcatgtttgaaatcttaaattaaatgtctccatttccaactaagaaaaattatgttacatgtttctaaaaattataatataagctgtgcatggtggctcatgcctgaaatctcagtactttgggaggctgaggcgggcagatcacctgaggtcaggagttcaagaccagcctggctgacatggcaaaaccccatcactacaaaaatacaaaaattagctgggcatggtggcatacacctgtagtcccagctgtttgggaggctgaggtgggagaatcacttgaacctgggagaaggaggttgcagtgagccgagatcatgccactgcactccagcctgggtgatagagcgagactccatctcaaaaataaaattataatatggttctcatcaataaaattctaatatgtgacagacaattcaagatttctggcttcctaggtttttactaaatttaagtttactaagagttaaaaattctaatttatatatgattctgtatataaatgtgcctaaaatgtgtttttaatttaaaaattatttaaaaggcataaaaatatgttatttattaagaaaaaataatttttgtctaattttcaggtttttaaaaatatgaaacaaaattaaaagaagccagcaagtaggagggagagatgtaaagaagcttacggatatgaagttatatttttggtaagaaaagtttaaaaaagagagagagaataattttgtatgagaaagaatcttgtatggtgaagtttttgtcctaaaggaaaatgactgattataggacaaagcaaaaagtccacacataacttaaatggcctgtgtaaattgtgataaggttcatgaaaagaaaattttataaaaggaattttgtatgtgattaagttagctataattttgaataattatttataacaatctttctaaggtttgagttttgatattaaaaatacactactacaaaactaaaaattggttccctgtattagaacaaagttttcttaaagtcttgatttgctcttagtaaaattataagaggttttgattcttatctgtttcttttcttaaacttctcaaatttacatatcagaagttcaacttttgccatgtgatctgcagccatgtatcattgccttctgttccttttcccttgaaaaggtgtatctttttgtttggctgggattataactctctccttcaatcttttcatcaactcctgttctaactttgctattgtggtctgatgcttaagtgcttatcttcacagtttagaaagcaatgtttcctctagtataactggattctgtgctgttggcttttctttttgtttcctttctttttcagacatggtctcactttgtcaccaggctggagtgcagtggcttgatcacatttggcttttctttttctgtgtgtgtgtgtgtgtgtgtgtgtgtgtgtgtgcagatagggtcttgctatattgatcagattagtttcaaactcctggcctcaagggatcctcctacctcagcttcctaaagtgttagaattacagtgtgagccactgtgcctggttggcttttcttaatatgtctgaattgttcagtgtaaccaggatacttcccacgccgtttctaagagccatgtattcccccgttcaagttactagttttcttgtttacactctcctagaatgtagtgtacactgattaccctggacgcattcttcctgtgtcagattaagtacaaatgccctttcttaatgaggttgatttctaggttacctaaatgggtttcccataaggagaagcaatcacacattacaggaggtttttccttacctttttagtaactggcctaaatcacacacacacacaagattttacattttgtcgtgatgatttctgtgttgtctttattagttttttgattacttagaagaactgagctttgaaagggttaaggcttttacatccatgtaacttttgtattgcctttgaggtcttaattatcactctggttaaacaaataactattatttttcaatgacctgtgattctgttttgatcaagtgctttaaaccttttgacattttttacaggtttctccaggaccaaaatcctgaattaagcctttttgaattacatgattagacttatgtggtaaactgtatgggaaacattgtcaaatggtaagtgatgctagaccttctttcaattacatttatgggtatattattgatatcaatgttccaaaattatgtaaatttaaaaaaccaaatatcagtcataactttgttatattaaaacctgttctaaacctatgtttacatcgatgttattaatgtgagtattttaaagactgcgtaaaatttataaaagccagatagtcctcatgtgacacagtcagtcatgattcttattgttatcttaaaatgctgcaggtaacaaaaataactacatttccttgtactgtgggaacttttatcaaattttaaccatgactaatctaagttttatcgttcaaagttattgttctaaattcttctctacaaacatttacaatcagctctagtccaaaatttcttttcataaaaaagactctaataagtgtgagtacagaaaaaggggaaaaatagtacaattaatataaaaataggccgtctcaaaaaaagaaaagaacacagatcatctcaacatcattaatcattagagaaatgcaaatcgaaaccacagtgagataccacctcccacccaataggatggttgttattaaaacaaaacaaaacaagttaaggctgtggataaattggaacctttgtgcgctgctggtgggaatgtcgtcttggacggaggtatggcagtttctcaaaaaattaaaagcagaatgaccccagaatggatcccacaattttgcttctgggtgtactcccagcaaaaccaaaaggagggtctcaaagggctgcttgcacagtcatgctcatagcagcattaggcacggtagccaggggccatcaacagatgactgaatgagcaaagtgcggtctgtgcatcccaggaactatgcttctgccttaaaaggaaggaaattctgccatatgcaacagcgtggatgaaccttgagaacatgaagtcaagcaaaataagccaggctcagaaagacaaacactgcttgactccactcacacgaggcatccggtcaaactcatagagacaggcagtagaatggtggatgccaggggctgccgggagaagggaatggggagttggtgtttaatggggacagagtttcagatttgccagatgaaaaacttctggagacccagtgtcatcagcaatgtgaatggacttagcgctgtggaattatacacttaaaaatggttaagagaggccgggcgcagtggctcacgcctgtaatcccagcactttgggaggctgaggcgggcggatcataaggtcaggagatcgacaccaccctggctaacacggtgaaaccccgtctctattaaaaatacaaaaaaaaaaaaattagccaggcgtggtggcgggtgcctgtagtcccagctaccagggaggctgaggcaggagaatggcgtgaacccgggaggcggagcttgcagtgagctgagatggggccactgcactccagcctgggcgaaagagcgagactgcatatcaaaaaaaaaaaatggttaagagatatattttatgtgtatttatcacaattgaaatttttttaggccaggtacagtggctcatgcctgtaatcccaacactttgggaggccgaggtaggagaatcacttgaggccaggagtttgagaccagcctgggcaacataggaagacccccatctctacaaaaaattaaaaattagctgggtgtggtggcacacacctgtagtgtcagagagtcgggaggttgaggctggggcaggaggatcctttgagcctaggaggtagaggctgcagcgagccatgatcacaccactgcactccagcctgggcaagagtgagaccctgtctcaaaaaaaaaaagaaaagaaaagaaagaaatttttaaaggcaaaccatgatgattgcacaacaattggatgtacttaatgccactaaactgtacacttaagaatgtttaaaatggggctgggggccgtggttcactccgataattccagaactttgggagctaaggcaggaggatcacttgaggacaggaattcaagactagcctgggcaacatagggagaactcatctctacagaaaagtttttaaaaaattagctgggcccgatggtgcgtgcctgtagtcccagctactccagaggctgaggtgggaggatcccttgatcccaggaggacgaggctgaagtggactatgaccgtgccaccgccctcaagcctgggtgacagagtgagaccttgtctcaaaaaaaaaaaaaaaaaaagcacaagcacagatcgtatcgtatggactgcaccttgcctaaaaaaatttcaattgtgataaatacacataaaatatctctcttaaccattttttttttttatatgcagtctcgctctttcgcccaggctggagtgcagcggccccatttcagcaatctgcggcaatgtgcttgctccgtgaacctgcgcactgccctgcgaggccccacagcccggtggcctcccccgtggtggccttgtctggtgcctggtccatgccatgcgtggctgtgcagctgcagccctcctaggcctgggaccctcgcggctggcgctccaggtcgctgcaccgaagggcacctgcattggaaactagtggctttgccgggcgccttcccaagggactggtgcatttgccttccttctgcagggtctgcaccccacccccatcccaccatccacagtgggcaggggcgctcgttctgaggggctcgccgcactagctcaccacacagtccgttctctttccccctcggcggggcatctgcctgtggcttcggaaggtttccgtttccccaggccttaccgtggcgccaggttcccagcctgcagccggtgggcccctcgcttggccggctcgggtcttcacttagctcagagaaatgctctctttcatgtaatgttctcacctccgtctgtccctccctttccctctgcagctcctggtactcagaggctgtgtcccgagtctcctctccccgtccccggctccaggccctcgtgtgagtctcggcacccgctcccttcccccaacccccgcgccgttcttctgttctgctgcccggttgctctttgggacctcagggatctagctccggaaagccattttgtgccgcactttgatcacgtcaaatgagcatctttgacgatgagccaagcgcctggccactcctctgcgcctgcacgctgtgggtccaggcagggcctatctctggctaccgagcccctcagggctgttgtggcctcgggggctcctggcctccatgatgagtgtgtccttgccagctgtcggggtcaggcccccttgggccaccccaaacctgtgatggacaaggaagcgacctggccattccatcagagcaaggatgccggatgctgcagccccagaggcctctcgacagccttttccagcccctccgtgcttctagaatcctcctcaccatttgggcttccttcttccgcagaaggctttcaagcagacgcttcctggtccccagatcgacagcaggataacaatattgctgcagaacaggtgacccccacaggccacaccttctagcctagagcgagcttcctagggcccctgcctctgcccctacacgtgctccacagcgccactctgcccagaggagaagcccccggtgccgcctagctgccgccctggtcccctggcccagagccgcactgacaccactgtccccagcaagccctcccgtggctccatgcctcctgccggctgccctcctctcagaacgccaccccaagactcacatcctagcccctgaatccaccagggctggggaaccatgaggaatgtcacagggcaggtcccatcctcccgggcctcagtttccccttttgtataaaggtcttcaagtcctggcatccagatgctgtccatccgagacctcacaggtccctgctgacctcaggggctccttggaagaccctgggtctgggggtctgatggggaaggggtgagccctgtgggtcttgggacagctggagttgggcctgtggccaccatgaggcccacaccacccagctgctgctgcctggcctgcaggggttaatgggtctggcccccccagggaccaggctcctttgtggagcctcctctctgcaccctggggcctggtttcttcggagacgcagctgtcagagctgtcgccaagcagaaccagcagacgcagtcccaggggccgaacagcaaggacgcagcaggggaccctggcagcagtgggtgcgggaggtgctgcttcaccacctgagaggggctctgcacccacagcaggcccctgccatgacttggtcccaggctgggtcagacagcgcggtcaggacgcacccctcgggccaggccaggcagggccgaccctttgctccctgctctgacggtgcagaatgagaagaggcaggagtctccggggcatgtgcgcacatggccccgcccacgccgtctagcctgcaggttggcctttgtgcacaggtcactctgcctggaaagtggtggcaggggtggtggcacggctccctgtaaccctctgcctgagtgagcgcctgctgcccagggccgcctcagccaggcaccccccggggctgcagtggccacctcaaagttccctctgcatccagacccttcccatccgagccacaaagccaacagccatgtagcctctgggcccagctgggagcagctccaaagtgtggggaacaggccctgccccgccagtcgccggcacatgcctcggagcctggtgtcccccaagctcactgcccaccaggcttggggaggcccaggtgctcattttggggacatgtgccccagtgacagaggagctctccctctgtatggcaggtcacagccccagacctgtcaacaggaagagcaaagagtggaggcagtggggagactggccgttgggggcccccgcttcatggcagtgcaagacacagcgggctccaggaacttggcagccaggacgggtagcagggcacgcctgtgtgtcctgaggggcaaacaggagtggcacaggtcccaagcccagcggccagagtaggggtgaccaccggggttcctgcagccacagccagaggggccccaggggcctagcaccagcctgggggtgccagggagcctgcctttcttcgctagatttgctgaccacacagcgccctctctgggggcagccactcacccacccacccacccacccacaagggaacaaggctttggtggcagcaggatggaccctgaggcctaaccctcacttgtggaccctggcctctgcatagcggactctgtgaggcaggtgagtggcactcaggaggtgtggaggtggcctagggtctgagggcagggactgccaggcttaccccagggggttgggccagaacctagcccggcttcatgaccacaccatgggggcagtagcactgagatgaagaagagccccatcgtctgccctgacatggcgtgagacagcaagcaggaagcctgctggccgggcctggacctcttgacactgccatccacatgggctggccatggccaggcaccagccaggcctgaaaaggtgcaaggtcccctaagtggggggttatgactgagtatggggtggagggaggccatgaactcccagtgggctcaggacactggatggcgagctcagggtggggggcggcaggcccgcccaccatggacacacgcaggcaactgcagaggctctcagctcaacccatgcacacttggtgcatgaatgatccctgagtgccacccctccacctccaacagccacacacccttacacgggcatggaggccagactacgtcctgtgagactccaagccagatgcatctcccggaggttacaggggcttccccagaatctggggaacacattggcacagccagaaagggccaggcctgtgggacacttcctgcagaagtaactgggcaacccagccccacctatgacacccgctatacctgccgcacctacttactgctcaccctatgcctgatgggctcctgtgggcctcaggacagcccctgccaggcccttgcctggggccccctcctcagctgctgatgctattttctatctcttgtcctggggggcagcctggatcatttcttctcacctgtcttctagttcacaaattctctctttagcagtgtctaagcgtggctgccaaactacttctggagtgtttggtttgaaggctgtatttttttttccatttctagaagttctacttggtgctaggttgaagtttggcctatcagcttttccaagccatctttgagcacagcaagctttttacaatccatgtctgagaattccagtacactcggatgcctctgcacacatttctcatggctttcgatcatggtgccaggttcccgtgtacttggtttgattgtggtctactcactgacctggaaaactcattcatgaggtgtacagatgtctaggacaaaggtgatttgcatttggttctaccaggaacctagggaactgcaagttaggtacacaccgtttaaaaggaaactcaaagcctgccgtctttttggccaacctggtggtgggaacatgggcttcaggtccacacgagtcatggtgtacacgactcctcagtggctgcccttctgcctgaactgcctggccaaccccttggggccacggcaggaggtgggtttaacccttgcccccaccctgagggcacaagccttgggcttgtgagcaactgatggcaagcagggtctcctaccagctcctctgtgtgtccctgcagacctggctcaatacaatggagaagccgatgggaggactccagccggagtgagggagactgtccctctagtgcacaccatagctcatttgcatggcttcctggagtccacagcagcagtgctcaacaacagacatccagagtaacttctgcagcaacgagcgggtcttaaggaattaccaggtcaaaatttttattcgttcattcatttattcatttgttctgcctgtgcaaggcagcctcactcccaggctgtcagcaggactttttttttctcttttgtacagatctggttcttggctttgctccttgactcagttgacctcctacccctcacagcagggtaaagacttgcacatcactgacaggcggctcggagtcagccttggagtcggccttccatgcccagccctgaggccaccatgccacgttccagttggctcaagcagtgaggggcaaaaccagctccagggccaggtggaagggctgcttctctcctgcctccatcaaatgctgaccttgcctctgaatgaccaagcaaaacaaaggaataaatgaatgaataaaaattttgacctgttaattccttaagaccttgatacgtattcgtgggtaagcaattttatactattttataaaactgttttcagctgttttagtcagggtcgggtgccaggcacctagacacccccctccccattcccaggaaggttttggccaaacctgcatccaccaccttggcatgccaacgcattcgaggccctggcaggccccgactcaacagaaccgtctcgccctctacagccaccacagccacgtgggccaatacccagcacgcgccccactgccccaagcctctctgccggcgtggctctcccccaacctcactctcaatacaaaagggacagcaccgaaagaacaagggaggccggaatggtggcattattcaatcaaatatacagagtgcttcctttaatatgtacacatttacaaaaatgcactttcacgaggaggggcggccggggccggcaggtgggcagcgcctggtgccacggcacgcgtggacagttgcgaggggtctgtgtgaaggcacttgtcacgagcttcaatactgccgccgtcccaggatgggagaactgcgcagcaggaagggcacttctgaaagcacagtggagagatcgctggagcgggcgttctgggcaggaggaagcacagacggcaggcagggtggactggccagcaagcgcgaggttgacctgccagccttgggccacgccgatgacctcaggccccactaacaaccacaggtgcgtcaacagccacgggccgtgccggcagccagggccacatcaataaccagggtcccaccgaccaccgtaggtcccaccgacagccacaggtcccattgacagccacgagtcccaccgacagccacaggccacaccatcagccacgggtcccaccaacagccatgggccacaccaacacagccatgggtctcaccggcactttggcctggagccacagagaaacccgagtgaggaataaaaggaagattctgtaaacagtgcacaacctctggtaacaaacgctacgatttggtgacgacgcagacaccctttgctctctcctttcatacagcgagtgccacgcacggaaactttacaaaaatagcaactatccgagaatactccattgttttcagcctgacagttactgaataatttatacaaggttaaagaaacgtagaaaataaacatttggtttttgtttttggtggtttttttacacaaaataaagaaactatgcacatggcctcggcctccgggtccggcagacggcatggctcccaccgagggccctgggtcccggcccagctggcagccgcccctactccttgccggcgtagcgggcctcattgatgctcctgaccgcgcggttgtccactttggggcctgaggcccagtgggccggcctccccggcgagcggccaggatctttggtgaatttgtgtgagaggaacttctccgcctccagggagtcctcctcaccgcggcccagatcctcgtcctcctcatcctccctgacggccgcgtggccggccggcccgggcagcgcctcgtccgccctgcgcggcggcggcgtgaagttcttgcactggtagagcacgtccttgtggccccccggccgctcaatggggttgcggatggggttgagcggggcccactggttgttggcgctctcctcccgcggcagccggctcctctcccgctctttcctgcgcttgcgtgtccaccacacgcacaggaccacgcacgccagccacagcacgctgaaggcaccacacagcacaggcaccagcagacctggggaccggggagaagagccggtgggcaatgaggcctgggcacctgcggggcactagccacacacccaggcctgggagggccctgcgggccaggcggccgggccccaccctccggttgctggctcgtggggagggtcccaggacgggggctgggaaggtcaggttgtggggctgggcggctggggcagcaggtgccagggacttctgtgttcctggtggctggcaggatcggcaggatcggccggctctgtgcccaatgcctgagttgcctgcctggtgccttcccaggggcccacctcccgcgcttacctgtggaagagccgcccgtaacaaccgtctccaccttgacctcggtgacagccaggagcagtgagctgttcccccgctgggtgatggcggccacgatggcgtgggccgcgccctggatcaggctgctgtcaggcaggtccctggcagggctgaaggactgcggcaaagaacggcattgtggggatggctcgagggctccaggctcccagcagcctgcccccaacactgaggccctggccacactggagcaaggtgggcgcacgggagacgagagcccggggtcctgcagtggcgacttcaccaccaggcagtgagtggggagtagcggggggaggagtggaggggtggaggctgtccccatccgggcacacaggagagcccagggtcctgaggtgtggggacctcaccaccaggcagcgagcagtggggggaaggggaggggtggaggatgtccccatccgggcgcacgggacagcccagggtcctgcggtggggacctcaccagcaggcagtgaggggtggggggaagtggaggggtggagggtgtccccgtccgggcacacaggagagcccggggtcctgcggtggggacctcgccaccaggcagtgagttggggaggtgtgtggccccattcgctgacacctgctccgtgatggccatcccttcttgtcagttcccagcccccacccccacctatgggccacaccccaggggcaccacaaacctagtgccttcacgaggccacagcaacccggggctgtgcccctgcctccaccacatccctgatggcgccctgacctgtgctggcacacttcttacatcttcccctgcccctactgcccttccatcacccagcagcacccatccatgtcccccaccccctctgcggcctcagggcaccaaaacactgcacgtccttcctgtgcctggccatggcctccaccagccacactgtgccatggccacacccactgctctgcacacccacccaccatgttccagaacattccctcccctctccgggcatgtctccaccccagtctcacccgacccccttggtatccattcacatctgacaccccccaggtccagggcaggtgccagtcccaaagcaggcctcccagggcagactaagcccacggactctcctgctgcctgtgacgtagggacacagagacaaaaacagagcaggggaccgggcgaggatgcagctgcaggggaagcgggctccacaccacagccctgcatctccctcatgctggccaggcccagggagcagttccacgggtctgcggcatggacagcgaggggccgcagggagacaggcctgcccgcagtccttccgcaccaggactagcctcgccagagcctctgtccagcatagccaggacctgcatagtacgggacccagggcccacccaggtgctgctccccactgggcactcaccacggccacctccacagcactggcccccgaggacgcccggtcgcaaagcaacaccagcaggcggtcccgtgccacagcccttgtggctggcagggagcggatcccggagcaaatggcgcccaccgtggtgccctgggcagagacaggcagtgcgtgggcagggcagggccgtgaacctgacacctacatccctggactggcgctgtgggtacacgtgggacacaccctacagcccgcccaggagagcacagcaaggatgccaagggcctgggggggcagcttcccacccggctgtgccctataccaggaggcaggagtgacggtgcccacccgcccatcctcagggcggacccagctccacctgcaggccagtgggggaaggagaggcagggcggggtacagtgggtctcctccagttctgagcccctcctgggagacaggggcccagctccaagcacacagcaggcaaaggtggctcctaggccagggcaaaactgcccacggagctacagcccaagagctggggccaggcagccatggcgccgtcagtccaggccctcagggcagctggacaaacaggcacccccagctggctgctctcccagcctcctctgccacctccacccagcaccaggcccaatgcccctctcatctgaccccacagggccactctctgtgaccaagagtgactctgctcagccaaccagggcctccctgccctgcggggctaggctttcgccatgccacgagcagatgccggcgtgtggcctctgcaagctcagatgccaccaggcccctcacctggggcacgtggtcacggttgaaatgcaaggtgaggcgggcacagttattgtccaggtggccggagcgtggcaggcagggggtgctcggtggctcttctgcgccgcactccccccaggcctcacagggtggtcgcagacactggcctggggccttctccaggcacctttgccccagtgggcactgggcgctcagggcctcgggctggccggccagcagacaaggcttccatccgcaccacacctgggcaggcacgcacaggagggtcaggcgcaggcgcacaggagggtcagatgcaggcacacagatgagaacccacaggcaggcacgggccccatgccaaggagggacaccgcccaagtctgtgagccccagggcccagcccaccccctacccagggctcccagggaggcaggccaagctcgacatcagaaagggcaggcggagcaaggcaggacccagaccaggcctgttttcccaactgcacatcgaagcatggggcctggctgagctctcgcctccctgggtgtccctgagggcagacggctctcagtccatccggaccccagcacccgcctcctgatctcacagagtggccagggtcagcgtgcaccagcctcgggtagggcagggcggctcacgggctgccctcaccttgctgcagtcacggcggccatccaggcagcggcagctgttgcagtcttccacccaggagcttccgtgtgggaacggagtgccccgggaccagcaggatctcccgaacccgatcactgtggggagaaggggctcgagggtcagcagtgggcatctggccctcggggctgggtgtcacccatgccccccaacccgccccaacccagggcaatcacacggggcctaccttcctggcaccgggggccggctcggccgggtgggcagctacagcgatacccgttgatctcatccacacacgtggccccgtaggcacagggcgaggactggcactcgtcgatgtctgcagggagagccaccgctgctcagtgcagtgaggccaacgcccaccgcaggaccggcatggcctagggcagcggggagccagtggcacacaggcgcaagccccaggacaatgaggagcagcccctgcccccgagcccaagctgctgcctgcctgaggccttcctgagcccagcctgaccctggcccaacagcaccctcctccgtctgcttctgcagtgggcctgtcccatcctggattagccccagctgctgcgtcggaccagccaaggggtgctggacagacagctgggccaacacccagggacaacagccctgcggccacagaggagcccacgtcaggctgcacgctccaacccccacagctccctgggccccggactggtcccccaggctggggctccccacttaatcacttggcagggtatacagcaggaaccccacagggcacagacatgtggggaaactgaggctcagaagagaggcaggaagtagttgtggccacactgcccttcaagggacgtggacgttgatgtccccagactcctgacaccgcggctgggctgaggggctcccagggctggggctgtctggccactcactgatgcggcagtcaggccccgcgaagccaggtgcacactcgcagcggaaccagttgacgccgtcaacacagatgccaccattgtagctgcagagcagagggtgggcatcaggtggccccccgtggtatgccaagtcccacccacccctgctgtggcccccagggtgccactcaccaaggcagagggttgcagtcgttggtatctggtttgggagaagagaacgcaggggatcagtacccaccccccaagcgtgccaggcactgtccaggctggcttggcgtgatcaggctgtggggctggggagggtcatcaaggagggtgccttttgctgggggcaggggcagcagggggaggggctggcagaagggactggggggcgagtcgggggcagggatgtcatctgggtggaggaaagcggcccccgcccacacccctcccacactcactgtgagtgcaagtacgaccctcccagccgtcccggcagatgcaggagaaggaggccccgctgcccacgcaggtgccaccattcacacaggggttgggcaggcagctgctgttcttggctgtaaggagaggaggaggagggagcgtctcacctggccctgggctggccctgggtctccataccgcgcccccaacccagacagggcagacagacccgggggcagggggcagggggcaggtggcaggtgtggccctcaaaaaagacccctcggcccatcgcgcccgagggagcggtgcctgggagggcatatgcccggcggtcgcagaggcagcgggggctcctcaccgacggcgcaggtgctgcccttccagccgggggggcaggcgcagcggaaggtgtcgccgctgtcgtagcaggtgccaccgttgctgcaggtgtaggcatcgcactggaactcgcctgttggcacatgggccgctcagcaggcaggccccagaccgccagggccagggtcctgggggcagccccaggcggccagggcctgcggacactcacgtgagtggcaggtcttgcccttccagccgtcgtcgcacgcacagtagaagtcattgaccaggtcgtagcagcggccgcggctgtggcagggatcgggaaggcagtcgttgggatctgggggcgaggacgccggtcagcgggcggggggtcaccggcgctcagggagggcttcccgggggaggaagcactggagctgggccaggtgaggacagagaggggcgggggaggagcgtcgggccgggggagctggcctcgggcatgggggcagcctgggactccaccccatggtggcagcaccccctggccaggcctttctgggtacggggcctgccgcacccagacagcggtccatctcagggtgataaggggcccacaggggtggaggcacaggccgtgtgggcgggtgctggaacactcactggtgtcgcagagctcgccctcccagccgctggggcagaagcagcggaaggcgtccacctcatcgatgcatgtgcccccattgcggcagggctggcccaggcagtcgtcaatgtctgcagaggcgagcggggtgagccagggcctcaggccagcccagccccaccaccagcccgccgttcgtggccactcactctcatggcagtaggtgccagtaaagccactgtcacagatgcaggaaaagttgccccctggctggctgacgcagcgtccatgggggccacacacgccggaggctgctgtgccaggcatcccaggccccgcgtctgacccgcagccatcgatcactatggcaggcagtacagtcaggagtcaggcccgcccctgccccaccacctcccccaccaccccatgccgcacccagcacctctgcaggccccgccagggcacggctcgcggggcacggagcagttcttgccaccaaagtcatcagggcaggcgcagtaatagtcaccctccaggttatagcagcgagcgccgttccggcaggggcttggctcacaaaggtcgacatccacctgcagggtggggggtgcctgtgagagcctaggcccaggcccaggccgggaacacaggccaggcctctgtccatacgaaggtagatccctggggacccccaggcccctccgccctgggcctaacagtgccagccagagcccaagacccctgcccacctgagactgcccaggccttagctgaacgcagatacctgtgggcccccacccccacctccactgcagcccagcttcctcactgtccctcgggaggagtgtggccttggcccctgctgctggcaggaaggacagctcctgagcccctcacacactgcctggccaccctcagagccaagactgtgggtcttttccagggccagccactgccatgcttgcaggtcctgaggtcagacccctgccctgggccccaagaagccctctggacaggaggcccatcctctgcaccaaggccagggcaggatcgtgggcggccgagggtggtagggaggtgggtggggggaggcagggaaaaaggggaagtaaggggagggggtggtagggaggcaggtaatggggaggcagggttgggggaggtggggaagggggtggtagggaggtgggtggggggaggcagggttgggggaggtggggaagggggtggtagggaggtgggtggggggaggcagggttgggggaggtaggggaggggtgatagtgaggtgggtggggggaggcagggttgggggaggtggggaagggggaggtggggaagggggtggtaggggtggtggggaagggggaaggcaggttactttggaggcaggggggaaggggaggttgggggagggggtccagtaccaacagatggtcagagggaggcgagagcatcagccctgagagagatgcccactccgacccaggactcacctatgacaggtgtatacctctccaccatcaggcacccaccctaccccatgtgctctgcccaccagagccccctgccctccagtcccgagggagtgcacagatggacagataggcctgggcagccagcagcccgggggctcctagcccaggccaccaggaaacccatcacaacaagcaatggccacagggggccaagcctggtgacctgtgacagccccgcctgcccacctggcacccagtggagagctgagcctgggacgccttggggacaacttcccctgcagcacccctgggtcactcaggccccatggtcaggggacgaggcctgccctacagctcccagagcagcaggtggggcagggtgaccaggcagacctcacctcacagagaggcccggagaagccctgggggcagtggcagtggaagccgtcggccaggtcctcgcagaggccgccgctgtggcaggggctgctggcacactcgtctcgttccagctcgcaatgccggcctccgaagccccgtgggcacacacactggtacccgttcaccaggtcctgggcgggccagccaggtgagcgtcccgcaggcaccctgacggccccgcagcacccacgccacacaccctcctggccccgcctcaccttgcaggtgcccccatgctgacactgcccgcgacagtcgttgacgtctgggggcagaggagcagggtcagaggcggggtcccatgtgcctcggcccacccgccggcgcccaccccccatactgactgatatggcagttgatgcccttccagcccgggatgcaatcacagtaatagccgccaatcaggtttttgcaagaaaaagcgttaaggcatggcttcccttcacactcattggcgtctgtgaaagagacaaggtgggagccgtggggctcgggccctgcctgccccctgcagcacgggcacctggcacccgcagcccagcagccccagcagccccagcagcccccgcagccccagcagcccccgcagcccgcatgcgcggcccacgttcccatgcactcgctcggagcccttacccagctggcaggtggcccccacccactgctcggggcagatgcactcaaagccgtccacctggtccacacaggtgccaccggccgcacacgggttcgaagcacactcatcgatgtctgcagagggtggagaaaggtggggccctggcagtgtgagccgtgggaataaggtccccatgggcaggtggcgctgcaagcctgggtcttcctgccatttgtcctcgccaagccagccgcagccacacgtgtggacttgaccactgcaccccatccccagcgagttgccccactcccagacccccactgatactaggcaggagtcccctactcacgtgcagacactcaccaagggcacaggtgggcccgctccagcccgatgggcagtggcattcgaagccggacggcacctcatggcaagagcccccgttggcacacgggttggaggtgcaggcgtgctcagctgtagaaccgcggggagggggcagagctggcagccaggcccccagctttccacaagcactcctccccaagcccacaggttcccaagctgggggtcaggggcccaccacacaggacgccagagggatggggcctgaccggctccccagggaaccagtccctgcctggccagaatttgggtggccagccccccacgtacccttctcacagttcctgcccgagtagccgtcagggcaggtgcagcggtactggtcaggctcggcgttgatgcacgtgcctccgttggtgcaggggtggtggctgccacagtagttcaggtctgggggcaggggtgggatgctcaggggaaaagccggccccccgctcccccacaacccacacttcgatggcagagcattaggcctgccgccccctaccactacctttgtcacagagcaggccgccccagttggtctcacagttgcactgccagggctccacacaactgccatgcacgcagccggggtaggggacacactcatcgcagaacctcccttgccagccgtagctgcacctgggggaaggaggaggggcgcaagacccagtgagctgtggtgcctgaaagggtggcaggggagccaggcacagtcacccacgccacacccagggccggcgggcggcctcaggcctttgaactggagcagccccagccaggcaggggttgcagccctgccggccagccccactgtcacgggcattcccggccgctggctgccgacggtcagccccagctgtcccgtcactcctccctgagctattttgggattcacccgtgagctgggccccgagagcaggcaccaggaaaggaaggccctgccgggaccccggggatgagaatgccggctcggactcacaaggtgctgccagggccgggaggcaccaggggctgggtaggccagcgggcagcaggggagcactcctggctctgcctcggccatgtggccctgggcacagcacgtgccctcgcccccacctcaaaggcagtcatttcgctcgctcccagtaaagtcccacaaggtacccatctcacagatggggctactgaggcccacaggctggcctgggccagccctgcccagggtagttcctgattctgcaggagctccagctgcacccccagctgcaccccccaggacacaaccaccaggactcgccctgccccaggctatcggccaacgtcctgtcttgggagtcccccaggagagggcaggtggccagggtagaacatggcctgacttgagggtgcctccgtcaggggagagagcctgcaacgaccccaaggctcagcaggctgccatccaggccctgccgggactcccggggggcccttcctagaactctccggtcctgcaggacgggaatgtcatccaggccacgtcacttccacaccggcacccgccacactttatttttgtaaaaggaaagaaccacggcccttcctgagccgccctcaagccacacagccagcaccgaaggcctatcagcccagttcagctgccacaaatggggaaactgaggccgggaagaacgtgtctccagtatccagcccagcatgcacagtggtccgcgtgggtggcctcacatcccgcctagaatccctcctccacagacacagagacccaggctcagggcggggctgtgacacaccttgggtcatcggccagagagcggccacagccgggctcagagcccagacctcgtgggtcccaagggcgtgctctcgaccctgggcagggcagcccacaccaggcccccacctcctggtttccccagccagcagccccagggccctggagaggcggcggcaggaaggcatggccatctccgcagcatccggtgggggggcgtcctgcactggaacctgagccgaggctgtcagcaacagctgggcctccccgacagggccagcaagaggggcaggcggagctcacctactgcccccacccaccaggccccccagactccggctcatcttcctgcgggtaaagggcagggatggccaacttctctgctgccttcctccagccttggtgtgacattcaagctgccagccagcagccatccagggagggtggcactgccatccaggttgtgtgatgcacactgggccaggcgagggtgagtggggccgactcccgtagatctacatctacatctgcccagaccaggtccaccttgttgcactttctgagctgacttgggactcgctcaacctgccgggaatccctgtgtgtgcaagtgaccgggtgggcggccccagccctgcttgcctccccgctctgggactggccgggaaagctcctcactgtaccctccaggccactcaaccgtggggcctgtggaagggtcacccacctccccaccttggctcccaactcagctggttcccaaactccccgactcctctccaaaacgccacgctgtgtgaccctggggaaatcagtaggctctctgtgccccagtgtcctcgtcccatggaggcaaacccactccacagagggaggtcctgggacccctgcaatccaaggctggctggagggcggtgctcacctccacctgctgtctctccacccgctcgcgcccctctctcgggctccccagcttgctcacgcacagtgagcgccacggctcgaagcccgtgcccaccccagaccctgggccccagcccctctggttgccctgctgacttctctgctccactctagggcaaagctgccagcccccctggctggatcccccacactctggtctgggtccagaggcctccaccatctggacttggctgtaagaccccggacactcccttgtggaggcccttgctgactcctcatccatccgccctgacctgtggcagccgggacttgctccttggcctccctcctctctgccttccccactttcccgtcaccgcctgaatgccaccccccacaggccccgcgtggcgcaggccaggcctctcccacgagctttctgggtgtctccagggacagggcaggcatcgcctctccacatccagctaaccccggccccgcctgctcctctgtggcattcctcctgccaccatggctctgctactcagcagcttggggttctccctgactccacacccttcctgcttgatcaaatccatccacaaacccctgggctccaccccaggatgtctgcaggacccgtgcgcctctcccccttccactgaccccctccccatcccgctggcccctcccccaccacccccacatgccccacagcggcctccccctcacagcctcccgtctggtgcttccccactcaacagctaccacagcccttccacccaccttgcccagctacaaacctgccagcagccccttcctctgtccctggtcctgcaggcctcagctcccaccactggtctgctctgccgcccctcgcctgctggtgtcacttgccggccgctcgccgcccaccccctccccatgggcagggttaccgtgtcctctgcccatgccccatctctgggtggcttgcagcctccgggtctctgcccctcggtgacgtgactgtccagccagcctccccagtctctcctcactgtcctcacatggctgccgccatcagacacatcccatgctcagacacgcacctactgcactaaggagcctcccgagctcagggcccggctctcacagctgtgtgcccaacctccagccagctccgggcgactcctgacagcaaggctgtgtgtgccagtgaggacgtgagggcaaaggttgggagggcaaagacgggccggcggcacactcacctgcactccccaggcacggtgcatcccccgtggagcaaattacacccttgtttacacacagctgcgaacagagaggagcgagaggcacagctgcagccagcctggccgcaaggcctgtgcccggggccctgcccgaggccctccctgccctccacgcagcccagcggccccctcaccttccttgcactccttgcccatccagccgtccatgcaggccttgttgccgtactggtcgcaggtgtagtggccgaaaaagtcgttgcggggccggcagaacttgttgcaagtggcgctgtagtagttctcgtcgcagcgcacgcggatctgcagctccaggtgcgccacgtggccgctgaagtgcaggctcttccagcggtcctccgggttgatcatgccggcatgcgacactcgctcgatcagcagctcctcttggggaggcggcagagtcagcacaggccagagaaaccagcccggccaggggtcctccaggaacaacggggacggggcagaagcctgcggctgctgcaaggccggggcacagcaggcagcagcacacggagggcagggcccccggccaggctgctacagaaagctcagggccccgagaggcctctccctcccgccaccaagcctgcgccccgctcccaccctaaacgcagagggtcggggggcccggctaggggctaggggccctgcagggagggctgctgagaccacaggctccacagagaaggcacggctgctgccagggcgtgagtctcacgtcccacacctgtgcccacccacctgcagccctgctccaacacctgcacccacctgcgccgtgtccagccctcgacagcacggacatggtgctcagttgccctcccctctcctgcgctgtgacttgctcccagaagtgccaaacaccactaccgtccccaccttaagacaagcctcccctcaggcccccaagacaggcataggtcccgtgacccgctgtctaagcctcactttaagtaagccaccaggagaccaggggccaggggcaccacagctgctggcgctggtatgcaaagtccgtgatgccggtccctgcgcttaggcacaggctcgacgttttgcacaataaaaggtgaacgggtcctccagaccccacctctcccgcctcgggccaaggcctgggaggacactgtgctggcccactccccaaggggcgtcccggccgccccagcctctccaggctcacgttgtcaagagccctgacgaccttgcttgggactcagcccacctgtctctctgccaccccctcaggaaacacccctgccctgagccgctggggtccccacaactgctgctccccacctgggcacccccaccgccgtccctgccctgaaaacagcccctccactctgctggcagccaggatgccctggccccgctctccctcctccaacccattggccaaccccatgcctccacttctgagagcccctctcacccccagactgcccctggtccaagtcaccctgacacgcccagattcacgtggcagctcctcctcggtctgtgtcctggccccacagcccaccctccataaggcagccacagcttgccaggcggagcccgtgtcctctcagtggcttgccagcctccatgatctgagcccagccccggctgctccccctgcacagccagcccgctcctgcccagaccttcacacgagctgctcccttggcctgtgggtgcttctgcattcacccatggaagtcatcccgttacccctgcagggccctgcagagcccctgcctcagggagagggccaccaaggctccatgctccagtacagacaagcagagggggccacaaagccagagacacactcaagggtgtcccctccactaagtcactgccatgggccccaaaagagcacacccaagaggagaacaacataggcaaagccaggactggggaagagagtgcatgcacagctctgcaagtcccaaacgtggcagagcttcctggcagccaaagcaaaaagggaaacagcacacatgatcctcagggtaaagcaaggctttgtcccaagcagacagaggagctgggccctgccacaggcacgctgaagctgagaggagctgccacctggcccagggctcactcaccattcggggtggtatcgttgtcccagtcccaggcctccacgatgagggtaaaggagcgctgcagacatggggaggcgggtcaggtacctgaggccacacctgcctgcctcgttcagggtgggacaaggcccagggctcagacgctgcccctgggtctgccaggctctggcccttcctccccagccagggacccaccaccctcctcatcctcaggccacatcctctgcagacccaaaaatgacccagctcaagggagggagactgcccctccaggccacgcgggctcaggggcctgggctccctaccgttggggtgccagaggcccagcctgccctgagctggctcaagtcagcacggagcacaggaagagcgaccggggggagaggtgggcaaagggcagcctggctggagtggccacagacaggggccccatgggcagccgggacccgagcgtttcctgtggaacgccccttggtgcctcactgggggtgaccacgggggagaacgtggggccccatcaccacgctggcggcctccaccaagtgcacggggtggccaagtacagggcgcccagccagaggccccaacaggccggagctcaggtcctgcaggcatacagcacacaggcaaacccacacctacctccaccctcacacagaacaggtggcaggaggggcccttgcggtacagttggggaaactgaggccaagaggtcctgggactgcccagcacagcctcagaccatggccactatgccccctctgcccccgggccacctggcccttgtaccccagccatggcgacaggcgatgctgtcagccaagcaaagagaccacagggctggccccctgctccgcctagtgcagcccacggagaccgtcactcacagacatgctcagacaggtgggacccccgggacatgccctgtactacccagcactgggtacccacattccacagcctctcagccctcactgcccaggaaccccccagtctacccctggtgtgctcttgacccctgagcccagccctggctccttccaggtggggcccagaggagggggctggggctgagtcacctcagggcctgctggcttcccaccccggggggatgctgcgttgggcagtgtccaggcaggccaggctcactccatccctcagcacaccccatccaaccagccccaaggcctggctaagctggggaaaaccacacttccccagcaaggcccaaccccacgcctgccagcccttccctggtcctcacccgccgcccaccccacgcacgtcccagtgcctcggcctcatccagctaaggacaggcctggcctcccaagatgtctcagaagactgcactcccacgtccagcccctcccctaaccaacgtgctaccagccacacccagcccagcctccaggacccccacccagtcccccgccccacacctccgactgtccctcaaatacagacaactagggcccaacatgactgctgaccctgggcctcactcacagctgggcaaccccggccccgcccccgagcccctgcctgcagaacacccggggacggcccgaggaggctcacccaggtaggagcacaggatggaagtggggggccatccccaacccgctcctagaaccctccctagccacgtcgagctgacaacagaccctcaatcccacctcttaagctccccttaaacccgttttcccacatccgccatggccccgccaggccacggggcccagtccccgcccatctccagggctccctgaggtcaccagggcccgcaaacctctgcctacaggcgccagacaatccccagagttccatccacatgcctcccaaggctccgtccacaccccccgccgagctctgtttacaccccccagagctccatccacacccccaaagaactcaatccacatcccccaacggggttccatccacaccccccaacaggctccatcacctccccagggctccatccacaccccgcaacatgctccatccacacccccccagagctccatccacacccccccagggctccatccacacccccccagagttccatccacacaccccaacatgctccgtccacacccccccccagagctctgtccacaccccccaacatgctccatccacaccccccagggctccatccataccccccagagctccatccacaccccccgagttccatccacaccccccaacatgctccatccacacaccccaacatgctccatccacaccccccaacagggctccgtccacaccccccccagagctctgtccaccccccccaacatgctccatccacacccccccagggctccatccatacccccccagagctccatccacaccccccaacatgctccatccatacccccccagggctccatccacaccccccaggactctgtccacaccacccccaggactgtgtccacaccccccaagggctctgtccacaaaccacccccgtcagctccatccacaccccccagggctccatccacacccccaccaggactctgtccacgccctctcagctcagagcacccttggggttcccaaggctcctgcccacccccacccacccaccccagcctatcaacccatctgcctggagcaccaccctcgcagctgcacctggccaagcccttccccacccccggtaacacctggagcacccagccgcttcccaggcgtctggcatttggctccttccttcgttccttccttccttcgttcacatcaagtgtacagcaggcatgcctctgccaccaaggacggcaacctatagccagcggggctcggggaaagcaacagggggcaggggctgttgttccaataaggccaggccaacgggtcacagtggctcacgcctgtaatcccaacactttaagaggctgaggcaggcagatcacctgaggtcaggagttcgagactagtctggtcaacacggttaatcctcatctctactaaaaatataaaaattagccagccatggtggcaggtgtctgtagtcccagctactctggaggctgaggcaggagaatcacctgaacccaggaggccgaggttgcagcgagccgagatcgcaccattgcactccagcctgggcaacgagggcaaaactccatctcaaaaaaaaaaaaaaaaggccaggccaggctttgaacaggtggcattgagattgaggctgcagggcatgaggaagtgaaggagctgcatggcagagcccacaagaaggcccaggggctgagaacgcatagcccacggggacagtggggtcataccacagatccagaccccaccacggacttccttcctgaggctaagcgaagtgggtgactgttgcgggtctgagtgaggtctgttcgggtgttgggggtccgagtgaggtctgttgggggtctgagtgaggtctgttgggggtctgagtgaggtctgttgttgggggtctgagtgaggtctgttgttgggggtctgagtgaggtctgttgttgggggtctgagtgaggactgggacccaccaggctttaacagtcactgtagccgctggacaggaaccagcaggaccaggaagcagcaatagtgaggtcagaggatggggccagcatgggtctgagagcagctctggccacggggcaggcagagaaaagccaggccacccggtctcccggcacagccacacctgggcttcagggccagcagggagttcctctcgactcccaggaaacctcatgccagccactcaggtaagattactgccaccttcgcctgagcccagggctccggttacctgctcccgcagggacgtgtgcctgcccgcccgccgagagggcctcaccgcccgccagctggggtccctacacctggatggcaggaagtcatccagagtgaacctgagctggctgacggggcggtacctgcctcaccccacctgccagctctcccagctccccttcttccctaggggccagcctccaggacttatttgcctcttctgtgaataacaacctctcacccccgtccttccaggactcagttgcctcctctgcgaatagcaacctctcatccctgtccttccaggactcagttgcctcctctgcgaatagcaacctctcacccctgtccttccaggactcagttgcctcctctgcgaatagcaacctctcacccctgtccttcctgcctggcgggccacgatctgggacagggttttgtcaacaccaaacccctagaacacaggagggactatagggcctggattgggcgggggttggcgggcatgttgcccttctaggaacggggctgggacatgtggggatgtgggcctggcgctggcaggggcaataggcgatgtgtgggctgggggtctggggacaggtgagagacccatcacctgcccaggttccccggcaagcagggagaggaacccaggccctccctcaaggccagcctagcagggctatgcccctgcccagtctctggaggccaagggggaagggcttcacccctgcaggcccagctaagcctctccctacaagcccggcctgacccacccccaccgcacaagcagacccgcagcccaacttcatctcccaccatctgattgcctcctccccagcccgaaccctcaaggctaagtctaaacccctcctcctgtccccaggcaggggcaacagcagtggcacaagccagaggacaggcagacaagacaatagatgttccaccccaggccagggcacctcaaagcccagggtaccccaggtccagggcaccccaaagcccagagtatcccacagcccagggcactgcatggcccagcatactccaagacccagggcaccccagttccagggcaccccaaagcccagggtaccccagagccccaaagcactgcatggcccagcacaccccaaggtccagggcaccttaaagcccaggacacctcaggtccaaggcacccaaagtacagagtaccctcctgcccagggcaccctagatccagtacaccccacagccttgtgcaccccatggcccagtgtacccacagtccagggcaccccaaagctcagggcactccaggtccagggcacccccagcccagggcactgcatggcccagcacacctcatggcccagggtactccaaatgccaagcaccctaagtccacggcaccccactgcccactgtaccccaatctacagcatcccaaaactcaggcaacccaagtctagggccctgcacggtcaaggccaacacagcctccctgctgccccgctaacggcccccccaggtccagggccctgcacggtccaggccaacacaacacagcctcctagacctgctgccccaccaacgccccgacttggtttcttctcctcggcctcccgcatcagcctcccgccccctacggagcacagcgcttggtgcaggcgccaggagctccaagcacagatacatttcctgaaacctgagcttctgagaggcccaggcctctgccaccattgtcacccgaggcagggaagaaggggtgggggcaaacaccatccccagggctctgggccccagggccgcagcaggaggagcagaccaaagcccatcccacgcaggaacacacacacccatgctccacaccagagaccagccagggccttgcctgggtgtacccccactccccagcacaccccctctaggtcccaggtcccccaccgtgaagacggtggcagccagggccggctagcacctgccacaaagcccagggtacaactgatgccagccacaccctgctcaggcctgggatgtggggataggaatcccgctcaggcctgtggtctggggacagggactccgctcaggcctgtggtctggggacagggcctccgctcaggcctgtggtcttgaggacagggactccgctcaggcctgtggtctggggacagtgacctcactcagatctggggtctggggacagggaccctgcttaggcctcaggtctgcagacagggaccctgctcagtcctgggacctggggacagggacccagctcaggcctggggcctgaggataggggccccactcaggcctggggtctagggacagggactccaatcaggcctagggtctggggacagggaccccgctcaggcctggggtctggggatagcgactgtggctggggcctgggattgcagatccttgtcttcctgcccccactccaccaccagcagcagctcaggccgaagcctggctccacaagcaccccttcactggcctagcttgctcccctcataaagacaccatggagcagcccaggagggcccctgagagcagcagtcccctcccacccaggcctgccgcctgctccccaacccgcccctccacctcccagccttcctatcgtgctgcggctttgacccttcagcccaccctcagggaccagcgacaaacccccagcccactctccaatcctccctggccaagggcagtcctccctggctccaatggtccccgtgttgcctgggcactgaatgccccaccctgcccccataccaaagctttgaaccagacccccaatgtacaaggcggacatgccctgagttctccccagggctctgggccccagggccatggcaggaggaacagaccgatgcccacccaacacaggaacccagatgcccacattccataccagaccagccagctctcctggtccctactgggaaggtgtgggaaggaggggggtggtccccagtgtgcagacaggatcccctgaaggtagggtggggaggccagggccctgtcatccccagcccaagctcagaaaaaacaggaagcagagtggtgctgaacctcacacctgccacgagcagcttaggtagctccaggcacagacctcagcctggcccaccttgagccctagggcggctggatgcagggggtgggctctgtaaaaaccttcctccctagggggcaaaggagagggtagggaaggctgggaaggggaggaactggacaggtctgggagccgggctgggggcacaagcagagcccgagctgggagtccagcagccccatctgacttcgtgagacctgcaatgaaaaagcggcagtgtgcccctttcacaggtgagaaaagctcagcccttctgatggcccaggacctcaggcctcctgagctgatagacgcagggtcagccccaggcccacctcctgtatctacagggccttcacccatcccgttctcctcataagcccagatctgtcacggggaccatgctccagccacaccaccccgcacagctgccctggagcccagcacacacatgccaagacagaacaagaaagaccctcgctggcaggcaggctcctgggctcctggctccagagatgggccagccaggcaggcacgacttccagctgcacctctgagggtggggccctggctgcccaggtcacggccaactgccaccaccctgctcctccctcagccagcaggtgtcccctgggcctgccacctaccaggccccagagcaaagctccctgctgcccccagcatgacactactcctccccaaacctccatcaccacctgccatgcctacagagcacccggggtgcgtgcacacacgcagctgggagaatgtggcctcaccctgccagctacaagccaggcaccagaaccaacccaggctgacaccggcctcctggggacgtctgggggtggagccaggagaggaggggcagccaggcagcctgctggcatgtggtccaccacctctccacattcaagaccctgggcccacccactgagggaagctgagcccgagaccagcacagatccatgactaatagcacacagaccccggccacaagaagccaggccagggggcagagggccacccagccaggcctgggtcaacagcagagaccacaaggtgggagagtcactcagggggcagggggtggagggagcgaatgcagagcccagactcccccactcctcttccacaaggccctctcattccctttactccaaggagcccaaaagccccacgggcctgggcaggatgccaccctagcctccaggctgaaacccctcctcaggtcccagggagcctgaactcggtccttgccttcccatcacagccaagtacacctcagctcaccgcacagagctggacctcagcaagccagggcagcatggccagggactgccgccgcccgagtgcaaataccagggtgctggcatcacggcacagctcccgcccggcagccaggccacatggcaggagaccagggctgcccccaaacacgcagctatgactctgccctggcccccaacccagagacaggccgcctgccccctcctggggcattcgaggaaccggctggaagcaagaggcagggaggtgagctggccccgaaacccagtgcccggactccaaggaaggcaagggcctacccggtcccatcccacacctgaccggctggcccgcggggcgaagagccagggcggacacgcgatagcccgccacattcctccaagacctccctgcccccacacccactgctgccaactcgagcagaaaacacatcctcaggtagcgatgtggggccacgctggctcaggcccaggtgcagatgacaggctgcgggccctgctcagacctgcctgctgcaccgccgtgggggcgaggggctgggcttctcacaactgcctgggccctcccatgcccgcccctgccttttccatctgggggacactttcccctctctggggcccccctggtcaagggatactcggcggggtgctcacgggttgaggacatggccagaggagactgtggccagcttccacgggtgggagctcaggaagcggtgaggatgggggcagcaggcaaggctgccagccagggctgcaaaggtacagcacaggactgggagccacacacggcaggcccaactggcgtgagctcggcagggattgccctcaactcacaatcacttcagggcccaggataccaggtgggcacactccggtgcctcctgctgactggagccacttcctggctcccagatccatctactccctgatcacaggtctgcatggtgctctcattcccgcactcacccagttccaggcccccagcacaatgaccaagcagggaaggacctctgggcaccagggcaaggccgtgctccaggcaatgaggtaaggcgcccgaggcctgggcctgcccacctaccactacccacctgccagcccactgggatgagtacctgtttcccagtgacactggacccctaccacccctcctcccagcacgcccaggccagggctcctgcctgactggccacctgccaggggagaccagacagccccgactcagcttctgcccctccagaataacaaaaccaaaaaaacccacaaacagggcagtgccacagaaggtcactgcaccaggatccactatctctgtctctgaacgatcttgggtcaccatcgggggcttctgccgacataagcgttaggcgttaggctctcccgggcctaggtcccacggcgcccgcccgtgccccccaggcatccaggaaactgcagggcaggcgcaggctggccacgggcccggggcggctcagtcagggcctgccctagaccagccccagcacgcgctgcgcacatgccaccgcggcctgcccgggaccggggcgcctcgcctcgcctccccacccagacagacacgcgcagggcgacgcaggcacacgccgcacaccgccgcgcacgcgggacgccgccgccccgcccccgccgcgaccccgctcccggtggccccggggccccggcgcgcccacgtggccaggcgcggaccaagtccccagagcacgcgccccctgccggccccgccccgcctgggcgcgcgcggctcgcacgcagacccggccgcaggtgttgggggtcgcgaagcgcgcggggccggggcgcggagagagagggaagggctggagcacgagggatggagcgcacgtaccggccaggcgaactggaaggggatgacgacgaggcccgggtcctggtcgccgccggcccgggcccgcgcccgcgctcggtcccccgcagcgcccgccggcggcaggtagaaggagttgccgcccagcacgggcgtggcgccgtggccgtagctgcagggccccgtgggcgtcaccttggcctggtactccttaaggcacacgcgcacgtacgtgtcgcactcgtcgtggccgcagccccccgcgcgcgttgtccggccgtcgccgtcacagcaggcgccgctcagcagctccccgttcacgttccgcagcgcgctcagctgcagctcgaaatagcccatgggccgcgccgcctaaaaataaggcagcgggagagcggagggaggcgcgggccggggtcggcgggccgggcgccaggggtgggggaacaggccccgccgccccgcccccacccagccgcgcccgcccggagccccagccgccgcgcgcagcctcgagggcttccgaaccacggcggccccaggcagtgcccgcccggcccctaggggcggcccggtgtgccccgtccgcgacccccgccgcccccgccgccccgctcacctgcacccagagcgccagcagcagcagcagccgccggggaaggcgcccccggccctgcgcccgcattgcccccgcgacccgcccgcccggccccgccgccgccgcccgcgcccggctcccagccgccgcgccggcctcccagcgcccgcccgccctccgagcgcccgcagaggcagcggcagcggcagaggcggcggcggcggcggcgcgggcggggtcgagcgcagcgccgcggcgcgcgggcctgggcggcgggcgtgcaggggcggcggcagctccggctcgctggcggccgcgctccggctgcccggcccggctcccacccggcggcgacggcggcggcggtgaaggcagcgggtcccggcctcggctctgcgcgcccgcgctcccggcaccgcagccaacaagttcggaacgagactgacagctcgctcgcccattcgtcacccgcgcacctgcatatgcatgagggggcggggccgcgccgcggggtggggccgggggggggtccgggggcgccccaggctttaaaggcggtggagggcgtcgcctgccagcgccccggcccggcgcgcgccccccagggcgcccgggcggcgggggcacggggcctcggggtcagcgcgggccgcgggggccccgctcacacctccgcgtgagtcggcgaggcgtgcgccggcgccgcaaagctgcctcccctcctccgcctgggctcctgccgggtgtcagaaaccgggggtggggcgccccgaggttgccgtgtggtcccctcccatcagtgcgccaccgccgcgctcctcgcagtcccagaggagatgccgcctcctactctgatcagggctcggcccccacgcggggtggcgcggccctggggccagagccgggcccagcccctactgcgcgccccccacctcctccgagaatctccccttctccgcgccgctcctaccgcctccacgccggctgcagggggcgctgcgcccctccgacgcccctgccttcccctctgcgaggcgcgctggtcaagcagccagtcaacaaatgctccagggtgcagactgctcagctcggcgctggcgtcgaggtagccaggccatgccctcaggaaatgctcaggccacattccccgtttcccgcctctcgccccccaaactcaggtctgggcttggggggcgagaggcgggaaatggggaacaaaagtcggcagtgcctgtccctgaaggctaccccgagagaggcctcccactgctgccctggtcaccaggcttccacaccccatcctctgcggtcacctccttgccctctccctgggtgacctcgcagctcctccacagggtcaaaaccaatggcaccttcctctcctccagtgagcacggtcctttccagagctaggggtcaccttggtggttaaagatccccatatggtccagaggggtcctcaacccatccccatgataactgagctgtcttctctccccctagctcctctcgcaaatttgccctgtgcccggagctgggtggctgtgcagccccccagcctggagcaagtcactgccaccatgctgctggggctgagggctgaaggaagagagctttggaggcacagggcctgtgaacaccccatgcgcagggtctgcctgctccatccctgtttagcagctcctccaggatccaggccgcaggctcagctgaaggtccctaaaggggtgggtgggagccccccatgcccacctcagctggctctgctcagagtgcccaccccaaacttggtggtgggtaggcttcgtggggattaagacacaagccaggatgaggcccgcacagagacccccaccaaacaagagaatccaagctgtgttcagagccttccagttgccgccttccggtgtgtgggcggtgattaccgcctacggggggaggggctccctgtggagatgccacctctcctgtgctttggcctgggggcaggtactcgggtactcgagagagggaagccccaggacagagaagccccctgcccggctccagaggcccagggctccatccccacctgcgcccactgccccactatggtgggggagggggtgctgggtgcctctgctgggcacttggccaagtggtgaacaagggagactccgcccctgcacaccctcaggagcccccagcccgggggtggacagaggacttagacaagtcatacagaagctggcatagggggccgccagagcgtggacgggcatgggtcagccagacctcacgatgtccatgagagcacccaggtcaggaaggtggccgcacctgcccttaggaaggagggggacataggaggcatcggagagggggtcccttccctgcaggaatttcagcagcccttgagccagaaatgccaggcagctggaccctggtttgagtttccagaaggcagcagtgggaaccctcgcccctcatacatatttcacaaaacacatttgccccctgctgcaccttgctggggtgaggggctgagatcagtggcggccagggctccagccccaaccctcaccagaccaggctacctggtctcttctagtaagggacctcgtcattgttctggggcccactggaccacagcaccctccagcctcccagagccacccgtcccccagcctggagggctcccactctgagcgctgggcggtgcccagcttgtatgcagagggcaagggtgcagctgctcagcctggccaggggctctgggcccatagggcagtcctggggaccaggctgaggacgggctgccaggggtttggacagagccggcgaggctccagagtaagctgtgcttccgctgggtcctgcagtgctaaatatagcagacggggaggggagtttccggttacaaccccccctccagtgccgggaaatcaatgccagctccattaggcccggcagcactgcctgctgacccaccccatcgggctgcggagcaaagtgaggggctggactacacccaggtccgggtgccctgtcacctgtcccctcagtgcttcaggggccagacccacctggtgcctgcgagaggtccctctgaggtagtgggaggcctctgctggtcaacccggagggcccatcgcactctcgtggtgtcaccaggcaggctgctggtaagggcagcacagcaaggctgctgtgggtcaggcagagctcctgtcctgtgaatgtcctgctggggcctcatctgggtagagtgaagctgaggctggccaagacccgcacaccccatacctggcagcccctccctggcacacaccccatacctgacagcccctccccggcagccctgtcgctggccttgctgatgcccacagggccccacctgggccacagccagcatttgcatacaggtggcactgcttttgtgggcccctgaggcacagcctcctcaggacagcctccaatgccaggctgtccagcactgtgctggatgacaacagggggtcagtctccacctccctgcccagggttccaccctgcagggtactgaggctcccttcacttcactgtccccttctctactttcctcctgggagccacagcctggacctaatgatgtccaggagcggatcgatcctgccgcagactgatggcccagcagtgccctcgaatgcccacaaccagtgccaacacacccattcacctgcagaacccttactgtgcacctgtggcccaggaagcagaccaggcgagctgggtcccctcctgcctcacaagcattctgggcacctggggagcagctctgagctgcacgcatctcccacagccccaccctcaggacaggtcagaaggcaaggccagggcatacaggccagagatgctcaggggccagtagagcctggtgctgggcggcccaggctgaggccgtgccccgggaccaggaccgggctggcaccaggaacctggcccatgtcaagaccactggccttgtgtccccaccctgtgccgccacctgctcctcttggagcaagcctgcagacatttctgcataccccacaggccgaggaaggtcccttggaaaacttccaaggctgggggtgcacggatcagctactggggcccccgacacagggcagctttggctccgggctcctgtggagtggctctagcccagccccagtcagggtggggacccctcacttgccccaggagcagggaacatactttccctgcagcgtgcagcctgcagtgctgcccaccccatcctaactcctgaggactggctcagccaccactctcgtgagcacagctcatgctgcagccccgtgaccagcaggcccacccccaggcctgccatgccaccctccatgagtcccggaccccacccctcccagctccaagaggaggcacagcctggccctgcccatggcatccccaggcctgtcctcagccccacagcaaccacctgcatggcctgccaccagctactcctcctacaggagagctcgccgtgtcccgagggccatctcaggtcagggtcactgcttcccgccccttccccagtcctctccaaggccctggtcacagagctcagaaccagcaggcagaagctggagctatgcaagcctttattggggtccgcggggtgtggggtgagtggccaagactggcctctgtctagaaccctggagtctcactggagatccaggttgggggccacctggctgaggaaccatgagacaccaaagatgacgccgagggtcttggggatgtccgggtcgtctgcaaaggcctgggcgccttccaggggcaggtgcaccacctcaatgagctcaccctcctccaccaggcccccacctggaccgctacgctgggcatctgtcacctctgtgtagaacatggtctgtctggagccagtcagtcccactccagacctacgggttgagacagggtctgctgagtcacccacgctggccccgctggccccctggcccttctaccaccctccaacccaccctctccactctgctccctccagccctccagtaggcaggactctgggatgccctctcccacccggattcccacctggtgtgcacgcccgtggcccctcccgcagcagggcatcccttccctgatcacgttgtactcgccaggtggggtgggtgttgtcgatgtgattaaggaccctaaccggtgacttgagctcatcagaagggagagcatcctaggcgggcatggcccgatcacgaagccctccagagggtgtttcaacgccagaaagggagaaattcaggccagtcctgctggccctgaaggggaagcaaccgccatgctgggaagggccaacagccagcagggaggtgggacccagtccccagccaccaggagctgaattctgccataacctcgtgagccgggaagaccccaagcccccatgagattgcagatccggctgacaacctgcctgcaacctgtcaaggccaagcagaagaccccacccctgtctgcagcccccaaccagataccctgaggctgttcccagtgctgtttggagcccctcagtctgtggccagctgcagaggcccatgccagaccccagcccatacccggggacacaggctggctgggaagcagggacaaacccaccaggccttcccgcaagggttccccaccaggcacccacaggacacaagtttcagactaggaacagcatgcactgaccgcccccccaccccccgtagcatggcagagtggggtggggtggcagcgaggtcctcagtaccaggcccagtggcccaggctggggaggggtaagaggaagccccctccctcagtgggcagtggccagaagggggctgctggcagccaggaggggtcaggcaccaagggaaggagcctggactggcgtgtgtggagggagaccacgggctaggaggacaggatggcagaggggctgggctgcattctggaacaggagggggagggccaggtgtggatctggggagaaacgggactgaggggcatctgggaagatgaccagggggtgggggagccctggctcgccgcaggaggggctgtcgggtgccatgaaccaaggccagccggaggcctgcagggtagaggccgccctctgagatgtacccaacatacaggggcagggacagaactgggggcttccatgccccacccccaaggcctccccacctccggggggactcaccccagaccgaccttacccagctgcttccttgccctctagcccctcacctcccgcagaccccttcctgatggcccatttccggcggcggccgcggctgcgcctctgagggaagtggcgggtctggggtttccagccccggtttccgccggcttgtgaaggagacaggcccggcccttggcccgggctgagaggaatctgccagccaggctgggcaacgcctcccccaccccagggcacgttccaacttcactccatcacgccccaagctgactgcctccctgggccttgtcctttgcagcggcaggtaagaggcctggctcacctccagaatcagagacagggagccacgggccctgccacagggtgggtgaactttgctgtcagtccagccccccatcaggccctcagagacggacaccctgacccctagtcagcagcatctccagtcctgcatccctgaagccacggcctgctcttcccgatgcgagtctaagcaggatgcctacttcccagagccctccttggctccccagcaccctcacaatcaggctgtggcccagaggctgtaccagtagaaccaccgcggccagggctgcttgaccacttgccctgagagcctgtgcggtccctctgccaggaacctgcccaggcccacctcctccagggggaccaaggggactccagcccctcccatgcctcccggctgtgctcagtactatgggctggggagctgggggcacagtgggcgtggcccaccacggggtagacacctgcagaaaaccaaggcccatccttcacacccaagtccacccttcggcatggaaattctgttttgttgagacagagtttcgctcttgttgcccaggctagagtgcaatggcgcgatctcggctcaccgcaacctccgcctcctgggttcaggctcaccgcaacctccgcctcctgggttcaagcgattctcctgcctcagtctcctgagtagctggaattacaggctcctgccaccacgcctggctaattttgtacttttagcagaggcggggtttctccatgtggtcaggctggtctcgaactcctgacctcaggtgatccgcctgcctcggcctcccaaagtgctgggattacaggcgtgagccaccgtgcctggcccagcgtggaaatgctgcctttaacttgggagtccacccatccagccaggaacgtgcccaggtgaagtccttgaggctgctgaggtgggagggccccaggctcaaccctgagtggcccatgtgccaggctgacaggtgcagagacttccggtgcttctcccagtggagcgggccctggcctctggaggaggctgtggaggctggtgctcagctggtgggggtgggggtctgtgacaccctcctccttccccaagacctcagctggggtcaggagcccatcgtagcgtccctggggaagtggatgggcttcataccaacatctagtcctgggaaggcaaccccaccccagctggcagccctcgcggggcaagagttggtgcctcgagtttggtgggtcaggtcccaaagcgcaggctctagtgcctgttccccaggagagctggagccaccccttctccagcccaggacacagcttctccctcattcctaagccaccctctgagaacagagctgtgagtcacccccacccccagcgcccggtcttaatcctacaggaagtagaggcacctgtcagcagcagctgtcacccggcctgcctcacacagctgggggccgcaggctgggggcatggggccgagacgctgcagagagagccccaagagcccagattctggcctggcttaggagctgaggcgcattcggtccaaccctcccctaatcccatgttggaaaacaaggaggaatccatcctgcttgcacactcccagggacggggccctcactctctcccatctcctgagtcacaccacaggcctgagggcctggtcccactcaccagtatgtggcgacccggcgcagatcagagggggccaagtggtagccacactcctcccaagcctccttgcaagccacttcctccagcgagagcccaggctggtccacgaggccggcacacagctcaactgtcacccccgctgagccgggcagggctggctgtagctcccgaggcccgtcctggtctacagctgctagggaccctgggaagcggcgctccacctcacccgcatacacagctgcgtgggaagaagccagactgtgctcacagccacgtggtggccacctccaggtcacccacacagccaagccccctcccagggcctcagcttcccctggagccccctcccacatctgtattcagaccctcaggaccacagggacctgaaggtgaccctgcagatccccttcccaccccagctggcctcacctggccggaactgcttcaccaacaccaggctcctccgagaagagttgaataagagaacggtcacgctgtgtacggggggaggggctcagcacagaagcactccactggccctcgtggggccccacctcccatctttctgttcccagcgtggccatcccacctccttgccagcagcccagggaggtcaggccccttgctcagataggatggctgaggcccaggcgggaccagagctttccagggtcacagtctggccaggacccagacctgctgtattccagctggcaggatgggaggcggggggcagggaaggacacacgggcagctgagtaggtcagggtgctcgcagctgaggccgggtgactgacaggacgtttggccctcactgagcagctgcccaccagccacactcctcgagccacgtcgccatccagcccagaccctggatgctaggggcaaaggctccaggacagcctctccctgccctgagagggcctgcccaccatcatggtcccggtggcctgagcaaagacctgactcagcccccaggcctcaggctgacccctcagggataggaaacccagaggccgggcagagagaagggacttttggagcccacgcagggaacagcaacgtcagggaggagagggcaccttcgccctgggcccagtgtccccgtagacatcagtctggggcttccccagtggccaggctgggccaggctctcacctgtcatgcgtcttcatgaagtcccaggacttctgggcaccattctagaaggggcaggtcagcggttagaatgtcccaggatgggcggaggtgctcggggaaccgaggaggccacagacccattgcacccactcctaaccagggagatcggctcgtggcctgggcccacgggagccaggaactgcagctcccgtgggcagaggagcaagcagcctgggaggggcagggaggtcaaggacagcctaataccctacgagtgaggcagaagaccagggcaaagggcagggaaggtgtccaggcacctcatgaaacactgcccagcacagaccgagcacaaggggctgcagagagacgtacaccgtcaccaagtataggaaggctcatggaggctcggggagggcaggcgtgactccctcacagcagggcaggagggccctgcaggcagaggagaggtcaggttttcctgctgatgcttccttgggccactgaacaggtggagacgggagggcaggaggggccggcaccaggagtggatggggaagggtggcaggaggggctggcaccaggagcagatgaggaagggtggcgccccagccaggtaggagatcgcactgcaggactcggtgactgtcatgatggtgaccaggctcggcagcccccccacacacccctacccccagtttctggcctcgactctcccacataccctgtggtcccgttctcctgtggccaccctccaccttcccactcccccacactgggcacaccaccctggcaggcccctgcaccctgggtggcactcagtgaacggaggaggcagggtgggcaggtgtgtgggctgggcctgctgggggaggctggaactgatgcattctgagatgcactcccatcctgggggctgagcctggggtcccgcggggtcccatctccggcacgctcagcccatctgccactctgaggcccaggccagctgctcatcccccaccgggggctctgcccagggctgtgaaatggacaagaggtctgagcagcagagacacagaagtgcagccaggactgcagaagagagaagaagccttcctgaggactttctggaggaggtgacggaagtgagggaagggactctgggcaggcagaggcgcagaggccctctgagcttggccgggaggcaaaggcgtcctgggaggagagtaccggtttccaagggaagggagggccggcgtcccgcgcaggtcaggcagcccgagaggccgtggggtaccactcccgggaggcgaccccaggcctgcctgacacccagccacccccgaaccaccacccagccagggcaggctccagggaagccccctgcccacagcctgccatgtgcctgctgtgcccatgccccttccccaccactgcttccccccgagtaacatcaccccatgcaggtctcaaggaccctctcagctcaaggtcaaaagcgtgtcagacccttaggtccagccaggtcaaggtgcagggaggtttagggaggctgctgaggcctgggagggaggggcagggctgggtgcaaagaagaccccatcgcctcggagccacgggggtcccctgcctttggtctgcctgacatcacaggcctcccctggctggacgcagcaaaaagctgagggctgcagctgcccctgggtggcagccagcgtccagcccaatgtcccttggccctgaggagatgccgcccagcccgagcctacatccgtgtccaccacagccacagcccgaaccagctcagctctggtcaccagaacccttcagcagagctgtgccggcgggctgcccgctgaggctgcaagggctgccctgaggcttcacggggagtgagggagagagtgctgccaccagggccacagagggcacctgcctgggcctgcacctgctgcctgagacccagccctgtggggactgtgcagccacaagcaggcatcccatatggccaacgtcagggaaaagggcagtgaccccatgtctccacctgctgtaccccgactgatcccagctgccccctgccagcaccaccagcttagcttcgccttggggagagggatcccctgtcctccagcgccaacaggactcccgcaacagggaaagtgaggggcacagggcctctctcaggctgggggccaagagggcttctccaggatggcgaggggcagagtcctggatgtgatgggggggacaggatgccccctgagggagggaggcaggcaggcagagaggcactgcgacctggaccacctgacctgataggctggggggctggactgactgtgaccaggaaggtggtctttgccttaatggcatgaaggagctctggcagaggggagatctgctgggggcaggtgggcatgcaagcaaaaggtggggccctaactggacagggctgggcttggaggaagacggcccgggactcagtgatccactggatgtgggaaaaggatggcagcagctccttcacccaacacatatgcctcatgcctgtaatccccatgctttgggaagccaaggcaggaggatcggttgaggccagaagttcaagaccagcctgggcaacagtgagacgtcgtctctacaaaaaaatttaaacattagccaggtgtggtggtgtgcacctgtggtcccagctactggggcgggggctgaggcaggaggatcgcttgagcccaggaggttgaggctgcagtgagctgtgaccatgccactgcactccagcctgggcgacagcaagaccctgtctcaaaaacaaaacaaaacaaaatattccttgtgaacctaccatgtgcctggtgctaagtgaggcaatacagcctcttgtgccgtggcctggcatgggagaaggtgacaccctaggaggtggggaaggctgagcttaggcagatggagactccaaggaggtgccctccctggaaaaaaccccaaggaggaagcctgctttgagaggctctctcaagttctcactcagctccttctcctacctccctgcgcccggcctctgcgctccttgctccctcctcctcggcccagctatctcctccttcaagtggtagcatgaaagccaccacttccaggaagccttccctgatccccagggcaaccaaggagttccactgccaagagggtcggattgggcgggcgggaaggatggggcccagcaatgcttccttgaaaggatgagtggtgccccctcagatgtccctcccgcggcccctccccggcctgggggctcactgggtctgggaacccgcgatccggcgggcggacaagcggccgcccgggagatcggcgggaggcgggggcggggctccggggcggggccggcagcgcggaagatggtgggcggggcgcgggtcgtgggccgggccgccggcgggggcgcgggggacgcgggggcgcgggctcacctggcggtaatgcagcgtgagcggccgcaggtagggtgaggcggcgcagcggcccacggacgccccctcgatgcgctccatggcggcgcccggacaggcgggggccgcgagctctgcgggggccgacacggggcggcgccctgtcccgacaggagccttcgggcgggcgcgtgaccgcggctctgagcatgctccgtgggcgcgcggggcggggcggccgaggtgggcggggcggccgaggtgggcggggctcgcaggtgccacctgtcgggtgccgcgcgcctcggggcgctggtcgccgcggtgccagggaagccgcgcaggcacgtgggcgtcgcccgggggaaggactggccgggtcgaccccggccgccgggcggggccagccgggccggggtacagtgcttgggtgggactcgggacctcttggctgggggagggagggcctggcggtggttggagctaagggcctgcagctttggggtgcgatgggccgagcggatgcctccccactctggggatggaccacaaccccgagattaagttactccaggggtccgcgggcggggccgggggcggggcagccccccagggagggagggactgtgggcccaggaagaaaatcacaggagaccaaagagagagggccctggaaggaagctaggggagaggagagtagggagctggaggggccagagcttgggccgagggggcctcccctcgaggttcctggtggcgagggtggctgggagctgccacgctgtctctggagctgtccctcctccactcaaaagccagctgcccttccctccccctgcaagtcctaccttgatgacggcccttcctgggtgtgggagggtcccaggcagcttcagtgcttccttgggcatggattccaaggaccccctccaaatgccaccacggcctccacgggggcaggaaacaatattgaggcccacactggccctgaaccctgacctgcacctgctttctgaactatggcccaggggacatgctcagggtggactggccatgtgagcttgaaatcgactcccagttccctgttaactattgccgtgtaacaaaacactcctccaaagcttagtgccttaaagcaccccgttatcgcctggcctgtgggttgcccagctcagccaggcagccctgtcttggggtctctctgcagttgtaatcaggtggcagctggggctggagtcgtctgaaggccaaacggggtggaccgtccaggatggcctcttcgcccccgccctcagttgggtggctggaacagctagggccggctggcctcccatgtggctggcgtgggcttccctgcagcatggtggtctcggggtagttggattctcccgtggcagctggctccctccagagcacgttcaccaggccaggccaagctgccaggctttgtgtgacctggcctcagatgtcatatggtgtcattcctggggcatcctgtgggtcagaaagtcctgggcctccggcagattccaggggagggacatcaccaggtgggaacgctggggagcacggtcatgaagccagcatccaagtccagctgtcaccgccccagtagctctacaggggcctgtgtctccctgctttagccattccgcctggtgtcccggaagccagagcgcccagcccagaagctggccccaccctaccccacagccaggcaggcctcttcctccggtgcacgaggggcccagggtaagcgcgcaccctggcatgtcgcgtgcaggctccttcctgcccgtggttgcatggaaaatgaggatgagtctcagcttccagcagcagcagccccgggacaggcagaggcaacaggagccccatcaaggagcccctgggagagccagcagctcctcaaagcaccgtgctcctcagactcactcgggtccaggtgtctggcagtgcagactgcagagctgagtgcctgaaaatatcagcaaggagcccactgtgggacgcagcctggcggctcctcaaaaagttaagcatagaattaccctgtggtccagcaactgtcttcctgggtatccacccaaaggagttgaaaacagacactcagacagatgcttcctcacagcagccaaagggaagaacaacccaagcatccgttgccaggtgaatggatccagaaaatgcagtgtagacgtgtaaggtagcacaactcagccatgaggagagaaattcccacacaagcgacagcgacactatgctcagcaaaagaagccagacacaaaggccgtgtcctctgcgattttgtgtatatgaaatgtccaggccgggcgcggtggctcatgcctgtaatcccagcactttgggaggccgaggcaggcagatcacgtgatgtcaagagttcgagaccagcctggacaacatggtgaaaccctgtctctactaaaagccagccgtggtggtgtgtgcttgtaatcccagcttctcgggaggctgaggcacgagaatcgcttgcacacgggagggagaggttgcggtgagctgagatcttgacactgcattccagcctgggtgacagagtaagactccatcaagaaaggcaaaggcaaaggcaaaggcaaagcaaggcaaggcaaggcagagaaagggagggagggagacaaaaagcaagaaagaaaaaagaaaatgtccagaacaggtaaatccatgagacggaaaagcagctgcggactggtggggctgagggcgggagaatgaagaatgctgactaatgggtgccggctttcctttccgtttggggtgaagaaggcattctggaagcaggcagtgctggtggccgcacagcagtatgaatgtactgaatgccgctcagtgtgcactgtgaagtgtttaatgttctgtgaatttcagttccattttaaacaaattttatttagagatagggtctcatgatgtggctcaggctggacttgaactcctggccccaagcaattcccccacctcggcctgctgagtagctgggactacaggttcacactaccatgcctggctcggttcaatttttttttttttaaaaaaaggaaaaaccagtgtcactgaggctattcaggaacattccatgctgtctatgaccacaaggccactgcccacacgtggagctgaggacagggcaagtgaggcctgctgtccctccgagatggaaagggagaaaaggcagaagcagcccaggcactttaccagttcctgctgtgcactggggtggctcgaacaggtgattcggggcaggcctgatgtcacaagaagttaggacaggcatgccaagaggcagaggacagcctccccgaggacacgacactccccagaaacccgaagatccaaggcaggagaaaggaagctgtcctggcaggaggagaccgaggccagaagaggcgttgtggccctgggggcagctcccttggcctgtgcttggcacatcccctggggccactggaagtctcggaggggttgggcagggcaggtggtcagatgcccctctgggaggtcaccgtggctgcctggggccgggggaggaggagactggtccgagggcctttggctgttgtccagagtggtggctgtgcagaggatggcttcgttccccatggaagcaggtgcaggaggaggaggaggagcttgatttggggaggggctccaggagggggaatgagaggactccgtgtggccaggtggcctgagagccacagtggagagctctgaaaagccacctctggctttggcagtgtggaggcttcaaagaccctgctgagcatagtggcagaggcccctgcagatgccctgtagcggggccagagggcatgtggggtgagagcaccagtgtcagctccccagggctgccaagacaaaccactgccaacccagcagctgggaacagcacggccatggccttccagccctgggggacgggtgtccaaaacgcatcccaccgggtgaaggtcaagggtcacagggcggctccttctgggggctccaggggaagatccattccttgtcttctccagcttccggaggcggcccccgccccctcctcaccttcaaggccagcagagcgcccctccgtcctcccccgactctgcctccgtcctcgcgtctccaccctcctgctccctcttctgaggtccttgtgaccacaatttagggcccccccgggtcatccggggccatccggggccatctcccacctcgggtccttctgttagtcaaacctgctaagtcccctttgccacagaaggtccatactcgcaggttctggggatccaggtgtggactctggggaggatgcgtcgggagggcatcaccaccagggcaggaccctgtggcgccaggatctgcagcctggggcctcgccccgcagcaagtgggcgggtttcttgcaggacacctaggagaccgctgtgggcttctgtcccccttcctctgtaaggggagtgaggcaagggcccctgccaaggatgagatgggaggggagggaggcgaagtggcccctgttggcagggggcttgggtgcgggctccgagggggcctggggagcaaggcttcctggtggcaccgggctggggatgctcctgggccatgctggaggcagggcaggtacaaggggggcccctgggctcctccatggctcagctccttcccagtaaggtcacaggcagcaggtggattggagagttgaggacactgagcagggagctacaggcatgacagagcccaggtgggggtgcggggggtggggaggacgtgggggagtcaggggcgggaggggtgcaggaaagccaggggcggggattccgaggtaagtgcagagggagtgtcccgagagaggctgagttgaggggaagctggaggaggatcaggatggggggtcaggaggtcgggggtgtggggcacagaagtccactgggtgtgggcaggagttgagtgcagagtgctcataagtgagcagagtggtgggctccaggactggcagtggggtgctggggggatacagcagagaccacacccggaggagcagcagggggctgggccgtgtgtgtgtgtgtgtgtgtgtgtgtgtgtatctgtgcatctctgtgtgtctgtgtgtgtaatggagagaagcagtatgtgtgtgtgtggaggtgtgtgtggggggctgtgtgtggggggtgtacatgagtgtgtggggggtatgtgtgtgagtgtgggggagtatgtgggggggtgtgtgggagtgaatgtgggggtatgtgtgtgggggggtgtgtgtgtatggggtgtgtgtgtggggtatgtgagtgggtgtgggggtatgtgtgtgggggggtatgtgtgtgagtgtgggggagtatgtgggggggtgtgtgggagtgaatgtgggggtatgtgtgtgggggggtgtgtgtgtatggggtgtgtgtgtggggtatgtgagtgggtgtgggggtatgtgtgtgggggggtatgtgtgtgagtgtgggggagtatgtgggggggtgtgtgggagtgaatgtgggggtatgtgtgtgggggggtgtgtgtgtatggggtgtgtgtgtggggtatgtgagtgggtgtgggggtatgtgtgggtgtgtatagggggtgtgtgggaggtgtgtgtgtgggctgtgtgtgtgggggtatctttgtggggggtatggggggtgtggggggtgtgtgtgtgtgagtgtggggggtatgtgtgtggggcgtatgtgtatgggggtatgtgtgtgtgagtgtggggggtatgtgtgtggggtgtatgtgtatgggtgtgtgtgtgagagtgtgggggtatgtgtgtagggggtatgtgtgtgggggtgagtgtgtgggtgtgtgtgggtgtgtatagggggtgtgtgggaggtgtgtgtgtgtgtgtgggtatgtgtgtgggggtatgtgtggggggtatgtttgtgggggggtggggggtatgtgtgtggggggatatgtatatgtgggggtgtgtatagggggtgtgtgtgtgggggtatgtgtgcgtgtgtgtgagtgtgggggggtatgtgtggggggtgtgtgtgtgagtgtgtgtgcagccaagcttctgcactgagtaggaatagggcggcttcactaagcaaaggggctgagcaggttggagcacctgcaacccaggagtgcgctgcagaagaggctgagtacacaaaggcttcctcccaggctgaaggtcctgccttcgtgaggtgcttggcagggagagcctgggaactgctgttttttctgggcatctggaaaagccttttcttttcacctatgatagggagttttggtgatgataggttgttttttgtttttctttttttggtgggggtgttgtttttgttttagacagggtctcacccttgcccaggctggagtgcagcggtgcaatcttgattcactgcagcctggacctcctgtgctcaagtgatcctcccacctcagcctcctaagtagtgaggactacaggtgtgcgcccctatgcccagccaattttttatattttttgtagagatgaggtctcgctatgttgcccaggctggtctcaaactcctaggttcaagcagtcctccctccttggcccccacaaagtgctatcaaggcgtgagccagtgacccagcctgttttgcatgtcctaagctatattatcttttgtcttgcctaatctcacagtgggctcaacctcaccctgtcagctgaaagtctcaagagaagagaactgaacagagcctggggtcaaggtgtcttcagcctcccggggacttcacaggagccattcagggccatcagtgggtggggactagaggattctaaggatacccaggtccccacagtcagggcgtgtgacgaggctggcaggggctgctctgcagttctgcttgtaaccccccagcgcctcgccaccgtctcccaggtcccaggcatgagtcagagcaggtgcggtggagaagcagcatcctagctgcaccacgggcgccacctgctgtcacaccctctactctcaacggccagctcccacgtgggcacagctggcctccagacacctcccttcacagccctctgaaggctccctccccctgctctggtggagcccatcctgcagccacttcctgcgacagggtgcgtggaagacacattttgagcaccgtgcctatctgagaatgtctattacactctcatccttgaatgatagctgggctgggtatagaagtctaggctagggccaggcgtggtggctcactcctgtaatcccagcactttgggaggctgaggcaggtggatcacaagagaccaggagtttgagaccagcctggccaacatggtgaaaccctgtctctaataaaaatatgaaacactagccagacatggtggtgcatgccacccagcgactcgggatgctgaggcaggagaatcacttcagcctaggaggtggaggctacagtgaactgagatcacgccactgcactccagcctgggcgacagagcaagactccatctcaaaaaaaaaagaagtctaggctggaagtcactttcctccagcattttgcaggcattgcttcatcgtctgtctgtctccaggggctgcttccacttctcaggccattctgaggcccgtttgaagacgtaacatgtgtccatgtggagaatgttctgtttgccctgttcgcggtgttttccacattgtcgcgtcttggcttggggatgcttgagctggcagtttctgaaagacgagttagagataaaactgaaataggaggcgacatctaggatcgacttcaaaataatcacgtcgggagagggaaaggagacggcagaactggccccacgctgaagaccactgaggccttctcaaaaaaaaaaaaaggggggggcatagtgtagagaggtggtgtgggaaccggagccggcccagaatggtggtggggcacgtcactcactcctgtggcttctgccgccgagtgtggtagaaactatgagagcgggggtggtccgcacactgtgtctgccacaggcccgtaatgagccgtggccggatccaggatgtaacccaacagcagatccaagaagagttcaacatgaaggaaacaggagagccagagatattccccaggttttctggcccaagcacctgggaggtgggcccacctggagcaagggcagatgtggtttgtttgttgtggagctgggtggagtgcgaggcgtccttgggaaactgggtattcacatgcaaaaggaggaagctggatcttcaccaaccaccctaatcaccctaactcgggccaggtgtggtggtacacgtctgtagtcccagcaccctggcagaccaaggtagaggctgcagtgagcagcgatcatgccactgcactccagcctgagccacagaacgagaccttgtctctaaaaaaaaaatagattaactcaaaatggatgaaagacctaaatacaagagctacatccataaaactctgagaagaaacagaggaaaagctccaacacattccgtttgatagtggcttttttgggtatgacaccaaaggtacaggcaacaagataataaatagacaaattgggctttatgaaaatttaaaacttgtacctaaaacagctgaagtccatcgatggagaaatggataagcaaagtgtgatatatacatacagcggaatattacttagctttaaaaaggaaggagattctgactcatgggtgacccttgatgacattatgctgagtgaaatacaccagtcccaaaaaagacagatcctgcccaagtccacttataggagatcctagaggagtcgaaggtataaagacagaaagtggggtggtggcgccaggggctggggagcatggacgggggcactggtgttgaatgggaaccgcttcagttttggacaatgaagggctctggaaatgatagtggcaaaagttgtgcgccatcaatgttccttcacaatcctgagctgtttacttagaaatggtcaagatggccgggcacggtggctcacacctgtaatctcagcactttgggaagctgaggcaggcagattgcttgagctcaggatttcgagatcagcctaggcaaaatagcgagaccctgtctctacaaaaaattagctggacgtggtggtgcacctgtggtcccatctacttgggaggctgaggtgggaggatctcttgagcctaggaggtcgaggctgcagtgagctatgatgtactccagcctgggtgacagagcaagacccatcttaacccccccaccaaaaaaaaaaaagatggtaaatgttgttattgcatgttttaacacaatataaaacacacaagcactgttggccatggttgactctggtagggaatgcactgttcactgcatacttttaggtgctatttaaattttaccatggcatgtattactctttcaatttaaaaaacttttaaaaagtggttaccatggtacattttacattgtgtatcttttactacgatgaaaacaaattggaaaactttgtgaagtgtcactggctatgtacacgaaagctggagcgtgtgagtcgacccctgcaggtggggagggccctgaatcagtgctccaggggcctccctgggtgagaagggctggggagcccataggaaaggtggaaggtcccccaggcagaacccgggagcagcagcagaggtcgctgagcaatggggagggggttgctgagcgatggggagggggacactgagcaatgtggagggggacactgagcgatggggagggggtcgctgagtgatggggagggggtcgctgagcgatggggagggggacaaacgtgcctttgagccccagggcctgttgtcagatgcctcgatgccttgggccccaccctcctgctggagctgtgagcccttcctgctcgagctgttcatctttaacctagggaaattctgactttgtattttcaaagagtcctcctccagcgacctgttctccctggggtgaacaggaggatgcccacacctccccaggctccaagaccctgcccccaccactgtgtgttctggggaaaccccaccaccacccgtgtccagctctggccccttccccggggcacctctgagcctctgggtggttcttcctgggcctctgccctgccccggcccctctgtgcatgcctagtccacctcttcttgctggcataggtgggcactttgcttctttctcttccagggctgcgcacctgccatgccagccgcctccccctgagacccatctcccccgggaacagacccacaaggtgggaggtgatagcacccgccgacggcacacaggccctctgagacccgcagagccgaaagtgcctgaggggctgggcccaggtcctctttgcccgcggcgtgttccaagcctgtggacagttctcacttagtcctgtctcctctgttggtctgttttgctcccgaccgtggttccaggactacgaaggcaacagaggggcgtcacgtgttctgggtgtgccccgacaccccatggggcccctgggacaccagggcagcctggcgcaagagagggtccccgtcatgggatggggcgggtggggctgggtggtgggtacttggggcagggcctgcgggtgctccctagaccaccctcactgggcagtgccttccggagagtgcaggggcgggcccagcagcagcaggaggtgtccaccatgggcttcagatgcagccacaggcttggaggccagagctcataaatgacgaggctctggcctgggccgcggagtctggcccaaggagaagacacaagtcactttctctccctcagcccaattcccagccccccatggagctgggagaacaggggtggcttcttcctcctccacctcggctcccgagtgctgcttctcctgggacttccgacatggctccctcgtccatccccatctggcattgcccttaggatgtgggaggggtgcccgctgccccagacctttgcagacgatgccctggttctctgggtagcacatcagcccataaagcattctccacgctgaccccacacaccccccgcaggaccctcagaccccacgctgaccccacacacccccgcaggaccctcggtctccacgctgaccccacacacccccgcaggaccctcggtctccacgctgaccccacacacccccgcaggaccctcggtctccacgctgaccccacacacccccacaggaccctcggtctccacgctgaccccacacatccccgcaggactctcgggctccacgctgaccccacacacccccgcaggaccctcggtctccacgctgaccccacacacccccgcaggaccctcggtctccacgctgaccccacacacccccgcaggaccctcggtctccacgctgaccccacacatccccgcaggactctcgggctccacgctgaccccacacacccccgcaggaccctcggtctgcacgctgaccccacacacccccgcaggaccctcggtctccacgctgaccccacacacccccgcaggaccctcgggctccacgctgaccccacacacccccgcaggaccctcggtctccacgctgaccccacacacccccgcaggaccctcggtctccacgctgaccccacacacccccgcaggaccctcggtctgcacgctgaccccacacatccccgcaggactctcgggctccacctcctgctcggcccagccgcattccccaaccacggcagggtctccccaagacagagcagccaaacaggcccacagcagggctgggggctgcaagccttgcctgggggcaggggctgggctggcctcacagttttagggaacgccttatggtcccttcctgggaagaggagggagggtgtggcaagtcagaggaggacacatctgccctcctctccccagcccaccctgtacatggggactccggaaaccaccgccaggcacagaatagacctgccgcactcaggcccacccagcccctccttcgataggcccccagccctgctcctgccggcacccgccttgtggacgtgtgtcacctggggctggccgctggaccgaggcccccattcctggcccctaggcgcccctgggtctcgaagggaaacggctcagcccagggccccagcaccaagtgagccccagcccccgttgcagagcaagcccacccggaaagcgctagcccagggaacaatgcccttcgtgtgacagactttcccctctgtgagagaaaatagagttcagtagaatggcaacttcctgcatttgtgcctgtgcctgaaggggtgattcacgcacggacctcccacaaagacagcccccacaccgcgccccagccaacaccgccaggcccagtgtcccagagcctccccgctctgccagccccccggggccgggccagggcccactgcccttccagggagcccctgccttcttcctaggcttcagctccacacccagcagccagaacacacgcatcaacacagctggtgtaaatcacggagggcttcctgaggagccaggcacagggtgcttgggcactgaggggctgtggtgagggcaggctgtgggtgcccaggcagcaagggtggggtgggagtggtggtcatggagcccacagtggctggggagtggggggtgtccctggacatggggaggccagggagggccactgtacaggggccatggctgcaggtgcccagtgcctgcgggtcctggaaagcatgtgctcctgagtgagcccagagcccatgggacatctgacctgccaggggacagtccttcatggtaaaggaaacttgagggcaccccaacatctttcccttctggagaagagaggtggagggcaacatctcagtgggagatctaaagaaggtgcaggaggagtcagcggaggttcctgccaaccgaggcatagctcctctgcaccccgcccccagcttccgggagaatccacccagctccaaatcattgctctgagggcccagccgccgtcagtctctccccagctctgtatacaacctgtgtgtggtccccaagcctgaggagctcctgctaccacgaggcagcctggaacccgcccccagaccactgcccttcctgggaccacttgcctcctggtctctcttgggcagagacccggccaaccaccctggggcctctggtcttcaaggttctcaccccctcccctcttccttccatcccccaagtctccccttaggagtctctagcacacagagactgtgggaccaccctgcccccgggggacacacatgccctcctctgccaccaggtgaagatggctgtgacgaggctgtgtgcagacatcctgacgcaggagccagtagacaatgcccagctgcccagcgctggccccgcatcacactggcatcgtgcccaggcagccccagctctgaggctcctcccacccaccacccagctctcttacctccatccttcccagcacccctgcgtcagtcaggctctccctgctgctgtgcctcctcccctctctatccttcacctgcatttccccagctgaatcgcacctgcatgggatcctggtgtcctcttctcagaggacctgagctcacacaggagactcagattcagggccctgttccatttcctgggctgtgtgccctctggctccttatgccaagggctgcctccccacttctctggttcataggcagcatggcatggctccccagagtgccccggttcgtgccaggcccttcataaacacgtgctgctgcttgtagagtgcccactaagatctggcacctcctttcacctgtgtgaactcccccaggagcctcagaggcagggaagacttgtccaagggacaagcagctgggctgggatggccattggcttgctctcatcgagttcccgggaggagctgtaggtgggaatgctgaaagccatgtgcacgtggcccccaggcccaccgtgcccgtgagctggagggtgggggacctcctgtccacctggggcccactgtgcctgtgagctggagggtgggggacctcctctgcacctggggcccactgtgcctgtaagctggagggtgggggacctcctctccacctggggcccactgtgcctgggagctggagggtggggggcctcctctccacccggggcccgctgtactcatgagctggagggtggggggcctcctccccacctggggcccaccgtgcccgtgagctggagggtggggggcctcctctccaccagggaaggctgcctccgcatctcccacactctcttgctgacttccctggaagctctgtccaaggaagtccagaaggaggagggacaggccatgtttgtccgtcagtggcaacttcaggtgatgatggtggtggcggacatggggacagaaagaggcagtggtgatgacggcagggacgtcagcaagagggggtgaaccactggcccaatctgtggggacacggcagcagtgggacctggctagcaccccccccaaccccacctgccggctgcctcttgcagcaggaaattgatttccggcttgccagactctcctctctacgttcctgcatcccctccaagctgttcgcattaagttctgctgtttgaaatccccgcggtggcttccgtttgctgattgagttggcctgagtcagggccagggctttgctgggaaggcacccagggggtctcggaaaaaggaactgcaggagaccccagggcacatggtgggaagtgagcagcggctgtggccatcctgctccagctggttcagtggcctcgagtgccatggggagctctggtgggcaccggtgggctgtggcactggtgccaactccccctcccaccagctcccagagacccagccccagctacgggtgagcttacaaccgatggccagccaaccagggtgctgtgctgggcgaacctgtggggcctggtgaatgggcagcgtggagcacaggggagagaggacgagggggtggagacggcctcagatggtcaggagcgccgcagggcccccgtgaaggagggatgaaccctggccgcatcactcccctcccaggcctcagcccctcttcccagcccacggtcctgggtgggcgtcttccgcatgggaggccgtgggcgctgggttttcacgaccctgaaacttgagcctgccctcgctctctctgagcctgtcatccagcagggagcagaggaaggctgcagagctgggaggggcaccctctgtctcagggtcttcctcctccttcctccacccgcccccagcgccgcaggatctggaggcgggagccccgccctcacagtgtccccctggaggggacatcccgctcctgcccccgccctgcagaccgcacaccgagccccagcctcactccccagcccccgggagccccgagccaggtctgccgtcgcctctgaccccaggctgggccggcctcctcgtctgggcctcggctcggagggtttcctgcccgcccgctcctagcctggcaggaagcggacacctcagaacaaagggaccggcggacaatggccattgaattgggccggggcgctcgcgcagggacaggccgccagctgcccgcgctgataagaccctccccgcggcgcccggcgcgggggctaatgcccggctcggccttccctccttcgcggcctgggcctcggcaggtgcggccgggactcgggaccgcaggccgggagtgggaggctcagctgcggcctcagggggccgtgcccgccccgctggggactaaagaggagccagcgcccgggaccaatcccaggagcgcaccggggagccaccctagcacctgccccccgaccctgccccgcggtctgacccccccttggatctggccccgcctctacctcccccgacgaactgaaccccctgggatctggccctgccccttgcacctgaccctgcccggagatctgaacccctaggatacggcgggtcccgcagtctgggccctctatgatctgaccccgtccctgcacctgaccccgccctggggtctgggggtccggcccaagccctgggcaggcggggtcggggtggggggcgagagtatgtgggggccagactctacccagctgcctgagagcctggcccttgtgcacgccaaggaagccgcgcttttaagagggcgtgatgtttggtatttccccaaaatgcaccagacgtcatgacactggagagcctcagggcttggctgcgtttccttcgcattgttttggacagaatgacagccagggagggctggccacgtggctgcagcatctcctggctttctgcagggttcggtcacttgctgtccccaggggcagcctgggcctcatgcctgtgtatgcggcaaggggacatggggtggggggggtctgctccaaggaacatcctccccagctgggcctcagggcagggccatcgggagggagaggccacattcctgcccaccccccacccccctggactctgcaggactgtccgacagcctccgagtcctcgagggccatgtttccggaagactctccttgaagactctacctcctcccgaggcctggggcagctctgtgttggcagagactgaacctaggaccagtgaagaggcggctccctgtcccccatccccaggcctgagcacccagggagatcaggagtcagcgctgtgctggctccagagggctcaggggcaccacgttcccactcgaatctgggaaggctttgtgtgggcaggtgcagagctgtcattagggcaagggccgggaggggttggggtgtctcagcgttttcccgcagcagcctggcacctggctgccccaggattagataatcacacaggaggggtgtggcactgggaggggtcaggggctgggggctgaaggaggagcaagaactcaaggtttggggaaactgaggcagcccctctcttctgggcaggatgagatagcccaggcccactttggtcttggcaagccccagacagacgtccagcccatggcacttcttgccatcatctctaccagccacagacccctccctcagcaagccactggccaggacagggatgacacaaggtgagcagagtcaggacaaagagacacttgccagctgcagaggtcccagagcaggttctggcccagccatgggggtgagggtggcaaggaaggcttcttggaggtggcacttgggttgagtttgccaagggaggaggtgacagaggaaaggcgtgacaggcagggacagcggggcatagaccccagtcaggggaaagccgggtgctgacagggagggcaaggagtcccaggggcacaggtggggacagcaggagctgaggccatgctggaccagggacaggagcaaggctctggagtggcaacctggaggcggtggcaagccatggcagggcaggtggatagtggtgactgcttatttgctggggtccccaggagtcaggtcaggtgggggtaccagggagagggtgctggggctgtgaccagagctctagggaagctcccctatgcaggtcctacaggaccaccttggcagcggtggtgctgagcatgatcaccctgggcccctgctggtgggctggggtggtgaccacagtatgccagaaatgctggggtgctgcaggctgccttctggctcaggggctctgagcatcgttgcccaaccagggccccgccatccaaggagccagccccagagtgccctaccatgtgctgtgagcacccccctctcctgggtacccctgaaccctctccgaagcctggtcaagtggatacctgcctgccacaccctcctccacctcactggcctggccctggttgtggccctgctgggaccaccgtctccactccaccctgatccatagcccttctgtagcctccttcctgtgtgagcagaagcttcctgggtctccctgcacccactgggacagatcctgcacgcccccggtgctcagccacgcaggtcatggcgtttgtgcattctgttttctgagccatccagcccaggcggtggacaccggcgtccagccccagctctcaggccacaggaagtgggaggtccagcggcttccattcctgccctcgatcagcccttgctgcttcctgcggccaggcccccgctggcgccgggcggcctggtgagcagtgactcatccagagcccagcacccgaacatcccactcccggctctcagcagaggaccccgtccccacctcaccccaccatctggcctgggctgcaggactgccaccgcccagcacacacctcctcctcagtggccctgcacctgctcccacccaccggctgggggtcctccactataaagagcatgacaccccagcctcaggggactccagccccccactctcagaggcccttgctgtccctggctgtggggctctgcccacctctgccctgctctccctacctctgccctgctctccctagagccaccagccctgccgtcacacaccctctgttgcctgagtcctaggttggaaggcctacctacctctacacctgggaccttctgtagcccatttcagccggccagcccctcctctgggaaggcttatgggctcctgagagccctctcagccccgcctcattgaggctgcctctcctgcctccaccccatggaccttgtctttgagcttggtgtgtccccaaggcagaactcaccctccaaccccatcctattgcgaccctcgcccaactcgcctggagacactgcaccggtcaggatgagaatggaagttgggccggaagttgggccgggcagcagagaaagctccgaggaagctcccctgtgcagggtgccccgaccccaaatccaggtggccaccccatttaagtgacaaaggagctagctgcctcagtggactccttccctccctagaggcctcctctcccatcggcgaggctcctgccctcctcatgacactgtcacacacgcccaatacctgcaagagggctgcacccacacaggcactgagggcccctcaggctgccaccccacacagcccacccagctgtcccgcagcgcctcctgatggccagggcccgaggggcctcccccagcttgcagagcctgcgagcatcctgtgcatgggtatgtacagatgcacctgtcccccagtggccatgtgaccaccacacccctccccttggtgggctgggaaatactgtctctgaatagcaacctccccgggagccaggccgggacacaccagcccaagagcgtgcccagggccctccaaggccaccagcaggctgctgagccctgattttcacctcccaggatcacatcatcccaggctcttccagccccaggccctccacacattacaggcccctaaatttggccccacctgaacctactcctttccgctgtccccctcccctaataacaaatccctgctgagaccttcaccagggagccagtctcatctcctcctccacccacctcccggccccacccagggacacccccatcctctgggcccttctccatcccctccccagagtgctccaaaatggaactaagcatgcgctctgctcacagccccacagcccaccctccagcagctggcaagaccacttctcctctgccggccggccgctgcgcctcacgccctgatttccctgcacaaacttgtgcctatggatcttgttggggagggggtggctcgaagcgcatctcccctacaaggacaggggcgctggcctgtgggcagcacttcccggttccctgcttcatcctcgccgactctgcgcacgcacttggctgtcaggctttctccacgcttgctgagtgaatccatgaacaaatgcatgagaaacacgcattttccagaaccccacgtgcagctggagggaatgctccggtcagggatttgtgggaggggaagtccgaaggggtgaggcctggagggtgggctgtgtggggatggcagccactccccatcctccgggcgccgcgggggcagagcacagagacagaagctcgaacatcgtctccatgctgggtacatgtctcccagcatgtgtgttcctggaccccaggcaggcgaggctgtggcctgcaggtgctgaccctagctcagcctcagcccacagtgccgcctccacctgccaggttctgtggcacctgcagtccggccctgcactgccgcccaggacccccacagcggccaactcagctcaatgggtgggtggtcaaggctggagcagagccatgggggccagcccccgaggtgtgctggcggccgggttaggctggggtcattttcccaggctccaccaaggcgggtacctggcagacaacgttattgtccacagggaggcagcaatgactcagtcgggctggtgcagaggcccccggccgcaaaggaaaggagggtccccacatcgtctggcagagtgggcactgcctcccctgggcaggtgtgactgggccttctgcccggcctcctatcccaatctcagtccagctagggcctcctgggcctctgtggtcccagctttgctgttaagtgggtacatgtaacgctccctccctgcctgtcagcgggcctgagctgcgggcacttccccaatcgaggccccccggactgctcaggagtgccccgaccccagctgtggctcctccctgtccagggtgagctggggtgtcagtcctgggggcatcagtgatggaacagagtcgggttgaggtcagggttgggtcccccagcctagcgcccctgacttcacagttccagccgtgctcattgtgtggggacaatggcttcctgagccaggttcctctccgggcaggaaaaccacacagaacctcctctttgcctccgcccacggcccctttgaagggcctgggccagcctcaggcactgactgcagccttggggcctgcccccggcgccacctcttaccagcctagcccaggccccggtctccccagggacctgccagtcctccagacacgtagtacaggctgcagggacagttactgacggcccaggaagccgccggccagaaccatgcaggcagtgggctcaacacagcatcagagcttggaaggacgcagagtcctgggcccggactccgtacaggctggagacggaggcaaccgacccccctcggtgcctcccaagaggccagggtacatctgcagggtggctgagccctgtgggggcggacagccaagggaccctggagggtgttggccctggagcaggcgcacctaggctggagagggcagagggtcctggcactcaaggcctgagaagggccatctgtcctcacacaagacaggggactcgaagcggggctgcctcagggcgtgtgcatgccctgcttccccagatggtcctgggatgcccctggagatgcagaaattggggaccagtcctgcaggggaaggcaggattgagggctttctagagtcacaggtggcaggtgggtctggcagagctctgcactctgaggcctccagccgtctgttcaccttgctggtgaaggtcttagaccccaggcagaggaggctgggatgttcaggcctggggtgtgtccagggccccactaaggtctctggtgccaggactgggacagggactgggatgctgcaggggcaggtaatctcctgaagcccccaaggctcagggttacttttcctccgagcctgtctccaccgtcttggccaaggggtcctcagaccctgaaagggaaggaccgaggaggaaggcgagaaggccttgctgtgtggggttgggggccaccagccaggcagggctccaagattcaacaaagacctgatacaacaattaagaacataaaggcatcttcgtggcctccggattcaccagatggggtgcaaggtgggcttcatcacccgggaaaaggccaagtgtcccaagaacataaatgtccgcttccagatggtgccgcccgtggccgccagggggcgggccagccgagtctcccggacacactgggcaggccggtcccgcaggagcctggatcccgggtgcccatccctcagcgggtccacgtcagcctgctgtgtctcgctaccacctccaagctccatgggagaaccacagggcggcccccacccaccatcacccagctgtgggggctgggaagggcgtgctccacactcctttgcccgactccctcaaaccaggggagcgggtggcagtccctggtggcagactcagactctagacagtgacaaaagagcccccatttctggccccaggcccagcagctcctcatgcagcagcccctgccccacctggaacaggaccagagagcagcagcaggcctagaagagggcttctgtcagtgtcttggaggacactgggggacagacggtggaaagaggggctgggaggtggagggaggggatgggggggaggtgaagggaggggtgggggatggggagcaggaggcagagggaggggtgggggcatcctcaggggctgcccggcatctgccctcgcagaacctctcattcagtgagagaccctgcaggtgtcccttgctgccccagtaatgctcagcccaggcccaggattcctgacccaccctggctgggctgaccaggggcctgtttggcagaggggcagacgtgggcaacagaaggcacctgggggttgggggagcctgggactgtctgctgtcccctattccaggggcctgggcagtgggggggtcacgctggagtgctcacccagcctggcgctgcctcactccccgaactgccaggaagctcacctcactccccactctgtggccgagggatggagcaggtgccaggtcacacagcactggtgtgggctgggtgaccatcaggtgctggagttaccagacacaagcccccagaccatccctccccgctgcatctgtggggagtggctgcaggggcaggcctggtgactcctgggccctgtcacagtgcccctgtgaggagaaactaccatgagcatccccagccaggtgcggtggctcacacctgcagttccagctactctgggggccgaggcaggaggatcgctggagcccagggatttaaggccagcctgggcaacatagcatgactcaatctcaaaaagaaatttaaaaattagaaagatcacccacaggcccacaagtgtccgagggctcagccaccatgtgggtgtggactgcggccagttgtctgccccaaccgggcccgacaccctgagctggtccagaggctcccggccctcagcatctgtgcatccaggtgtgggtctgggtacacacgctcaagcccgtgcacatggtggtgggatgggtgcgagcagacgtgtgtgcggatgaatgtgtgtacgtgtacacgcgtactgggtgtgcatgaatagcggccatgtaggagggtgtggtgtgcatggaagggcactcacaggtgtgcacaggcacacgtacgtaagggcattatgcatttctctgtggatggtcacatgcctgcacacgtgtgcccctgaggctgccagctccgtcctctctctggctggctgactctagctcagcagccagcagccagcagccagcagcccacgtggccctcagcccctgccctgccctcccctctggcatgcgggcaaaggtgacttggacttggcagagggcaggaaactccaggaaagctctgtggctgcatgagtgggccgaacccgcccactatgccccacctgaaattgggcaggacatgcgcgcttcctgcccactggccctgagcggtatgtgctgagctggggtaggtgggtgaacagaggggcctggctggccttgggtcctggcccttggtcccacaaagttcccagtacacaacaccaaactccacactaggacaggggtccaggatgctccaaggatgcccgggcatacgtgtgcactcatggatgcacgcacactcacatgcagatgtgctccatccccacaaagggccggcccctggctggtgcacgccaagcacagtgggggtacacgagaggcctgcggactgtggaaggctggggaagttggggtatccctggcagagaccacggcggctggctgccagtcacactcccagcctgaagtagatcttaccacatctggggacagccccgggccatgggagaacctccagggctctgcccctccagtgccaacagaggctccccagggcccagctctgcttacccagggtccttggggttccttggtcctgtgcccctcccccgtggggcccgctgctgcctctgcccttgcagagcctcagacgtgtggtgggaggccaggggcggggagaggccatgcaggtgccccctcccaccccagcaatgctccggctttgcagccctgagcctgctgggggacccctccccaaggcaccagaagagaaagaggccgcccaggccagcagccggaaggaccgagccccaagtaaaacatccagccagcctccacgaggacacactgccagggctggggccacagccttctgcagccccgactcccactgccgcccttgaggccctgcccctgctcttggcagctctgggcagatgccagcctgccttgaacactcagcccaggcaggcagctcaggccagtggggaggggagtgtctggccccctctgccacacagggagcagcagctgggctggacctgcctggggcccgactctgaagctgccaatccgcccacctgctggtgcccccaacctcgctccaagccacagggtaaggctctaggcgcccacccagcatgaggcagccagctgcagagggtgctggccacactcgctcctcttcccctgctcctcagcactagacagaggctgctgggtcatccgctgtcagctgtgctggacatgggaactgctccctctggcacttggagtctcctgcaaagcacctgcgctcaggaaggcctggagacaaccagcgcccctgcagggacttgaggaagccaaagtcaggggcacagatgcccggcctgtccctcccctggccagcgtggtccacacccatacggctggaccaaatgagcatgggtcaagattgtgggcaggcatggcagcccctctacagttggggtacagggattgtgggcaggcatggcagcccctctacagttggggtacaggggtgtgggcaggcatggcagcccctctacagttggggtacagggattgtggggaggcatggcagcccctctacagttggggtgcaggggtgtgggcaggcatagcagcccctctacagttggggtacgggattgtgggcaggcatggcagcccctctacagttggggtacgggattgtgggcaggcatggcagcccctctacagttggggtacgggattgtgggcagacatagcagcccctctacagttggggtacagggattgtggggaggcatggcagcccctctacagttggggtgcaggggtgtgggcaggcatagcagcccctctacagttggggtacgggattgtgggcaggcatggcagcccctctacagttggggtacaggggtgtgggcaggcatggcagcccctctacagttggggtacggggtgtgggcagcatggcagcccctctacagttggggtacgggctgtgggcagacatggcagcccctctacagttggggtacagggattgtgggcaggcatggcagcccctctacagttggggtacaagattgtgggcaggcatggcagcccctctacagttggggtacaagattgtgggcaggcatggcagccccctgcagttggggtacaggggtgtggggcgtggcccagcttgttctctgggtcagggagtgaggtcactgggcagacatccctaaggacttggcaaggagcccagaggcggcaaagggtcagatctcgtgccccaccctccaactctggctcaaggggattcctccagggggctctccccaccccagctccatgggctgcaaagaaggagccatccaggcacagaacagctggaccaagacaatggagctcagggccggctgtggtggagcctcgggcctgacccagtcctgagccccacatgccccaccccctcgctctatggagctgtgcagaccacttctcccgggcacccccaaaggtggacacatgctctgacaaagtcctggagcccccaggaccactgagcccccaactggctgttctccagtcctgtcaggactgtaacgtggtatccacggggtggtggcggccaccaaacaccaggttcctaagccagctcgtaacagcctcggatggccctgctctgagcaggcagcaggaggcggcggtggctgctcagggctggggtgtgcatgcctggcaggcccagcccggaaggcagcattcaaggggacagctagcaagctaagaatagtgatgcggggctgagaggctgggctcccccttccccgaggctgcagcatggtctggtcctggcactgggaagggcccaggcagaacctgcccaaggtgctgctggacatgctggcaggccccgtgcagctgcagcgtcacagctggccaagcactgcttcaggcctgtcagcgtccaggctgggagatgtggcccctaagccacctacgggactgagcaatacagacctgaatgcccaaacccgcggttcaggccagcacccaaaagcacctggccactacggctgtctactcccgggccgcagcacctccgcacctcggccacccaagtgtctgtgcagcacaggtccccacggctccaggacccggatgctgtgttccacaccgcaccctctctggggaagagtctttccgccaccagcccagagatgtcccacctcccctccagccattgtggggcttgactctagcacactggtcaccgcctggccccgcttgtgctcctcagccccaaaccccagccatcctctcccgcgccccagcccccgagccccaccccaccctcccccttctgtgataacctcccccgcttccatccccaaagggtggacagccactgcctcccgggcctccctttcccctggccctcacctcccacccacctctccacccctccctctccctccagcctcaggcgggccgttcagccaatatcctcaaccacctgtgggccaagccgctcatgcacaggcagcctggaaaccttctttcctggcctcccgagtggaagtgcccagccagagctgtctgtcctgaaaccccctccaacacccaactggccccaaagcaggtctcccgggatgaggattccttccctcctgcggagctgcagcccacctgtgcctggggccccacagcctggcaaacagcaccaccagagtcagacgctgccccccgccctgcaccccagcacccaggccgagggctggatcgctgcacggcctgcctcgcctgcgcccctcagctgcacgtctggtctcctccccaaataagatctggtggcaggtttcacccatttcgccccccaaatccaccctcttcgatctccaacaagacccccactccatgccacctggctgtcgtctctggcccggccccagtggccatctgctaggccgggagcccctccagctggtcctcagggttcctctaagagcaccttctccaagccccccatcctgcggtcccacggcccacctgcacctccctcggggcccctgggtgccagctgtggcccccaggcccgcccaccctggcccagttgctgcttcctgttaccccagcctcagtgaagcccctgtgggctggtcctgccgtttcactttcttcacagcactcacctcccggtgcccacactgcgctgggggcccaagcggggacttgtccacccggtcccctgtggcacacccatgtccagcccaggctgatgcacacccactcaacagctgctgcagtagttggggggacctaaagaccccacacccctcactcagggcagcccctgggtctcaggggctaatatccacagccaggccgtgcagccagcagaccgacatgacggctggccacagatcgcaacacagaatcagacaagcctcaggcaatttctgttaagtaacaacagatcttcctgctttactaaatctattcttcccccaagccctcgagaagccctggcaggacccaggctggctactgagctctgggcgggggtaggggggtctggcctgctgcgggccaagttggggcaggacatacagcccattccatggggaggatgaggcccctgggggtcagtgaggcacggctctgcctcaaggccaccccctcctaaggacacagggtgaagccccctcggccacatccggggcagccatgccagagctgagacctcctacgagtggtactggggccttcccacgaagaggcctggggaggctctcgggcctccgtctgccctccctcctcgatggggggcctgatccagctctgacagggagcgccactgccctctggctctgtccacggggaactcccagcgccaggacactatgcaggctatgcccgcactgcctacagagctatgctcaggacgggtgggcgccggtctcagctgtcgggcactcagttcacctgccggcagccgcagggctcctgggcccacaactcaagtggccctggagcaggggtctgacccccatgctgctccaggcggtgcaggcagcggggaggggggtctggaggaggcaggggtgggggtgtctgcctcggacgaggcaggtatctggatgcagggccacagctggaggcagaggaccttcaaggagctgctgcctctcaagtgccagatcctcagctcccacggctgcgccggacacctgcagggctctggcttccactctggcagaggctgctggcgccgagtgctgctcaggaggggacggtgcggagggtgggctggagactccagagctggtcctgagtcacagggccagcacactcagccctccacacacttggaccagcagtggggctgccccaagcctgtttccttaatagtagcaacaccacactgccagccttggagggtccttggatgagtcgacggcaggcagcgggacccagccctgcacacacccggcccacatctgatcacacacatgcagacgcttggtccggtttcccttgctgaatagaaacacaatcccaatggtaagttccacatgggacgagggctgtgggacaggtgccacctgtcaccaggagtctcggcgctggggcctgcctgctgcggtcctggaagcccgtctgatgctgaggagacccgcgaggccccctgccaggacatcacctgcctggaggccacacttcagtagccgtcgtcctcatcgccatcacagccatagtctgcagaagagcacagtcatgaagcccagggtctctgtgggacccaggagcccagaccccccaacccgccctgttcctggtgcccccctagaagactcaggctccagccccagccccagccccccgcgccccgccaggagccatcttgggctcctctccacctcccgggactggcatgcacccagagcagggccttgctcctcgtcgagggcacctgagagcagtgtgggctccctcagcctccctccctgggtgtgcaggtccgtggtggtgtgcagatccgggaacctcgtgctgctggctgggcggccctcgtggtgggtacctcaccgtccctagcctctctgaccctggctgcctccaacctcacaatcgacatgaccaatttacaaaatgtcttagttcaaatttctttccagggagaaacagaaatttagtttgaagctaacaggcccaagttcagggatcatgaggggcagtagctgatgcctttatttcccttgaacccctccctgttgtcgggccccacccaccgttgctgcccatcatctgcagggcactgacgcagggctccccgtcctcctcgtcaggctcctcctcgtcagcctcctcgtcggcgtggtatgacacgggcccgctctccaccagcaccgcctggggcctggcaggctcagctccgagggtgggagagcttgggagcaaagcctggaacgaagtggggctctgacacacacagagctgggagccctgtgtatctcaacagacccctcagacccaccagggctggcccaggatgctcagccactcccgccacaccagtggctcccggggttggccagggctcccaggcccactggccccttctggcctcctgggggctgtgccatgagctgtgtcagcatcaagatcccaccctcaggcctctgccagcccctgctcctgtatcctactgggccccaccccagtgctcggggagcatgcagaacacctttccagaccataggcctcggccgaggacactgtggcctcagcccccgggggcttggcctgccctgacccccagaacacagacagaggctctgctccggcccctgccccagcccccgccacctgccagcaccttcaccctcgtttcctgggccagaccagtccccaacaagtgacagtccaggtgaaagacccctgagccctggagggctgggccctgtgacctggcagtgcctgcttcctacatacaggctccctgcaggcaccaggcccacagcaaggctgctcagccttggcccgagcgctgagcagcaggcacacaacggtccccacttcctgcccgctcctgctccggcaaccgggagctcccaccctcgggcctcgattctctggccatgccaggcaagtatggggcagcaggggcaggcgcctctgtcaggcctgctctccctgtggtcacagaccaagcatctgggcccaggaagaagtgggctgcctcccaaggtctccctgccctggctgcgtgggacaacacacctctcccgtggccaccttctttgctggctgcgtagacaccagaggcctcaacctgcaaaaggaagcacagcatggcggcctcagcccaggctcccgaacgcctgcccacttgttcccttttgcccatcttccctttcccagtgttaattgactgtttctctgtccctttggaagcctggttctgcgtccaggttctgtgtgctccatcagtgctcactgcacatcaacacagagctctgacccgttcacattctcaacagcgagcagcactcgacacaaacacagaagctgcagacgccccgctccccagcccactccccttccaacagtgcctgagccctcaaggagctgcctggtgccctacctcactcagggaggaggggagggagggtgaagggacactgtcagacccgagagtgcttccccaaccctcaccaggcccagggcaatccctacatctgctgacaacaccctgcacagggcctgctcgccggcccgccacacacaaaggccaaaggtgccttccacatgccaagtcttcttggagactgctggtccccccagggagacaggggggcccaggggagaggacgcaggcattacccacaacctccagcacggacacacagggctgtcgggcgggcaatgagagggctcagggcctgtggggaaggacgcagcggggcagagcccttccctccagggcacagctgtgtggggaggcggtagggggcctgaggcagggccctgcctggctctgacgtgtcagatgaaccctcgggacactgggaagggaccccatgacaggtggaccttagcagaacatctagacgtggagctctgctcggggtgaagctgatagcaggtgtgagccaggctgaggccccgggctccccatgtggtccctctccagactggagacagtctggacaccagggctcctggtggtgctgtatcctcaggccaggcctccagcctgcttcctggagcctgacagctgctgctccgccctccccactcccatccccaggcccactgtgcagtggagtgggggcctctggggatggcagctggccctgcagcggggcttctcagcaggctgacctcaatgagacaccccactgtggtctctccagaagtggctggcgctccaggaggcaggcctggcagttgggtgggaggcctgatcttggccggtgggactaagtccccaggagattcatgctctggaaggtgaggccagcaggcccccattgagaagggccctgagaccccgctggctcaaggagaggtagtttttttcttttttttttttctgagacggaatcttgctctgtcgccaggctagagtgcagtgacgcgatctcggcccactgcaacctctggaagaggcagtttctttgactttggcagactgtaccttagctagagaggagcagatgctggcgggcaggaatacggggctacagggagagcggtgctgttaggagggtgcgcttcctgcagggacacaccctccctcccccacctggcactgaggacaggctgaaattcaagccacaaggtcctgctgcactgacccaaggtcctgacagacaagtccagcttttccagaaccaggaagcagctgtgccaggcctcaccctggggggccagaaagctccctactcctgcagaacccggctggagagagggtgcgtagtgttcatgagtgcagaaccgcaagggctcctggggtctgcgggctagctgggggcctgtctcaagggcttccccctcttccacgcagtatcctgtgtgaacctgaggcagccaggccacacgggagggcctgagagcgcctggagaacaagctcccacctggcatcacctcggccatggctttggcctgtacgggggtccccagccaggggcctgaggatgtggggcgctgcggcccattgttcacgcaaacccactgttgggctcaggctgctccctctcgcagccgcgccagcacctgctgaccccgcttggctgaagctcggccccagcccagcctggggggatcctggggcctgtaagcaggcaagagggcagctcatctggtgggcccccactttgtcccccttccagatatgggcgctggggcccacagcccacactggcccctctgcctgtccccagagtgggacgctcaggcatgaggacagactgatctgcatgggctagaggaagaccccgagggtcaaagcagcccgagtgaccacagagtgaggaggagacaagctcggagggagcggctgcccacatccctgtgtggctcagctgcccacacccatgcatggcccacccctgcgtggctcagctgcccacacccctgcgtggctcagctgcccacacccctgcatggctcagctgcccacacccctgcgtggctcagctgcccacacccctgagtggcccagctcaggttctgcagttgtctgtcatcaggggaagcatgcatcatgacgcaggaccaggggcaggtggccagagggagatgggctaggcagccaccggcagccaaagagaaagggggtgcagctcaggctggttcccccacagcaaggagggactgccatgcctgggccacccaaggcagcacagctgctgctgaggaacgctgtggtcgctgggctgaggcagtgcctcctcagctgaacccctccttgatggtccctccccaccacccctccccacgtcggagcctcagcctctttccaagtggtccaaatccctttttcctcacccgagtgtgggtgaaaagctgcccccatgggctgcaagggcaaccgggacaagcccttctgtccccaggtagaccccctctcccctgccccgctggaactgcctgagctgcccaggcctgagtgggggtgggagtgtggggggtccccagccctgaggtcttcatgcttccgtcttagaacactaaatattcccgaatcagatcatggccatgttggggggaagactgatgggtttctaaagcaggaagcagtgcacgaacacgcagatgtgtgtgcacacagactcacagatgcacacacactgcacacagttgagagacttaagacacacacacacgccccacgcacacagagaaacacagtgtatacagacacatgcatgcacacacgtgtacatagagacaaagacctgcacaccacaatctgtagacatacaggtacacatgttgcatgcacacacactgcatgcacagagagacacataggcgtgcacacctgcatttgcacacaaaaacttacacacatgcacacacactatgtgcagtcacagatacaggcacacactgtgtgcagacaccagaacacatgcacacacacacgtactgagtgcaccaacgcacacacgtactgtgtgcatacgcactgcatgcacagacacaggcacacacacatgcacacatacactgcaggcacacagacacaggcgcacacacactgcatacacagaaacaggcacacacacactgcatacacagacacaggcacacacacactgcatacacaggcacacacacacatgcacacaaatactgcatgcacacaggcacacacacacatgcacacacacacactgcatacacagacacaggcacatacacatgcacacacactgcacacacacacatgcacacacactgcatacacaggcacacacacatgcacacacactgcatacacagacacaggcacacacacacatgcacacacacgctgcaggcatacagacacaggcacacacacactgcatacgcagacaggcacacacacactgcatacacagacacaggcacacacacacatgcacacacactgcatacacaggcgcacacacacatgcacacacacgctgcaggcatacagacacaggcacacacactgcgtacacagacacaggcacacacacacacatgcacacaaatactgcatgcgcacagacacaggcacacactgcatgcacacagatacaggcatacacgcactgcatgtacatgtatacacacacagagagacacacatgcacacccgggccctgtctgggccagctggtcagatgtgacagagggggctgtgaaccctgtcaccaggcaccagaatcacccaactgggacaggacccccacctccagcgctgacagaggctggctaggcaggcagaggacacggagactaaagcctcagatcggacctgggagtgctcaggcacaggggaaccgagccacagacctgccctgacttcacctctgccccactgacctcctacgcatgccaggagctgtgctaggaatgcacccccagaggaccagtgcatggctgatgtggaggagacagcccatgcggccctcctgaggggctgagacgccggctgagaagcaccagcctgccaggaggtcaggctccctcacagagtagcacctgggcaccccaggggaggggcaggggcagggccacagcacagccaactctcgcggggtgcagtggccagcctagcagctcaaaaggccaaggagaaaccaccgcaaataccgcaaacaacaggaggccctgacggggctgccgagagtcagcactgccccacaggcggaagcagctggagacaacgcaagagatcccaagaagcagtaggaccagcagacacacccagcccggagactcggtggggtggagtgaaggtcggaaccaccaaagggtggacccagaagctaagccgccaaccccatctccactgccagagggacacatggaccagccacaggcccccaagacgcagcaggtgagcccagctgcccatggcctcgtcaggagagcctgcagccgccacccagcggcaagctgtgcacagaggccgacccactccaaggcggccctgcatggagctgcagagcctcgtgaccctgtgcgctgaggccagcacatcccgcctttgacgtccctcagccacgttctccacccacatcctccttcctcagcagtgtgctgctctcacccatcacctcagcagagacggcaatgcagccagggtgcgcagagcaggcacagggcggcagggctggggactcttcttcccgaacccaggctggagaaggcaccgaccccacggattgtcccagcccctccttgggacaaaacagagcctaggctgcaggacccccctgacagctggacccgcccgtccgctcacagcctgccaggccaaggagagttgagacactgtcaaggtgccggagaaggcccaccagtccccagcatgcaggtggcaaatgccactccaggcacttctgtggccccggctggcccccggcagctccaggacccgaagccatgggcctctgcccgccctgggctgctgccctaacccagccactcaggacaggatggtaccttttccccacactggtcacagggtcagccccacttctgctggccggcgtcctccttcgtgacagcttcctggcactggcgctatgctcgggctgtgcatcctccctgtgcggactgcccccgccggcgctgctgaggccccggagcacgctataattgatcttgctggagatcttcttctgctccagcatcttctcgatggcctccctggcggtactggcctgaattggctcccgtcgcttgcaagacttcttgggcttgagggaaacaagcaagaatgcctcccgtgagtcacgcccactgcactccaccatcaggggctccacgtgaggccaggagtgcaggcgggtgaggcctggctcaggccctcagaagggccgctcctgcctcctccccccagaatgtgggccagcctggtgctctctgggcctgcccacgtcaaatcctgccctcccaggtgagtggggcacgtggcctggcatgggtgctggcagggcctccagacagcaacagcagcaaacatgccacaggtgctcagggccctgctgcccctgggtcccacacagggcagggccacatgcacacggcagggcgatgtgctgctgcactgtgagggctgcagcagagatggctactcagtgaagacagacaatccaccccagcaccgctgcccacgtcaaaggccccagctgcccgaagaccctggatctccttctaggagctggagccatagaccacttcagggcaatcagcctgcaccacccctgctgccccccgctgcacgatgaccttcctgcgtggcccagcaaggcctgggacgtgctgctgggtggggtggagtccctgggctcctaactctctgaccacaagctccccgggtcctgctgagcgggtaggccccacatctgccatcccagccacctccagcttcgtctgagggaccccagtctcgcaggcagggaactggctccccgtgttttctcctgctcagtcactcagaggctcaaccactgctgcctgcaccacgaggctgaaggcacattccgccagagagtaagctggcagagcaagtcaccgtgacggccacaaggcagggaggcatgacagtcggactttcccagggcgtcagaagagcaaacccgttaacacaggcagggaccccagcgtccagccccgagtctcgacagtctgccccggtgctgcatccagaaggttaccccaaagctgagcacacgccctccaaggtgaggccgacggctgggcgcctgtggccagcacggggcaggacctagtggttaaggacgtgggtctggggtccagagcacatggcctccggctgcctgccctggggcctagaccctcctgtcacatggggaagggacattccagagacatttgccccccgtaacctggacacccccaagaaggccaggcccagcgtcacaggcgcccaccttgtgttccttgtagatgccgagctccttctctttcgctattcttgcttctttttctaaaagttcagaaagggggccagcgtcactgagggcccacgccccaggcctggggactgtgcgtcctgcgtgtgagtgtgggcgggtggcgcttacccctctgttcccgcaggtactcggcgttctccctcatccacagctcggccttcacgcgggcttccgactcattcaggatgtactgggcgagcacagggaagtggggctggcttttagccttcgcacaccggggcatgctaaggtcgcgctggccagcgggaagtatttccaccgttagaggaaggggaacccggggcagcctctatttagtgcggagcctgggctgaggcctcatcgcgcggggcgagttggggacctgttgctctgtggcctgtcccaaggccaaccacgcaggccacatgtgtgagaccccctagggcagcttgcaagccctgccggcaccaggaccctggccagccagagtgcaggccacaggttcccacaaaggggccaagtgagggtgagagcctcccactcaggtacagatgggccaggctggaggggtctgaggcaccacgtggccatgaaatcagggaagacgacttcctgcctgacagagggcaagtatattgagataaactgcaaagagctggtcccaatggctggaagccctggggtttgggggcgcacagcgcatgtggagtcagtgggtgccctcttgtgtctagagacccctcgaggggctgcccctggtgctatttgtgcgatgtgtgcctgctgcaggctatgtgccgagggccgcaaggaccaggcgcaaagccaggggcctctcgacaggccgcccccgagccgacactggagaagagagtgtgggggggggtcccgggaacagtggccagaaggccaggagcccacttcacccagcggggtgggctctgggcaggggaggtggccaaccccgcccgaccactcagggctccttgggctgcagcgccctcccaagcccagcccctcttgggaaggggtgctgccacgtaccctgtcaatctccaggtcatcaatgccactgaggtccagctcaccgtctcctgaagcatcttctggagggaagcacagcatccgcgtcactcagggccagcactgattataggagcgtggccaccacctgggctggctcaggaccctgggtctgggctaagggctttctagaaccccgtcccctcctctgcactggtgggtcgcgccctgtctgcccacatgaccgcacctctttaaatgcctagctcaggacactaagcgaagccagcagaacactgaactgaagctgcaaaggaaaaccccagcacttctgtgctttttgtaaaaaagcaactttttaagaacaggagacagaggctgtcaggccccaaagaccgagggagggcacggaagctgggcaggaaggaaaggtcaggccacggagtgagatgggggtctgtgctcaggggagccagctccccatcactgagcccataggtctggggatagaaatgagggaatagaaatgattccggagtccaggcctgagggagccctccatgatcatgctcaggacaccccaaaacctgcctgtcacccctgcccagccccacgcagtccaggcagcatctgcacagcctggaattgggacagcctctccttgccacagccccacgccatagctgcctgccccgtgctgccaagtcaactccagcacagggccagactgtctgaggtgctctcctgccatgctgctccagggccgaggccagagacggctcctctcagcactcacaggcagcccttcctcagctccagccagaatggccctttctgctcagggtcactgtgccgctggctgccccagggcctgtgcatgtcccctctgcctgttgctctgtgtgactcgcctgggttccacccacacagcagccccaaccatcaggattgtctctaccccggcccagatatcacttgataaacattcgcctggctcctcacacagaggccaggccctggtgcccgacgggaggcagggcttgagggtgaagcgttgcaggaaggtctaggctctcagccagggaagcctgtcctggcagggatgggggatgggacccacctttctcctagagctcccagccaaatgggcaaggtgagggggggcaagatgggcacggtggcctggcctgggcactatggggcaggggtgcctcgtcattgccacgcccaagctcagcaagtgacgttcccccgaccatgttggacaagcggatgaggggtggagctgccccatgggactcctggacacaacttgtgggctccattctccgtggcccctgtgacctgaaggcggtcccagtgagggtgacgagactcactgcattctggcgtcggcacacacccaattcttcacgccaggaccactgacgcccacacagccccattggggggactggtggtgccaccacccaagcccaccgcccgagaccaccacacctcccgacagaggatggcagcatccggctctccccatgagaggcacacgcctgaaagatctcccgatgacctcagcgtcccccagggccccatcagaactcactggggtcgctgctctgagaggagatgcattcgcggatggagtctgagatgcccaggctggctgcagtggggagggggtccagcagggaccccagggccggaggtctgccgccccactcggggcttcctgctgcttccgagctgccgggggcaccaccaaggagctcccggtataagtctttgttcaggtggctggccgcggcttccagctcctcgtcctctgtgtcctcctcgccacacaagctggacgcggtgtcctcggtggagcctaggtgtacacaatccacctgttaaccaggcagagggccagggtgcccgcttttgtgacaaaaaacaatgctaccaagctgccaggtaacccatagaacggctgtcagtgcacggtgcctggcggtcaggtgccaaagaacgagcctcagcccacacctcgcactgcacgcggaagttagctcaaagcagatcacagacctagggggagagttaaagtacagacatttcagacaaaaacgtaaaagaaaaactttgtgaccttggataaggcaaacatttctaatggttctaaaagcagaatccataaaacactgataaaacggatttccaaaaaattaagaactgccctttgaaagacatcgttaagacaatgaagacagcccacaggcttatctgcaaatctcgtaactgataaaggacttaaatctagaacagatgaagaattcccaaaacttcacaagaaaacacaacccaattaaaaaatggaaaaagatctgaacactccggcgaagacgacatattggtgtaaatgaacatatacaaagacctccagtcctgaaggaaatgcaaatgaaaccaccccaagctcctccttcacaaccatcagaatgtctagccctgaaaagaaaaccaggccgcacttcccagacagggggaacacgctcccttgcacttccacgcatggtgctaaccctttggagacaacctgatcagttctttttttttttttgagacggagtctcgctctgtcgcccaggctggagtgcagtgacgcgatctcggctcactgcaagctccgcctcccgggttcacgccattctcctgcctcagcctcctgagtagctgggactacaggcgcccgccaccacacccggctaattttttgtatttttagaagagacggggtttcactgtgttagccaggatggtcttgatctcctgaccttgtgatctgcccacctcagcctcccaaagtgctgggattacaggcgtgaggctctgcgcctggctgacaacctgatcatttcttaaagacaggcagttcgtggccgcccacttgggctcaggagttccagaccagcctgggcaacacagcaagatcctgtctctatgaagaaatgtaaaaattatctgggtgtggtggtgcccgcctgcagtcccagctacttgggaggctgagatgggagggttgcttgagcccaggaggttgacactgcagtgagctatgatggaactattgcactccactctgggtgacagagtaagaccgtctcaaaaacaacaaaaaaagacatacacacttgcctttcacataacccagcaatttcactcctcagcaattgacccaaaaggaaatcaacgtccacacaaggacttgtacacgagtgttcacgagcgcatctgaaacagcctcaaacgtgcaatgtcctctaacagatgaatggctacacaccctcagcgtgctgaaggactaccgactgccacacaatacaaacgaacaaaccattgatgcgtgactcaacacacaccctcagcgtgctgaaggactaccgactgccacgccacaacacaaatgagcaaaccattgatgcgtgactcaacataattacactgtgaaaaaagccgaagggaaaaacatatactatgtgatcctactcctacggaattctacagaatacaactaatttatcgtgaaaaaagtagctcactggtggcctggggcaggagggggggtggtgaccaagggcctgtggaccccgtgggagccacagatctgtgggtcttcttggttgtcactatggcttcacaggtgtgtgcagacatcaaagttcagaaatcaaagggcacattttaaatatgagcagttttcatacggcaatcacacctcaataaggctgttaaaaatcacccaatggtaaatttaaaagactgagaaaagaactttcacgggaggaatgtgactcctcctccttgagctacgtgttcatttcttgaaaccacttgctgttgccacaagtagctctaaactaacccaataatgccgcacccaatagtttaacgatgtacagccaatcacgaatgaacgttactattgtaagccaatgagaattcccaacagacaactttgtatctatccaatcactgtccctttttgcctttaaaaatccatctgtagctgaggctggctcactcctgtaatcccgcactttggcgggccaaggtggacagatcacttgaggtcaggagttcgagatcagcctggccaacgtggcgaaaccccgtttctacaaaaaatacaaaaattagctgggcgtggtggcgcatgcctgtagtcccaactactcaggagggtgaggcaggagaattgcttcaaactacagggtagaggttgtggtgagctgagattatgcaactgcactccagcctgggtgacagagtgagcctgtctccaaaaaaagaaaaagtccatgtgtaactgctgctcaccagagtgtatattcaaggcaatgggatatgtccaccctggctgcaatcctcaagcttgacccaaataaattatgtagattacttttgcctctgcttcttcctttaaggttggcaaaactcatcttaaaacatcccactctggattttgtgtgtgtgtatactggggacagggtctggctctgctgcccaggctggaatacagtggtgcaatcatagctcactgcacatcgaactcctgggttcaagtgatcctccggcctcagcctcccgaggagctgggactacaggtgcacactcccatgcccagctaatttttttattttttgtagagatggggtctcactatgctgaccaggctggtcttgaactctgctcaagcagtcctcctgtatttgcctcccaaagtgctgcgattacaggcatgaaccaccatgcttgacccactccctagtcttagactgctttcttctgaatgtgttccaatacaagattcctggctagcactgagtcccggaggggtccccatggtgaggaatggctccttgggggaaagcacctgatccccagagagcagctgtcagtggacgatgacctctggacagagcagcctctcagaagcccctccccgggcaagtgggcccaggccgcaggtgccaggagccttgggggctccggctgccacattcccgggacatgcacattccctggactgttggctctgccccaaaagtacttccagagttcgaccaggctgggccaggtctctcaccctgggttcctgcaacagcctccctacctcctgcctctgttctcaggccctcccgtggctcctactaacccccaagtgaaaatacacagtacagaatacaaatcaaaaacaagattctaagccccacaaccaaccaaatggatcccttctcttggccaaggagatttcaaagaaacctgaaaagctagttcagaccatgatgggaagtgggggcggggtcagacacgcctcattatacccgcttataccccctccctttggagttcaggcacagctcatcagcattaacatcaaaacacagatctgatgattgaccagactttgtagcaacagataccaaattccaacctgactctagtacaacatcaatgacaggtagcaggccctgaaagaaataaaaatattttaccccaaaatatctttgacatattttgaaatggccccgcaaagctgtcttttgtaggggaaacttacattctttttttttttgtttgagacggagtctcgctctgtcacccaggctggagtgccgtggtgcgatcttggctcactgctacctccacttcccaggttcaaatgattatcctgcctcagcctcccatggagctgggactacaggtgcgcaccaccacgcccagctaatttttgcatttgtagtagagacagggtttcaccatgttggccaggatggtctccatctcctgacctcgtgatccgcctgcctcagcctcctaaagtgctgggattacaggcgtgagccaccctgcccggtggtaaacttacattctgtagataatccccttccctttccaggtctttttctgatcctgaagagatctgctgagactctagcacattttaaaggtctgaataggggccgggcacagtggactcaccatcttttgccaggctggccaggccccccttggcctttggccggctgttttctagttcaatctcaattgcatcctggtaactggatatttcacctgaagtcataagttaaaagcaaaaagtcagcataaaatcaattttcccaacaaaacagaagcattacatgggaagattggttggttaccttcaacctcctccagtttttttgacaggacttgttcaagctgaaagggaacagggcaagaggcttcgtgaagggaggccctggtgcacagcgcagcctctggggtgccgcgtgggccccagggaccacaggctgctagaacttaggggtacgcagcgatggaggtggagctatgggcctgtgtcccccatgggaagaggtggcacttcccagagtctgtgtgaggggcatcccggagcctcgggctctggctggtcatagcactgaagagcggctatgaggctttgggatggcaccagctctgctacaaccccagtcggggtgtgtggcttccccccaaggctggcaagcccagcacagacagacaccaaagccggcgctacctgcttcatccgcagcttcctctgcccagctgtgtacgagggggggtcgcactcctcctccaggtcgatcttcatgaactcatcaatggtcaactgactggtgggggtgtcttcaaattccgtgagcctaaaatggagccagacatgggaaatggagctggtggctctgaaaccagctgtttaaaactgagctttcgcctgggcgtggctcatgcctgtgatcccagtgctttgggagcccaaggtgggtggattgcttgagtccaagactttgagaccagcctaggcaacacagtgagactctgtctctacccaaaaaaaaaaaaaaaaattagccacgcatggtggtacacacctgtagtttctgctacttgggaggctgaggtcagggagaatcgcttgagcccaggaggttgaggctgtaacgagctgtgatagcgccactggcctccagcctgggcagcagagtgagattttgtctcaaaaaatacataaaaaataaaaggccaggtgctgtggctcatgcctgtaatcccagcatgtgggaggccgaagtggtaggatcacctgaggtcaggagtttgagaccagccaggccaacacggtgaaaccccatctctattaaaaataacaaaaattagctgggcatggtggtgggagcctgtaatctcggctactcgggaggctgaggccggagaatcgcttgaatccaggaggcggagcttgcagtgagccaagatcgtgccactgtactccagcctgggcggcaagagcgaaaatctgtgtcaaaaaaatgaataaataacaataaaaacaaatacctgaactgtgcttgtcggatgttcctccacggggcctggcactcaggccttgcccctcggcgcccaggtcccttctggcggcttctccacccctacccgatcctgcccggacctctgctcactaggagaaaggcccacaggcaccctcatccctcacaagagaaccccaatcctaggcggaagactcagaaggcctgaagagaggaggctgggctagaacctcagcacctggcagtcgggcaggaaggggccctgcaggcctgtgagccatggggctcagttcttacgaacgcctctacacgctacacaaccttcaaacacgtttcatcaaagattttttttacagaatcaatggtcagatgtttaaagtgaaatactttacagctggttttggaaaatgccacaggacacaatctcagctgaaaaacagcagtcctgtgtttaagatttgtgataaatgtcacagcagttacaggtggcagcaactccactgtcacatttaccttgtcaaagtctatgaaacagggctgcggtgcaggcgagctgtgaggaaccccgacaaataccacccagcaaagccggggtgcaaagccccacccctgcctgcctggcttgctacgccactcatttcactgatgcggggacctcttatggcactccggcttctcactgggacaggggtcacctgggctctcaaagtccaggacgggccacagcaaaaaggagacggaccaggcttctgacgtcaaagacagcctcatgcctgtttgtgacttagggcaactttacacatcaccctccgcctcaacttagaaacacggggcgcggtggctcatgcctgtaatcccagcactttgggaggccaagacgggcagatcacgaggtcaggagttcaagaccagcatgaccaacatggtgagaccccatctctactaaaaaattagccaggcgtggtggcacacgcctgtaatcccagctactcaggaggctgaggcaggagaatctcttggacccgggaggcagaggttacagtgagccgagatcacgctattgcactccagcctaagcgacagagcaaggctgttcctcaaaaaaaaaaaaaaaatacagggatcggaggaggaggatgcctccgcaggatagggccggccccagaaggactagcagggaactctctggagggaggcgaggcagcccaccagcacgtccaagccatagtgtgaccggggctgggctaggtcctggccagcagccaggcgggggacggcagggtcccgggaggtggcgcctgctctggcaagcaggcctgagctggactgatgaagcctctgtgtggtccccatgccatgaatgagagcccctcacctcttccgcagcgtggactcacacactttgaccacactgatgacctccttcacagtcctcctgaagtcatgcattctggctgcaaccaggagcgctggaaggcaacgagacgggcctcgtcaaccacggctgggaaccagggcaacatctgtggcggcccaggacaacactgcggatcccggtcacggagatgatggcctgagaagacgtgtctgtgccaggcagtgagaccctcacttggcatggctactcctgaacgacatgaccctctctatcttattgtgggtggcggctgcacccattccattttcaaatcaaggaaaattaaaatgaaggcttccgagagcttcacgtaatccctcaaagcaaacaaactaactctaagatgactgtgcgggaaacacagcttgtgatgggagctggggactctgaggatgcggagccaggctgggcaggaaaggggcgaggccacagctggcagctgacacaggttcaccaaggccacagtgggcccagaacctccagtgcaaacatggagatcatgtgtgcagatggaacggcttctcaggtggactgaatcctgcagcgcagggatgccggtacctggcctgccgggtagagtggactctgtgggcacgagggtaagggcccggatgaggagtgagggccctgccgacctggggctccaattccggagctggggtagttgaccaggccacggccacatccacccaccagcaccaagggcaaagtgagagtctgagtgacagctgcgacctggggggtcacagaggtccaactagaacagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgtgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagccacaacctagcatctcaggagagagaggccacaccactgtccgcgtagtcgcccagctgggggcgggggacagcctgacagccctgtggcaccctcaggagccacaacctagcatctcaggagaaaaaggccacaccactgtccgcgtagtcgcccagctgggggcgggggacagcctggcagccctgtggcaccctcaggagcacaacctagcatctcaggagaaaaaggccacaccactgtccgcgtagtcgcccagctgggggcgggggacagcctggcagccctgtggcaccctcaggagcgacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtcagaagccgggccccacgagaccacgggcagggatgcccatgcagccgcaccccagaagtaggcaacctggggtcaaggccgctctgccctgagagttctgccccttatgccaggacacgcagaggccaacggggcagccaggaggtcctggagggctgaggaccccggtgggccaggccagagtcagccccgggaggctggaggcagctctcagtgctctgcaaacatacggcccagcccaccagcactcaggagtcaggaaagtgtgaggccaggacccagaccagcatcccccaggcaggcagggcccgctgtacctgctccgcagaggcccgaggggcgccggcctgtgtgcatccagtcccgcttcatcctctgtaggagcctcagggcagtcatggacacctcgtggttcttctccccgaattccagcaggtgcgcaaagcgtggaatatacaggcacgggtctgcggcagacacagcacctcagtgcccacctccatgtgccatggcacgtgcacaggcggcccacgcagcccaggggtggggcaacctgcacttgtctttccaggcccccaggccccccaccagttcccctcccctggacaaagcctctctgaccctcagctagggcagccatcgcaccgaacccaggagagccactggccacctgctgccagccagcctgctgcagacacgctagggccaggcagcgtgctcctactgcatggccgccctgctcaggacacagaggggcgcacacccagcagccttccctccagaccatgcagacagcaccacacgcaacaacggtccggggactcttagagcaagacaggcgtgggctgggtacacaagtcgccagccggccggcatcagctgacactcatgggtgagaggagggcccacttctggcatctctaccagcatggcggtgccacgggggctgtgtgtgcacactgaggcctggcgctgtgcacctctgccagcacggcacagtgccacgggggagtgcctggagcaggacaggctgggcgctgcacagcctgggccctgagcgactgcatggacctaagcagcgctcccctatgccgagcatgaggccgggatgtgactccacagggccctgctgtgccccaccaggctcaggtggctatgacttgcatccattcatactcacgacgcagcccccctttccagctgagggtgtccataacacgaaggataaatgcttgaggtgaaagatgtcccatttaccctgatgtgactgttacacactgcatgaacgcatcaagacacctcacatgccccaaaatacacgcacccgctgtgcacccacaactaaagataaaaaccaatgatttgtggtgatttggctgctaaaatagatattatttggagaaaaaaattagataatttaaaacaattgctaagatttttaatgattttcaataagatacaatcatcgcagctagaaataaagagaacgataaaaaatatgctcataggctgggcgcggtggctcacacctctaatcccagcactttgggggccgaggcgggcggatcacctgaggtccgcagttcgagaccggcctgaccaacatggagaaaccccatctttactaaaaatacaaaatttgcagggcgtggtggtgcatgcctctagtcccagctactcaagaggctgaggctggagaattgcttgaaccagggaggtggaggttttggtgagctgagatcgcagcattgcactccagcctgggcaacaagagcgaagttctgactcaaaaaaaaaaaaaaaaaaaaaaaaaaaaagatacgcttatagactgggcaatacagagacgaagtctatacaaaagtttttgaaaaaaatttggccggggccaggtgctgcggcttacgcctgtaatcccaacactttgggagattagggcgggtggatgacctgagctcaggagatcgagaccaccctgggcaacatggtgaaaccccgtctcaactaaaatacaaaaaatgagctgggcgtggtggtgcacgcctgtaatcccacctacttgggaggctgaggcaggagaatcgcttgaacctaggaggcggagattgcagtgagccaagatcatgccactgcactccagcctggatgacagagtgagactctgtctcaaaaaacaaacaaacaaacaaacaaaaaaattagtgggtgtgaggctgggtgtggtggctcacatctgtaatcccagaattttgggaggccaaggcaggtggattgcctgagcttaggagttcgagaccaccctggacaccatagtgaaacccagtctttactaaaatacaaaaaaaaaaaaaaattagccgggtgtggtggcgggcacctatagtcccagatacttgaaaggctgagactacagcattgcttgaagctgggaggtggaggttatagtgagccaagatcatgccactgcactccagcctgggcgacagagcagcaagactctgtctcttaaaaaaaaaaaaataaaaataaaaaattagtgggtgtggtctagtcccagctactgaggaggctgaggcagtaggatcacttgagcccgggaggttgaggctgcagtgagctgtgattgcaccactgtactcaggcctgggcaacagaaaaaaaaaaagagagagaaagaaaaagatgtactaatgtgggtgagactttgatgctcattaattattgaaatagaaaactcatttcaaaaacactggtaaatatatcaacggctgggcacagtggctcacacctgtaatcccagcactttgggaggccgaggagggtggatcacctgacgtcaggaattcaagaccagcctggccaatatagtgaaaccccatctctactaaagatacaaaaattagctgggggtggtggtgtgcgcctgtagtcatcccaggtactaaggaggctgaaacaggagaatttgcttgaacccgggaggtggaggttgcaatgaaccaagactgcgccactgtactccagcctaggcgacagagcgagactccatctcaaacaaacaaacaaaaaattcaagacaagccaggcagagtggctcatacctacattcctagctacttggaaggccgaggtgggaggattgcttgagcccgggagttcgaggtcagcctgggaaacacagcaagaccccatctcttaaaacaaaaatctggggccggatgcagtggctcacacctgtgagtcccagaactttgggaggccaaggcaggaggatcgcttgagcccaggagtttgaaaccagcctaggcaatatagtgagacccccatctttacaaaaaatgaaaaatttagcctagtgtagtgatgcatacctgttgtctcagctacttgggaggctgaggtgggaggattgcttgagtccaggaggtcggggctgcattgagccatgaccttgccactgcattctagcctaggtgactgacaccatgtctcaaaacaaaaaacaaaaaagacaagcaaaaagtgtttttttcaagacaaatctgtcagtgactagggtggaggaggaagtggtgggcagcggcggcacggtgggcaaacgcggagtggcagagcggcacgggacaggcatggcatttcatcatggaaaggaacccatgtcaagcagcctggaatctgcaggcgcacagcgacagaggaagaattaaatgaaggaaaaacactggaaacaaccttcaaaaccacaataataggggattttaacatggttctctgaaatttgacagactgattaggaaaaaaaagactaagggacgacttaagacacatcaccatagactcaatctgacaaggatgttctaaattctgtaccccatggagtcatcatgcttctccagtgtctgtgggacagttatgaaaatgaccaggtatgatagaacaaagaaaccctcaatatatttcaggtaacagcacataggacatgccatttgaccccaagtgcaaaaaaaaaaaaactaaaaatgagcaaaaacaagtagtcccctcacctccaaacgctgttagaaattaaagttcaatccttcaggtaactttattaactcaagcgctttgtgtatttaaggcagcaatgggtcaggcgtggtggctcacacctgtaatcctagcactttgggaggccgaggcaggtggattgcctgagctcagaagtttgaaaccagcccgggcaacacagcgaaaccccgtctctactaaaaaatacaaaaaattagccgggcatggtggcaagtgcctgtaatcccagctactcaggagactgagacaggagaatcacttgaacctgggaggtggaggttgcagtgagctgagatcgtgccactgcactccagcctgagtgacagagcaagactccatctcaaaaaaaataaataaataaataaaggaagcaatgaaattaatgaactaaaataacagaaaactaaaaattaacaaaattaattatttaaagtaggcaaagggactaataagaaaaagaagcaaataaattaccactgtcaagaaaagaattaaaaagtccaacagccagtatggtgctgacataaagacagacctacagaccaacagaacagaacaggacaggacaggacaggacaggacagcacagggccagaaatgacaatgacagacagatgaccttcaacaagggtgacaagaacttcttgcacaatggggaaaggatggtctcttcaatatgcagcgctgggaaaactggatatccacttgcaaataaagatagacccttaccttacatcatacacaaaaactaactcaaaaccgatgcaagacccaaacacagacttgaaactgtaaaacccttagaagaaaacaaagggaaagacttcacgacattggtcttggcaatgatttcttgaacatgacaccaacagcaagggcaacgaaagtaaaaatagacaaatgggatgacctcaaactaaaaagtttctgcacagcaaaggaatctattaacagaaatgatatcctatagaatggaagagactatgtgcaaaccatctatctcataaggggttaacagcctgaatatacaaaaaactccaactcaggaacaaaatcgattaaaaatgggcaaactgcacttttgtaatcccagctctttgggaggctgaggcacaagaatcgcttgaacctggaaggcggatgttgcagtgcaccctcaccaccgcactccagcctgggcaacggagtaagactctgtctcaaaaaaaaaaggcaaagcccttgaacagacgtttctccaaacacgccatgcaaatagccaacaagcacatgagtagatggtcaacatcattatttatcagggacatgcaaatcaaaaccacatgacactacctcatgtccattaggatgaccattatcacaaacaaaaaagaataggctgggcgcggtggctcacacctgtaatcccagcactttgggaggcctaggcaggtagatcacttgaggccaggagtttaagaccagcctggtcaacggagtctcgctctgtcatccaggctggagtgcagtagcatgatctcagctcactgcaacctccgcctccctggttcgagccattctccttccttggcctcccgaatagctgggattacaggtgcccgttaatttttgtatttttagtagagatggggtttcaccatgttggccaggctggtctcaaactcctgacctcaagtgatccgcccaccttggcctcccaaagtgctgggattacaggcgtgagccaccgcgcccaacctacactgtaacatatttaaaaatcaaagtgcaaagggtggtttctttctaaggatgaaaattattattcacatgctccacaccaccatgcagatcaagacgctgactacctctggcggctcagcaattctatcctggcacccccggagacagctgtcgcccaggtcttgtgtgctgctgtaagttattccttctcactgcattccccaaatggacccaccacaacctgctgatcctttctgttgctgatggacatgtaggctgtctccactctggccatttgtatttctcctggaaactgcttatgcccgttacctttttctatggaaacagacggctgggacagaaaccacggccacagcagccagcgtgtctttgccagtggggtcccacactatgaaatcgcagctgtggcctcggtgggtgtgtccttggcgggtgcatccacacactttctctcggaactttccggactctcatgcatatgctacagctttccaaacggcttggccgtgcggagttacgcacccacctgcagcaggtgatctccagctgctctgcattccaccaacactacgtgacaagtctcaagttcagccgcctgggggctcgggcaccccattcctgggagaaatgatgatttgtgcactctgggccattgcatggtgtctgttcacgtcctttgcccgttttttaaaaaactgggttgtcagccttttccttcctgacttgtagttgctcctccatcctggagagtcctttgttgaaaataccgcaaatatcttctgaagaggactctcccagggaacattcactacaactgtaacgaccacagagacacagagctcctgttcactgtttagcccaggactgcggtgacaggtgcacccatgacccgagatgctggctgcgtcctgtggggtttcctgcatatggaagttttaaaagtctaaagcctggcggtccaggaggttgcgtgtgtgtcctcggggaggaaccctcctgacagccaggcctctggagcttcgtctgcacgcgagcttggcatgcaccagctgtgcggcccaggccaggtgacacggcctctgaagtctggtctcctcatcagcaaagccagtgccccatgccacgcacctcccaggattagccccaggccgggaggctagaggccccacaaggagcgagcctgcgactgcgatccacaggcagagccacagaggcagggcgcgccctggggcccaagctccagggctgcaggcccagggccagatcctgacttgcccacccgccggctgtgtgaccttcagcgcgcgactaacctctctgtgcctatttcctcgaggaaaatgccgggaaatagcagcgcctgcccctgtaaagccctcagagcagagtggaccgcgctctctgcaagcgctggctgctggcgtccgtagcaagctaaatcgcgaagcatctgaacgaacgaggaagcccaacgaccatcccacaggccgcggccagaggcagactccggaatgcaaatggccaaacaagcaggtccacctgcgttcctaaccaaaagatcgctaactgaagaacgggcgcaagcacctgcgcatggcactgcgggtctgggggcggccgcctgccagcgccgggagccgccttccacggctacctctgcacagcgcgcggctcgcgccggttgctgggcagaagctcgagcagcttcgaggatgtcgggcctgggggcggggccgcgaggcagcgacgtcgcgcggggcgcggccctgacgcagcgtgacgcaccggcgccgcggcgggtacgggctcgggcgggcgggcgggcgggacggcgccccccgcggccgggcctggccgggctgcgctaggctgggctcgggcagggtcgcaggggcgggggtggcaggggagcgggtggcagccccgcgggtcacagcgccgccgccgcccatgctgctgcccctagcctgcctgcacggccgcgtcgctcagtgcctgacctccttgcttttgcttgcagagccgctcccgaggccccggcgcggcgcgagggcgcggggcgcggcgtccacaggcgccgaggctgcccccgccgccccgcccgcgaagatggcggcggaactctacgctcccgccagcgccgcggccgcggacctagccaacagcaacgccggcgccgccgtgggcaggaaggccgggccgcgcagcccgcccagcgcccccgcgccagcgccgccgccgcccgcgcccgcgccgcccacactcggcaacaaccaccaggagagccccggctggcggtgctgccgccccacgctgcgcgagaggtgagcccgtgccccgcggcccccgcgcccgcgcgcgcccacgcccccagcccgtgcctctacctttgcaggaacgcgctcatgttcaacaacgagctcatggccgacgtgcacttcgtcgtggggcccccgggggcgaccaggacggtgcccgcccacaaggtgggtagcggcggcccctctcggaacgcgtgccccgtccgccccgtccgccgtgtggctgacacgcagcctgcgggagagccaggctcacggcggcgctttctcctcccagtacgtcttggctgtcggcagctccgtcttctatgccatgttctacggagacctggcggaagtcaaatctgaaattcacattccagacgtggagcccgcagcctttctgatcctcttaaagtaagtccactctactggggagggacgggtgggtccgttttaggcggcctccggaggcttctgaagggaagcacacaggagctgatggactcctctcccaggcccagccccgcgatgggtgcttgggagccagcccctgacgcgggccctgcctcgcctaggtacatgtacagtgatgagatcgatctggaagccgacacggtgctggccactctgtacgctgctaagaagtacatcgtcccagcattggcaaaagcctgtgtcaactttctggagacaagtttggaagccaagaacgcctgcgtcctgctgtcccagagccggctgtttgaggagcccgagctgacgcagcgctgctgggaggtcattgacgcacaggccgagatggccctacggtccgaaggcttctgtgagatagaccggcagacgctggagatcattgtcactcgggaggccctcaacaccaaagaggcggtggtcttcgaggccgtcctgaactgggccgaggcggagtgcaagaggcaggggctgccaatcaccccacgaaacaagaggcatgttctggggcgagccctctatctggtccgaattccaaccatgaccctagaggagtttgccaacggcgctgcccagtcagacatcctgactctggaggagacccacagcatcttcctgtggtacacggccaccaacaagccccgcctggactttcccctgaccaagaggaagggcctcgccccgcagaggtgccaccgattccagtcttctgcctaccgcagcaaccagtggcggtaccgcgggcgctgcgacagcatccagtttgcagtggacagaagggtatttattgcagggctgggcctgtatggctccagctctgggaaggctgagtacagcgtgaagattgagctcaagcggctcggggtggttctggctcagaacttgaccaagttcatgtcagacggatccagtaacaccttcccggtctggtttgaacacccggtccaggttgaacaagacaccttctacacggccagtgccgtcctggacggcagcgaactcagctactttgggcaggaggggatgacggaagtgcagtgtggaaaggtggccttccagttccagtgctcctcggacagcaccaacgggactggggtccagggtgggcagatccctgagctcattttctatgcctgaggtgcccggggaggctgcagcaggtcagcgagtgagtggaggggaagtcaagatgctaactgcttcttgacaccatgaaaggctgctcttaactttgtctctctttgacatgtagtcagctgaagcttgactgtgtagagacattttccacacagccagaacccagggattggagtcttaggcatctctggtacagtggggtgcacgtctcaggtggaggaagatttacggctcaagacaggccccagatcccctcccagtggcacccatgccacctgctttgaggggttggatcttcctgctaccctcttggattctaagtggttccaagcttaacttgagaccttcccttcaaatctaaaattggcaaaaagtcacttaaaatagtggacttctgtaataaaggttgcctaaaataacacccacgtgtcagtaaatgactacagcagttgtacagtggggtattctctttctcatgcaacagaacagctccctcccatcccgaggagaaaacctgtcatgctgaacatgctatgtggttaggagcaaactgcgccccagtgaagcccatctgtcccctgggttgctggctggcttctgggccaccctaggaaacaccaggtgcctggttgtctctatgtcctaatgcatcactagcacctcagagtcctaccctatgaacagactgtcgggggagcattctgctgggcccagcgttctggaccctggggactgtcactagctgtgacactgctgcgggacagcctgttgcaggagtggactatagggtgaaacaggctctcccaccccttgtctctctcctcccactctgcataccctgtaggcagttgttttctggaaaacctgtatgacccccgaaaagagggatggcccctcttggcacctgggagagggcatgggccgagtgtatagcctcagccggtgcccctctgctgctgcagcccgtgttgctcagtcctgttggtgacccagccccacctggtgcttctctacccaaaggacatacgctcctagatgcaaacaggcaaagtaagaaaggggcctctaagcgggccatggaaaccagtcatctgcttggtaaagaaagggtaggtcagaaccatcgggcagtgagtgctgttttgatcctttccttctagacttttccgctaggttagattctgcatgcatgaacactgctgctgcctcgagggagagacaggacttaccctacacctaacacacatcaagaaaggcatacaggagttccacaaactcgcacacaacacagaacaaaagtggcagaaaaaccacaaaagagggctgtggctggaaagcacaaccaggagctgccccactgtccccatctgtccagaggcacctggagccaggtgtgtcccttaaaccttgtccacacaagatgctcccagcacgcagcacttgtttccctgtctacaccttcctgccacctgacaggcactgacaacaggccttctggttttgcagcagaaagcaagccccaggccaggtgcggtctcatgcctgtaatcccagtgctttgggaggcgaaggcacgaggatcacttgaggccaggagtttgaggctgcagtgagctacgattgtgccactgcactccagcctggacaacagcgagactgtgtcttagaaaataaggccccacattactgagctcctagcagctttaagaaacatttcttaccttgaggggtcccatgcttggacaggatttccctccactgttcaaaggacatttggcacgctggtccctacagcagcctgccggacaccccagcatctcacccagatgcctacctatggccggcgcattgatgcagagctctcttgccaagagaagaaacgtctttccaagcacgtacacattcacctgagatggagagatcacaaccagaaacagcattggtatttaaggaaatgtttgctttttttctcttaaaatgcatctcttgtgcagtctttaaagactccgatggcccgtggagcagccaccccacacccgcaagcctggctggcctcccttggctgctggggctcccagggccctgccttcttcctctaagccgctgctttaggccgtgctgccgtctcgccaatgatggcatctgcttagaagaaaacctgactgcaaggttcctcccagggcgtcatcacacggtgcacgcagcatttcattcacaactgcacacccatgaacacaaaaccagttctgtccacatgtgctcccaccagccacacctccagcccagattccgatgggcccaggggtcttggcctcagcccccttgctgggactgagatctgtgttcctcagtgactcccctgccccccacactgttcctaccttaggtccaaatccacacagatcctgtcacccctgcctcggctatctgccatagggcagtggaggtgaggcccagaccgagaagggcaacgccgagggctggcagtgatgggagcaccgctgcttgtcctcagcaaaacaaggactctagcctgtgtgcagaccctgtgcacagccctgccgtgggccgagtacccctaaggagccctgctggctgggggaggacacttcagagcaatgtctgctggcaggtgtggatgaggtgcacagcgggaatagcctggtccctactggagcctgcaagagccctgcccacacttggctgtcttcatcccaggcttgcccctggggcccccgggcctcacaggcttggccagtctgaccctctgccactagcctcccccaaagaattccctcgcctgaccaagcccggctcgtgggcccttagacaagtccccttgtcctggcccgccagtggcacttccaggtgcttgctgactccagggtactgggagacctaagggaccgcacacaaagggtcctgtctgcgctagaggcaagagacagaggcaagagccagaggcagcgcttgtgggggatgcctctgatcagggaccctgcccgctgggagggctgggcccccacagcagctcctcctggtcaccatccaccccagtggggcgcagcttccatcttctccattatatccgagggctccatcacaagggctggtggctcacagagtgtgccttctgaaggaatttcccctcctcacagtttctgggggttccagggatccctggggtctgctcaccaaactggggggcgtgtcagcacatgtagtgtgtgtgtgcatccgcatgcagtgtgcagacatgcatgtgtgtacacacgcatacagtgtgtctaggtgtgactcacgcatgtcatgtatgagtgccccagcccctgtgctgggttcctgccaggcccctgcatcttgatcgtcctgatcccaccatctctctttaagccacagcagaaccatgatctgctgctggcctctgcctgcccacctcaaactccacaccccccaaccttgtgtcccagagacacagggatcaatgagacctgaacactgcaagtgaggaatctccaaagggcctttacatggaaactcacgtttaaaaagccatgtgtgcaaaacgcgtgcagtttttttgttttagtttgtttgtttttgagacggagtcttgctctgtcgcccaggctggagtgcagtggtgcaatctctgctcactgcaagctctgcctcccgggttcacgtcattctcctgcctcagcctcctgagtagtcaggactacaggcgcccaccaccacgcccagctaatttttttgtgtttttagtagagatggagtttcaccgcgttagacaggatggtctcgatctccagacctcctgatctgcccgcctcggcctcccaaagtgctgggattacaggagtgagccaccgcacctggccgcagttttttgtttgttttcttgagacagagtttcactcttgttgcccaggctggagtgcaatggcgcaatcgtgactcactgcaacctccacctcaagggttcaagcgattctcctgtctcaccctcctaagtagctgggattataggcatccgccacaacgctcagctaatttttgtatttttagtagagacggggtttcaccatgttggccaggctggtcttgaactcctgacctcaggtgatctgcctgcctcagcctcccaaagtgcggggattacaggtgtgagccaccgcgcccggcctaaatacatgcagttctttacagagttgctaccatgtatgaggaccatttattggaaattctcttgctaacagtctaactgtggctgctccttgagggcaggtcagggtggggcacagccagctgccccccccatctctcttcctgggcagcaggtggattctgcctgcagactgccctcgtgggtgtctgatgagctgtgtgcccaggccagtgaacaacctgggtctgccctaaggcagggatcaagagggagactccatgagctcgccatgggaccatctgagtccccaggagcctgaccacttccggagcagctgccctggccctggccctcatactcatcttccctgggaagtcgtggggttggaaccagggtcatgtggttttgccctgcactgagcagagagcatctgaaatgtggacttgctggattatcacaattccagcagactatttttagcttgaccacaaaatgtttcagcagtagcttctgagttgccatttataaagacagctgggaggacaaggaccccagatgccacctgacacgggcagaagcctaactgtgggctgctgccaaaggcggaaagcccttgaggaccagaggtggcagcacagcctgtgggtgcccagaacccctgtgggcacctggatctggacagagctccctttgaggagtgaaatctacatgaattctgcactgtggtcacaactgttttcaatatttctgagtcctcagcagcatggtcaccaaggacctgtggtgcagcccccagcaccgtccctgcagagcctcggtgcccccaccctgtatcctgtctgcacaggggtccctggggttggtctttccactctgtcactttgttcagtcatgtggaaagagagatgtaactgaaagtgctttctgtggtacccagaaagtgagtgtctccaaacagactgtaatataagatttttctacaatttaaaatgcatgcaagaggccaggtatggttgttcatgcctgtgaccccagtacttagggaggccttggtgggagggttgcttgagctcaggagttcaagagcagcctgggcaacatagcaagaccccgtctctactaaaaatacaaaatagccgagcatggtggtgggcacctgtggtcccagctacttgggaggctgaggtgggaggattgcttgagcccaggaggcagaggttgcagtaagctgagatcacgccactgcactccagcctgggtgacagagcgagactccatctcataaataaataaataaataaaatgcaaggtcaaaagaaataatctcctataccaaactaggtactcacaaaaaaattttttaattgaaaataatctcctttgtgtaggacaaaagttcactgttcacccaggcctagctaacacccaaccgtgcccagcattggcaggtgccctcctgccatggagacccacactcccacaagtctcggactgtgacccccatgtcatgaaggcccctcatcctacagaccaaaacttcctgactgggcaggcagcacagaccggccactgagatgcgtggaggcacctggggtacaccccggtcacaaccctggtcacaacccccaggtcacaaccccaggtggggaaagatgcaggacggaggctgtctacctggagcaggtcgctgaggtccaggagcatgtctgcagcaggagtcaaggatcctgtcgagtggctgcaagctcaggttactcgcccaccttcaaatgggcaggaccgcaggactgcacctgcagggagctggagtcgcccctccaaatataagctccacctttgatcaggaaggaaaggtggtatggaagcgaggcgcggcacgctcaggcctcaccagaacctcccagccccaggcacaagtgagacttctgtgaacccagtaccaggacaagggactgcaaggaacctggagccgggtcgggggaaccagaaacggtgggggcttccatctgatcctggagaaagcgtgcacccccacacacccgcctgcccagtcaggtgcccaccatatggtggatctgctgcccacacacagcacagaagagacagtggcactcatgctccatcccaagggcacttgctgagcacctatcaggcgtcaggcaggcagtcctcccgagagacagaaaactagacctggggcccccttggtgagtggtgagcctgcaggcgccactgggggctgcgctcgagagacaggtgtggggaccccgcacaggacctgtcttcgctcagatgaacaaacaggaccaagaatgtgtcctaagtgattcaaaactcacatggatacataagttatcaaacacaagtcactggttaatacactctgccagacagctgaagtgcacatctcccatgggcccactgtagcttcgagaagtcactaaggacacctcctggagctggatcaggagtccagagcaggggtccaaaggaagatccccgggaccagagcagcaaagccccaccacgcaagaacctcgcaagcaatcagatggttaggacgccagcccactcatccacgccctgggctggaggcccctgacctctcttgcaactccatgcagaacagcaaggcctcccaccctaagaaggtgccagggctgggtacaggggcattccgacacagagcagaacccccaggacggctgggacgtgagcggtgaggcccgtgaacaaaggtgcatctgaaggcaggcagtcccagagggccgagacaacgggcaggaccgactgcagcacagccaacagcctcacaagaggcactatgagaagaccggcggcaggggtggggccagtgacatcaaaggaaaccaaaggaaagcagtaagaactacctggggaaacgcccgtgacagccaacacacaccaacgggaaaagtgaacgaggccagaaggctacaccctgtgtgactccaagcatacaccttccggaaaaggcaaaactatggagacagcattaggtcagtggccaccaagggctggggaaaggcagggtgggtgggccgagaggagggttccaggacgctgcagctctgcaccactccgcactggtgggttcacatattgcatatttgtgaaaacccatagaaggcacagccccaagagtgaacctcaatgtgaactgtggacttttcttatcaacaacttggcaagacgggctcatcaaccataacaaatggaccagctaacacaagatgttaataacatagggaaattggggattgaagggggtgtatgggaactctgtactttctacacaatttttctgtaaactaagactgctctaagaaataaactctactgggctggacgcggtgactcacgcctgtaatcccagcacttcgggaggccgaggtgggtggatcacaaggtcaggagatcgagaccatcctggctaacatggtgaaaccccgtctctactaaaaatacaaaaaaattagccgggcgtgttggcgggcacctgtagtcccagctacttgggaggctgaggcaggagaatggcgtgaacccagaaggcggagcttgcagtgagccgagatggcgccaccgcactccagcctgggcgacagagcgagactccgtctcaaaaaaaaaaaaagaaatgaactctaaggccaggcgcagtggctcacgcctgtaatcccaacactttgggaggccgaggtgggaggatcacctgaggtcaggagtttgagaccagcctggccaacatggtgaaaccccgtctctactaaaaatacaaaaattacccagggggtggtggcgggcacctgtaatcccagctacttgggaggctgaggtgggagaattgcttgaacccaggaagcagaagttgcagtaagcaaatatcgcaccactgcactccagcctgggcaacagagcgagactcagtctcaaaaaaaagaactctatttaaataagaaaaagaataaaggccaaaataaaaaaaggcaaaacaattcaacagaagcttcatgaagacaaaaaaaaatagccaacaagcacatgaaaaagaactcaactgcattaatcatcagaaatgcaaacaaaactgtgacaatgccacgagcccgcgacgtcactgaatgccggcgaggatgtggggcaagcacagctcacccatgctgctgatggaagcgtgaagtggtacaaccaccttgggaaaaggcctggaagtttcttacaaagctaaacacacacctctgacccacctattccactcctaggtatttacccaagagaaataaaaacagatgtcagccaggtgcagtggctcacacccataatcccagcactttaggaggctgaggccagcagatcaccagagcccaggagttcaagaccggcctgggcaacacagtgagaccctgtttctacaaaaaaatccaaaaattagccgggtatggtgacaaacacttattgtcccagctactcagaaggctaaggcaggaggattgcttgcacccaagaggtcgaggttgcagtgagctgtgattgcaccactgcactgagctggggccacagagtgagactctgtctctaaaaataaaaagaaatatgtccacaaaaaaacttgtagaaaaatgttcatagcagcttcattcagaacagccaaaaacggggagcagtccaggtgtccattaatacaagaatactctggctggtattcacacagcaataccactcaccatacaaaacaccatgggcgcctctcaaaaccatgtccaccggacacggggctcacgcctgtaatcccagcaccttgggaggccaaggcgggcagtcacttgaggccaggagtttgagaccagcctggcctacacagcaaaaccctgtctctactaaaaatacaaaagatgagctggacatggtggcgtgcccctgtagtcccaactacttgagaggctaaggcattagaatcgcttgaacccaggagacagaggttgcagtaagctgagatggaaccatactgcactcagcctgggcgacagagctacattctgtcaccaaaaaaaaaagcatgtgaagtgacagggcacagatcatatgattccatttatagggcattctagaacaggcacaactggtctgtagtggaaggaaatggaaacagcggttgccttttgcggggctgggactgttggaaggggcatgaggtctgtccacagagccctgctctgggctgacgggtgaccgtttgtcagaactctccagatggagcaattagggcctgtgcatctcactttaagccaactttaccttcagaggagaaaaagacccaggaacgatgctcacccccattgagctgatggtctgcctgctgaaggactgtgtgcagtacacagacgtctgcaacttgccttgaaatgtgccaaaaaataagatggtgagggcagcatagctttggggagcggaccacaggtgtgagcgaggggactccacaattcacttcaactttgcaggtgttcgaattttttttttttcccgagatgaagtcttgccctgtcgcccaggctggagtgcaatggtacaatcttggatcactacaacctctgcctaccaggttcaagcgattctcctgcctcagcctcccaagtagcttggactacaggcatgcaccaccatgcctggctaatttttttttgtatttttagtagagatggggtttcaccatgttggccgagctggtctcaaactcctgacctcaggtgatctgctcacctcagcctcccaaagtgctgggattacagacataagccaccaagctccacagaaaattttcttaataaaacaatgggataagtgtgtacatttttaaaaggagcttcaaattaaacatttaacgaagttagaattactgctttccttgaaatgaaaatcacctggcacttgatccgcattcacctggctctatcaggcgctttcagggaagtttccagacgatggaagctcaattatgtgcttcccttgtgaggatatcacattccctctggccaatcccgggagggcctactaatgcctttggggcccagcctacaggtcccccagctaatgagctcccagggctctggaggttctcctgtgtccagcatggctggtacctgtgtcctcccagcagcccctcccttttgctgagcagctgcttctgaccatctgggaatcagaaaaaagtctgcagagaagaggccctgtctgcggcccccagggtgcgaaagcctggattctgccagctggggcctctttctgcctcccttctggcccctgccacgctgtgccgggtggtcttctgctcggtgcagctgagtgccagtcaaaggagagacgcgggagcacaatagagggcaggtgacacaatgccctcaaagggcgccagacattcctgagtgcggcagaggcccacgcgaggctcccatcagcagatgacaaggcccagaaatggtccagtcatgacggtgcagccctgcaccccactgctgtgccatcaaactgtcccggctccaggaaccaaccaggcttccccaccacagctgtggacaacacagcgaggggccactccactgtgaagaggatggggaaactgaggctgcccacaccctggctggctgcacgatgcttgcagggagaaaaactgcagatgggtcctgactcagacacactttccttacatggaaaagtttacagagatttacataaggcagaactaaaacttaaaaaaacaagaaatttctctcaacagcctcacatacaaatgctcttactggatacccaaagagagaagcgagggaaagtgctcttgtatatagagccccacagaaagggctgtgtccacaacagccagcagtgcaggggccggcagggccccaccctgagcggacaccagcattcccggccccatgggactggagagggggactgcggcgcccacacggcgtgaggaccaaggagcgaaacccacaccttctggagaatgatgcccagcactgcaccggcccacggctcactgcccctacccagtgccactccccttctgcaggccccccctgctctgagtgctcctcaccggcagccaacaccacctggcacgggaacacacggcccggccgaagctccgtgtagagcagtagtgcccagccccaacccaccaagggcaaggccctggcagcactcagcatacagcactcagcggccgaccaagcacccacacaggagcccggcaggcagactgggcatcctcaggccccgcacatgcctggacggggctatgacggatcctagcttggaatggggtcactcaccccagagctcggatgccctcagcaccccaagagcaggacccatcaagacccagggcctaggtcatgagcagccctgccctcccgaacttcccagagaccaccctgctcctccgcctggaggtgtggcacagagcaggtgctctgggagtccctgaatgactgatgcggggtaggagacctgctggctgccctttgtccagatacctctgacctccagggaagagccagtgggtcattgctgggccttgcccatcccctgcacagtgactaaatccctgagccactgctggctgccacaccccacggtgggctcctgtgtgcagtacaccctgaataatctagcacctcaccgctgtcatcatgcatggcctctgtgaagttcaagggtacccaggtgccttctcaaagatccctgctctgaagactgagcctcccacagagctgggagcctggctctgtcccagccacactgaggtggtctcacggataatgcagctgctatccaggcagtcacctgacgctcccagcccctggctttcaagcacacacatgcaaccaggcacatggatggccccaggaggagctgagtggcacgagtgtaaggtgcagtgtctcagctcgggcctccttccaattctcgccaattctaataagctgtcatagtctggcagtgccaggccaggattgcctgaggacaggagttcaagaccagcctggacaacatagcaagaccccatctccatttaaaaaaaaaaaaagtggctggacacggtggctcacgcctgtaatcccaacactttgggaggccgaggcgggcagatgacaacgtcaagagtccgagaccagcctggccaatatggtgaaaccctatctctactaaaaatacaagttagccaggcatggtggtgggcacctataatcccagctactcgggaggctgaggcaggagaatcgcttgaacccgggaggcagaggttgcagtgagccgagatggcaccactgcactccagcctgggcaacagagtaagactccatcaaaaaaaaaaaaaaaaaaaaagtaggagcctagtgctcacagtctcgcttggcaagggaagatagagtttacagttcagtggcttccgagccagccagacacgaggggccaagctgccaagagaagaggaagcaacttcaacaagcgagcagggcacagtgcacttagtccctttacggcagctgccgcccctggagccacaggcaccaggctgaggcccgccaagcccagaagtcagctctgaaaggcaaaagagccgagcaggaagttctgcagtcccgaggtgccaggaagggacacctgggtcctgccacgatccttcagccgggaaccaagacggaccagcagcaactggatcagagtgagctacctgcgtgctctctgcttgctcaagaaaagttaaattcccggccgggcgcgatggctcacgcctgtaatcccaacactttggaagggtgagatgggcggaccacgaggtcaggagatcgagaccatcctggctaacacggcgaaaccctgtctctactaaaaatacaaaaaatcagccggatgtggtggcgggcacctatagtcccagctacttgggagactgaggcaggagaatggcatgaacctgggaggcggagcttgcagtgagcagagatggtgccactgcattccagcctgggcaacagagtgagactctgtctcaaaaaaaaaaaaaaagaaaagttaaattccctctggatggaaaagtatccatcatctctgtaatattttagacctaatattccagcgattcaatgaaaaattaccaagcatgacaaaagacaagaccaaaggaacaaaaacaaaaagaaaatcaagataataaaaacagaaccacaaatgattcaactatttggcttatcaatgactttcacctaactatgaagaaatgaagaatcttaccaaagaactggactctaataaaaggagtcttagtgatggctcacatctataatcctagcacgttgggaggccaaggcaggagaatagcttctgcccaggagttcaagaccaggctgggcaacatagcaagacaccattctctacaaaaaataaagagcccaggagttcaagaccagcctgggcaacacagtgagacctcatctctataaaaaattgatggccaggcgcgattgctcacacctataatcccagcactttgggaggccgaggtgggcggatcacgaggtcaggatatcgggaccatcctggctaacacagtgaaacaccgtctctactaaaaatacaaaaaaaaattagccgggcatggtggcgggtgcctgtagtcccagctactcgggaagctgaggcaggagaatggcatgaacccgggaggcagagcatgcagtgagccgagattgtgccactgaactccagcctgggtgacagaatgagactccatctcaaaaaaaaaaaaaaaaaaaaaaaaattgagtgggtgtggtggcgcatacctgtagtcccaactactatggaggctgaggtgagaggattgctcgagcctgggaggtcaaggctgcagtgagctgtgactgcaccactgcactccagcctgggcaacacagcgatattccatctcttaaaaaaaaaattaagaagttagtagatgggttcaacacctgattagacacagcaaaagaaaggatgagcaaaagagagaaaggctaatatatggagtcccagaacaggaagagagagtggagcagaaactttatttgaaaagatactacccaagatgtctccaacgtagacaaaagacatcaagtcataagttctacttatccttttttttgttttttttttgtttgtttgtttttttagagacagggtctcactctgtcgcccaggctggaatgcactgatgcactgatgtcatcacagctcactgcagccttgacccctgggcttaagtgatcctcctgcctcagcctcctgagtagctgggactacaggtgtgcaccaccacacctggctaatttcttttattagcctaggctggtcctaaactcctggcctcaagtgatccacccacctcagcctcccaaagcgctgggattacacccataaactaccacacccagccaagtcacaaatccttgaacttctacaaaaaataatctggataaacacaaagaaaaccacatctaggtacatcagagtcaaactgccaaatccaaacacaaaaatatttcttaaaagcaggtagtgggccgggtgcagtggttcacgcctgtaatcccagcactttgggaggctaaggtgggcagatcacctgatgtcaggagtttgagaccagcctggccaacatggtgaaacccctctctactaaaaatacaaaaattagctgggcatgggccaggcatagtggctcacacctgtaatcccagcagtattgggaggccgaggcggatggatcacgaggtcaggagattgagaccatcctggctaacacagtgaaaccccttctctactaaaaattcaaaaacaaaattagccaggtgtggtggcgggcacctgtattcccagctactcgggaagctgaggcgggagaatggtgtgaacccgcgaggcagagcttgtagtgagctgagatcatgccactgcactccagcctgggcgacagagcaagactccctctcaaaaaaaaaaaaaaaaaaaaattaggtgggcatggtggcatgcacctgtaatcccagctactcgggaggctgaggcaggagaatcacttgaacccagagggcagaggttgcagtgagccgagatggcaccactgcactccagcctgggtgaggcagtgagactctgtctcaaaaaaaaacaaaacaaacaaaaaaccgtgtgatgtaacgaaactcacctagagagaaatttatagcctcgagtgcttatgttagaaaaaacaggccagatacaatagctcacacctgtaatcccaacactttgggagtccaagatgagaagataactggaacccaggagtttgaggccagcctgggcaatacagtgagaccccatctctagtgcacctatggtcccggctactcgggatgctgaggcgagagagtcgcctgagccagggagttggaggttgcaacgagctagggtggtgccacagtggtacagcctgggagaacagagcaagaccctgtttctaaaaaattttaaaaaattaatcagtgttatttacgttaggtaacagattaaggggaaaatgtacatgaaaaaatcataccaataaatacattggtgtttgataaaattcagtatttttcatgacaaaaactcttggaaaattagaaagcaaggtaacatcctcaagctgataaagagtcctatacacaaaagtctaccgcagatacatagagcgaagggcagaaaacacccctcccaggacaggagagagccaggcacatctccctccccaggaccatgctgagtcctcggcatacaaaaggcaggacaaacagatgagaggtgtgtgggttagaaaggaagaaccaaggctgggcggggggttcacacctagaatcccagcactttgggagactgagggaggcagatcacttgagctcagaagtttgagaccagcttggacaatacagcaaaaccccgtcgccacaaaaagtacaaaaattagccaggggtggtggtgtatgcctgtagtccagctacacgggaggctgaggtgggaggatcgcttgagcctgggaggcagaagctgcagtgagccaagactgcgccactgcactccagcctgggtgatcaagtgagatcctgtctcatgaaaaaaatgaaaagaaagaagcagaactggcattatgagcagcagacacagttgtgtgcattaaaggagagactccaaaactcaaacagtaagatcgacaattgaatttggtaggaatgatgtattaataatgtcaacatacaaaactcagctaaacctctgctacgccagcaacaagacaccaccgacaaggggcccacatgggcccacgctgggtgtgccggtgtttccaggtcagcctttcggaagtctgaaatggcaacttttttttttttttgagacggggctcactctattgcctaggctggagtgtagtggtgcgatcatggctcactgcagcctcgacctcctgggttcaagcgatcctcccacctcagcctccccagtaggtgagaccacaggtacacaccaccagctggatttttttttttgttttctttttcttttgtagagacggggtttcaccatgttgcccaagctggtctcaaactcctggactcaagcaatcctcctgcctgggcctcccaaagtgatgggatttacaggcgtgagccactgtgcctgacctgaaatgccaacgtcttcatgcctaatgatgtgtgcaccatttgattccctcatcagccatcctaataccttcttctgaccacttaaactgttataaatgccctgtccttgagaaggcagcagagggagaggagcaggaacaagggggcctggtggcagaaggaggtgctggccagaacaggggggcagagaagtgtgggctctgaaagcccatcccagaccccagaatggaataagctgaatgcacatggcccctgctgacctgaacggacggttctgcagcctgagagaggagctgggtctgaagggagtgtggcggctggcggcagaggccttgctcccacgcgtggccaggcacgccatggaggctgaggctggcaggccatggaagctgggcatgctctttgcagacctacgtggggacaggtgatggcaccatccacagtgctggccccagggctctgacgccctctagggctcaccagcctgtcaccatcccaagatgccctctcacatgcaggcctagggcagcctggctggacaggaacaaatgtcaaagacccacaaaccagctgtgggcaaaagctgcaataacaagtcgagacacacagccaggaaaagcacactggccacaaactacctgctcgacaatggcagaggtgctcattccagctgagtctctgcccggcatgtccaggtcccgtgtctcagccctgctgcccacgcagcctccctgggctgggagccaggagcagactcaggcctagggtcagccgggccttgccagactcagtgggactcagcagcaccccgttcctcctccaggaatccgggactggctgtgtcagccaccaggctacggggccaagagaggaggtgtgtgtgcacagcccccggcactttcggggtgatagtggacacacctgaggatcgggcaacaatgaagggtgggcagaaggaggaataagcttggatgttcttaaatcaagcccttgttccttctgagagaggatttcttgtatccagccctgggctcagggcactggtcccacccatgggctggacgatacgataggaggatcctggggggcctctcctggggtgggggccatgcaccccacaacgtaagctcactgcacaggaccctccacgtcctgctgacggcagggtggaggtggggtggtgggtgctgttgcgccctggctaaaggtggcgagtccagaaggtgacgggagctgtgcaggcagcagggctgggccaagcagccctgtctcggagaagagagcctggctgcacacaccctctcctgggtggattttctgtggaagggaagtgggtggagctattgaggaaactgaggcagcacatgagcccagccagccagctggggctgcaggaggcgaggacagtggccagagccaatgcaggtcagcagggagggagaaggcacaggggcaggagaaaacaaggagggcggtgagagacggagacgtgtccaggatgggtctgggggctctggctggcaggcctagggcacggtgctgcccgcaacctgaagggagggcagagcgggacatgctacacctggcctgacccacttccctctaaagtgccggcaaagcaggggtgggctgggaagtgagggctacagctacccgagaccagcccgaagcatcctctgaggatgctgaagggagccccaccaggccaccagcagccagaggggatagagtgcggcctcccgtgagcacagtcctgttccaagctgtcttgtccttagcagctttataaggtacaagtttgtgccacaaacctgcctgttcacagtgcaccgggcagtgggttttcgtaaatccccagagctgagcaaccaccaccaggatctaattttagaatgcgtgggggacacggggtggcttcctggatgctgccactgtgagcactgtgcgtgagcctcggtggggacacaggtactcttttcccttgggcacacacttagtaggaggatcgctggagcgtgtgggaactttgtggctaaaggtggtcctgccagactcagaggcagccccggcagtgccacaggactgctctccgtcctgcctgtcatcaccccatgaaggcccatgtcccagggcatctgtcccccccacaggaggcccagtgaggcagcagcatggacgtggttccaccccaccttgctgacgctggggtcccagtgccggcctgcaccctaggccctgctccacagcagtccccacacagctcctacaaacacaagggaggcagggccatgggctgaccctgggctctgctcagcttctcgctcaggaccttggtctgcttctaagagagcaggatcggagcaggcctctcagtgggaccccagggtggagccggggcaagcagacagcaggcggggcgggcagggacgcgggcgtgggctctgtctctcgccctgcagtgggctgcctgggcactctgcatcatccctgtccctaaaggcacacgtgtgctttaaacacttttacgcagaaatgacaaatttcaaaatgttgaaaggactttttttttttttttttgagacggagtctcactctgtagcccaggctggagtgcagtggcgcgatctcggctcactgcaagctccgcctcccgggttcccgccattctcctgcctcagcctcccgagtagctgggactacaggagcctgccaccacgcccggctaattttttttgtatttttagtacagacggggtttcatggtgttagacaggatggtctcgatctcctgacctcgtgatccgcccacctaggcctcccaaagtgctgggattacaggcgtgagccaccatgcccagcccaaatttcaaaatgttaaaaggacattttcagggttggatgcagtggctcatgcctataatcccagcactttgggaggccagggcgggtggatcacttgaggccaggagtttgagaccagcctggccaacatggggaaaccccatctctactaaaaatacaaaaaaattagccaggtatggtggtgcacacctgtaatcccagctactcgagaggctaaggcacaagaattgcttgaacctgggaggcagaggttgcagtaagctgagatactaccactgcactccagcctgggtgacagagcaagaccctgtctggaaaaaaaaaaaaaaagtaacattttaatgaaagatcctgatactgagggttgcctggccagaggcaccgtcagcaggctaccagctcgtcatctccaggagccctccctgcaccccactcaaaagagaagcaggccaccaggatcacctggcacccaggacacccctcgagggggaccaaccagaaaaacagaccaagacagaaaagagctcaaggtgagaagatgccacactcaggaagacgggagattataaaaaagattcggaaaagacccagagctcttagagatgaaaaacatgaaagaaatgaaacagcctgctggaagctaaagttcaggtgctgtcccaaagcaaaaagatagccacgtgcaaaaaaggatgagataacacatgggttcagtgtggcaggcagagtaacagagaagaagggagacacatctaacgacgaattcaacagaagctcaggacaggaagctgtcagagagcaaaggcctgatgggctcacactgccgtgagatttctgaacgtggagattagaggcaaggagctgaagccccgcagctgcacagcaagggccaggagccagagggccacagaactgcccagtgagaatgctggaggcaaggcgacggcaggggcgcaggctgggaggcagacatgtggccgggcacgccacgcccaccagacacagggcagggagggggaccaccttcagaggggcgcagctcggaaaaggtccctctcccagggagccattgcaggaggcacctcacaagatgaggagggtgtggaccaggaagcggggagtccccagagagcagggaaaagatgcaggtgcacagcaggtgtggacagcacagcacagagcagaggaggctggaaggctctgggctccctgtcaagaggccgaaggcagctcctgacccatgtgtgtgtctgcagatggcagcagtgggcacaggaccagatgcacagagaccagtgcaagagaacaccagacactggatctccacgcaaggccaagctgcacaccgctgagggtcggcagcctccccgcccaccgcctgcagtcacggtgtccacgcacaaggccaagctgcacaccgctgagggtcggcggcctccccgcccaccgcctgcagtcacggtgtccacgcacaaggccaagctgcacaccgctgagggtcggcggcctccccgcccaccgcctgcagtcacggtgtccacgcacaaggccaagctgcacaccgctgagggtcggcggcctccccgcccaccgcctgcagtcacggtgtccacgcacaaggccaagctgcacaccgctgagggtcgggggcctcctcgcccaccgcctgcggtcacggtgtccacacacaaggccaagctgcacaccgctgagggtcggcggcctccccacccacggcctgcagtcacggtatccacgcacaaggccgagctgcacaccgctgagggtcggcggcctccccacccatcgcccacagtcacggtgtccacagctgcaggcactcggtgtacgcctggctgcagcccactcagcaacagcaccccacctgctcaggccagagggcggcctgaaccacaggggacgtggagacagcacccaaggcgcagtaggtccacaagtggggagaatccagggcatgattctcaggcaccgacagaaccctcgctctgcatgcccaagggctgtgcgaggaaggcaggtgcccagctccccagttcttcgatccagtaaaaggagaccccaaattcagaaagccctggatcaactgaaacagttcttccagtaaggtgtttttctattaaagacaaacaccaagttactgcaactaccaagtcccaatattcgaggggagccaactaagcatcaagatggggccctctgggaggctctcaaaccaaaggatacgcggcgtgccctccgtacggcagaccaggtagaggcaggcagcaatcacgtgggccatcttccggccgcgggtcaggtgcctgctcacggccatcttgaagaagttgaaggcggtgtccaggcagtgctggttcagctgcagctggttccccaggtggtggatgtggcgcctccctaggacacagcacgaggcagctcttagccaaatgttcccacagaacatgaaaagtatcacacggccacagcagcaactttaagaatatagatttgtgcttttccttgtaagtttctgagctcactttttatatgtgggttccaatcactttttatttaaggacactgaaatgtgaattttctgtgatctccatgtgccatgagatcctgttctacctgtttcccttctttaggctctgagtggcgtgtgcggtgtggctgaatgtgcctctctccagggctctgaggtgcggcgtgtctggcaagggcttggtttgggctggctggcaggtgctatgcccctgactgccctgggctacagtgggaatgccccttttcctacagccacatgccccagcgccaccgccttccccaaccgcacagagtctgggtcagcccacccgtcccttctcagcagggcccattctgctcagccctgcgcccgccagcctctcctctaagagccagccacccggcctgagaaaaagccaggctagcgccatcccctgcacctgcccagagggagggccatggtgtagggaaaaggaagagaggtcagactgttactgtgtctatgcagaaagggaagacataagagactccattttgacctgtgccctgaacaactgctttgccctgaggtgttaatctgtaactctgccccagccactttgccccaacctggagctcacagaaacctgtgctgtatggaatcaaggtttcagggatctagggctgtgcaggacgtgccttgttaacaaagtgttcacaggcagtatgcttggtaaaagtcatcgccattctccagtctcgatgaaccaggggcacaatacactgcggaaagctgcagggacctctgccctggaaagccgggtattgtccacggtttctccccatgtgatagtctgaaatatggcctcgtgggatgagaaagacctgaccgtcccccagcccgacacccgtgaagggtctgtgctgaggtggattggtaaaagaggaaggcctcttgcagttgagatacaggaaggcctctgtctcctgcctgcccctgggaactgaatgtctcgatataaaacccgattgtacacttgttcaattctgagataggagaaaaaccgccctatggcgggagattagacacgttggtagcaatactgccttgttattctttactccgctgagatgtttgggcggagagaaacataaatctggcctatgtgcacatccaggcatagtaccttcccttgaacttaattatgacacagattatttggttcacatgttttcttgctgaccttctccccactatcaccctgctctcctgccgcattcttcttgctgagatagtgaaaataataatcaataaaaactgagggaactcagagaccggtgccggtgcaggtccttggtatgctgagtgccggtcccctggccccactgttctttctctatactttgtctctgtgtcatttcttttctcagtctctcgtcccacctgacgagatatacccacaggtgtggaggggcaggccaccccttcaccatggtaagggcatgcccagcagaccggaggccactgcgccctcctaggggctgcgaggtgctggaggtggccaggacggcaacatccgagcacacgcgcctccctggagcaagaccctcccaaagctgcgggccacatgatggcatcaggagggaaatggcaaagctgccctgcaggcaggaggaaccttgggaaacaaatgtcaatgcagagtacaggccaacctcactgccccactctgtctgcagagcacaggctgtgtggggagcacctgggccaacctcactgcccccacttctgtctgcagagcacaggctgtgtggggagcacctgagccaactttactgcccccacttctgtctgcacagtgggcgtcgtgggcaggcagagtccttgctccaggcaattagccccatggggtacccagaggacatgtgtggtgggtcacggctcgatgcagaggaatgctgccgccatggagattccagttcccactgcatcctctggcacccaaacccacagtcctcctgcaaagactacctgaggcggcctccatccccatataaagtcaaaaactgacctcccagatttatttgataagggcacatgagctggagaaagtgagggctgatgttttgctcacgccaaacttcactaatgatgaccagcagccagaggtgggcagctgctgagcctgcatcccaaggaagccggtggccagggtacacagtctggcaggtccaggtcaagcctcacactgccaggcccctggcagtcagcagcatcacatggagcccccagcccggctgtggccctgccaccttgagcacctaaggccacctgcctagagctcatacagctctgaggcctgcagtccagctgagctgacgtggaaggctggtcactgtccccagagctgaggcctgggccaagccaagaccccaaaagaatggacagaaagggcatcgtgccagctgccacctgcacatgtgcagcaccagccagacacaccagcacagaccgtccccgcggcccagcaaggcccagagggaaacagagtcagctgacaggggacccgctgaagctacggctccttacctaccagctctctgctgtatgtttgaaaattctgtaataaaaggtaagagagaggtactctctgaggccacacacttgaggctgggactcgatcccaagccccgaccccacaggcaccagctcgtgttcccagcatgcagggctgctatggtcagaatgtctgactcctaaaattcctatgttgaaatcctatcccctacggggatggtattaagatgcagggcctttgcgggagactaggtcaggaggcagagcactaatgatgagctcagtgcccttaaaaaccggaccccagagaactagcccagctcttctaccacgtgaggccacagtgagaaggagctgagaggcggccctcactagagagctggggaggaggccacagtgagaaggagctgagagggggccctcactagagagctggggaggaggccacagtgagaaggagctgagaggcggccctcactagagagctggggaggaggccacagtgagaaggagctgagagggggccctcactagagagctggggaggaggccacagtgagaaggagccgagaggcggccctcactagagagctggggaggaggccacagtgagaaggagccgagaggcggccctcactagagagctggggaggaggccacagtgagaaggagccgagagggggccctcactagagagctggggaggaggccacagtgagaaggagccgagaggcggccctcactagagagctggggaggaggccacagtgagaaggagccgagaggcggccctcactagagagctggggaggaggccacagtgagaaggagctgagagggggccctcactagagagctggggaggaggccacagtgagaaggagccgagaggcggccctcactagagagctggggaggaggccacagtgagaaggagccgagagggggccctcactagagagctggggaggaggccacagtgagaaggagccgagaggcggccctcactagagagctggggaggaggccacagtgagaaggagccgagagggggccctcactagagagctggggaggaggccacagtgagaaggagctgagaggcggccctcactagagagctggggaggaggccacagtgagaaggagccgagaggcggccctcactagagagctggggaggaggccacagtgagaaggagctgagaggcggccctcactagagagctggggaggaggccacagtgagaaggagccgagaggcggccctcactagagagctggggaggaggccacagtgagaaggagccgagaggcggccctcactagagagctggggaggaggccacagtgagaaggagccgagagggggccctcactagggagctggggaggaggccacagtgagaaggagctgagagggggccctcactagagagctggggaggaggccacagtgagaaggagccgagaggcggccctcactagagagctggggaggaggccacagtgagaaggagccgagaggcggccctcactagagagctggggaggaggccacagtgagaaggagccgagagggggccctcactagggagctggggaggaggccacagtgagaaggagctgagagggggccctcactagagagctggggaggaggccacagtgagaaggagctgagagggggccctcactagagagctggggaggaggccacagtgagaaggagccgagaggcggccctcactagagagctggggaggaggccacagtgagaaggagctgagagggggccctcactagagagctggggaggaggccacagtgagaaggagccgagaggcggccctcactagagagctggggaggaggccacagtgagaaggagctgagagggggccctcactagagagctggggaggaggccacagtgagaaggagctgagaggcggccctcactagagagctggggaggaggccacagtgagaaggagctgagaggcggccctcactagagagctggggaggaggcaactgtctcccccatctccagctcaaactttccagctccaaaagtgtgagaaacacattcctgctgttttgcctttctggtctatggtgttctgttacagcagcccaaaaggactaaaatgggggcttatgatgactgcagtaagttattttttaccatcttctttctcttttttgagatggagtctcgctctgtcacccaggctagagtgcagtggtgcgatctcagctcactgcaacctctgcttcccgggttcaagtgattctcctgcctcagcctcttgagtagctgggactacaggcacatgccactgcacccagctaattttttgtatttttagtacagacagggtttcacactgttggccaggatggtctcgaactcctgaccttgtgatccacccatctccgcctcccaaagtgctgggatacaagcatgagccactgtgcctggccaaatatgttattaataaacagatattcacatagaaaccaactactaattagctagccatagcctgcgagtctccttagacttccttccaacaaatgaattctaaaagtaaactcaggctgtgtgccgtggctcatgcctgtagtaatcccagcacttcgggaggctgaagcaggtagatcacttgagcccagaagttcaagaccagcctgggcaacatagtgagatccaactgctaaaataatcagccaggtgtggtggtgcaagcctgtaggcccagccaaggtaggaggactgcttgagcttggaaggttgaggctgcagtgagccatgatcctgccactgcagtccagcctgggcagcaagagagcgagaccctgtctccaaaaaaaaaaaaaaagatttgaggcatatcaccacttacatgtaaagtataaagcaataaagcttccagaggaaaacacaagagtatcttcagaccttggagtagataagaatttcttgaacaagtcacaaacagccctaaccataaaaactgatatactgggacttcattataattaagaaatttctggcagggtgcagtggctcacacctgtcatcccagcactttgggaggctgaggtgggaggatcactggagcccaggagttgaagaccaacctggccaacatggtgagacccccatctctatttaaaaaaaaaaaagaattggccgtgcgcagtggctcatgccggtaatcccaacactttgggaggccgaggcgggcagatcacgaggtcaagagatcgagaccatcctgaccaacatggtgaaaccccgtctctactaaaaagtacaaatattagccgggcatggtggtgcacacctgtaatcccagctactcgggaggctaaggcaggagaatcgcttgcacccatgaggcagaggctgcagtgagccgagatcgcgccactgcactccagtctggcaaaagagtgagactccatgtcaaagaaaaaaattaaaaatgagtggatgtggtggcatgtacacgtgatcccaactactcgggaggctgaagtgagagggcggctttagtctgggaggttgaggctgcaaggagcatcgactgcaccactgcactccagcccggaccacagagtgagtgagacccagtctcaaaaaaaaaaattcagaagtttctgttcgtcaaaagacaacattaagagagtgagacaagctacagacgtgggaggaggattcgaaacatgtatatccaacaaaggactcgaatccagaatatataaagaactctacaaatctgtaagaaaaagacaactcagtttttaaaaagcacaaaagacgccaataggcacttcacacagaaaggacgtcccaacagccaagaagcatgagcaaaggttgtggccataattactcaccagggaaagcgaattaatgccgcagcgagtgtgctacacacctaccagaaagactacaactggaaaggctgatgatgccacatgtgaacaaggctgcggagccactgggactctcctacactgcttcctggtgggaacatgaactggtacaagcactacagaaaaccctgtggccctatctaatgatgagcacacccagacctcaggacccagacacccattcgcaggtaaactcccaagcggagggggcacctgtgtccaccgaaggaccaggtgcaagaacacgcacagcagcttcctgtgcacagccaagaatggaaacaccctagacgtccatcaacaggaaaaggagataaactgtggtctattcatcccatgaaatactacattgcaataaaagaataaactacttacacgctccaaaacagcacgttctagaacggctccagcccagacactggcaagccagatgcggacgactagagccacaggagctctccttccttgctgctgggagcacaaaatggctcaggtgctttggaaaagggtttggcagtttcttacaaaactcagcatactctcaccacaccacccagcaatcactcagaaaaacctgcacgtgacgtttacagcagcttcactcataatcgcccaagcccagattcccttcagcaagcaggtgaaaggataaatcaactgtggcgcacctaggcggtggaatattactcaccactaaagagaaagaggccacaggctgtgcagagacctggaggacagttaaatgcccatggctgagtgacaggctgcacagagaaaggatgcacagtgtgcaactccagctctacgaccacatgaccaagcgccggtgaaaagatcaatggttgctggaggctggggaaggagggatgaatgggtggagctcaggggatctttaggactctgaaagcactctgtatgaaactgtaacagtggttacccgtcactacgcattcatctaaacccatagaacacgcaccgcccagcgtgagcctgggtgtgtggtggaagctgcgtgatcctgagcccaggtgtgcagatacagcctgaatgatcctgagcccgcgtgcgcaggtggaggctgcatgatcctgagcccgcgtgtgcaggtggaggctgtgtgatcctgagcctgcgtgtgcaggtggaggctgcatgatcctgagcccggctgtgcggtgaaggctgcgtgatcctgagtccgggtgtgcggatacagcccgcgtgaccctgagcccgggtgtgcggatatagcccacgtgaccctgagcctgggtgtgcaggtggaggctgcataatcttgagcccaggtgtgcaggtggaggctgcatgaccctgagcccgggtgtgtggatacagcccacgtgaccctgagcccaggtgtgcggatacagcctgcgtgaccctgagcccaggtgtgtggacagagcctgcgtgaccctgagcccaggtgtgtggacagagcctgcgtgaccctgagcccgggtgtgtggatacagcctgcgtgaccctgagcccaggtgtgtggatacagcctgcgtgaccctgagcccaggtgtgcggatacagcctgcgtgaccctgagcccaggtgtgtggatacagcctgcgtgaccctgagcccgggtgtgtggatacaggctgcgtgatcctgagcccaggtgtgcaggtggaggccgtgtgatcctgagcccgggtgtgtggatacagcctgcgtgatcctgagcccgggtgtgtggatacagcctgcgtgaccctgagcccgggtgtgtggatacagcctgtgtgatcctgagcccgggtgtgtggatacagcctgcgtgatcctgagcccaggtgtgcggatacagcctgtgtgaccctgagcccgggtgtgtggatacaggctgcgtgatcctgagcccaggtgtgaggtggaggccgtgtgatcctgagcccgggtgtgtggatacagcctgcgtgaccctgagcccaggtgtgcggatacagcctgcgtgaccctgagcccgggtgtgtggacagagcctgcgtgatcctgagcccgggtgtgtggacagagcctgcgtgatcctgatgagtcgatgtggggcggctgactgcagctcgtgcaccacagtggaggggggcactgacggggtcaggggaagctgtgtggtgggaggtgctcagagtctacaggaactctctgccgatccattttgctgtgaacctaaaatgctctaaaaattacaagtcttttttttttttttaaattcctttctatatgattcccactgtatgaagcagaaaaccaagtgaagccagtgggcagcaggtgctttctgagctgctgcaggcctgactcatgtggatttgtcaggtggttcatggaaggtcagcacatttcatgcactttactatgcgtgctatactaggaaaaacagaccaagagaacagaaaaagaatttccctgagaaacgcgtcccaaacgaaaggctcatcaggtcaatgaagagagccccacctagcggcatttcagaaccgtcgcttcagaacatcaaagaaatcatcccaaaaggcctgagattttaaaaacagagatcaaaacacactggcattcaacgtctcttgctggtggacccggagcagatgctccccacattccatggggtgcctgtctcaaccccttggcaaccatcccagggggaaggggcaggagtttctctctcccagaccctttctctaaatacagtctcagcgtgtccccagcaaaccaaaggaggggcctgtgacctcgcagggtgcacggaggcaagcagaggagacagagtcctcgcagaacatgactgtcgctgcgggcaggaagggtggcccgtgagtttatttccatctttgcagttttctaagaaaggcaatcaagacttcaccaaaacagtaacagtcggaagctacattcacagatttccaccaaacctggcaggctgggtggcgggcgggagtggaggccgtgggccaagcttgcagcgggaccagggctgatatgaaaacttcaaccaaggcggtatggggagaacaaaggagaataaacaaaatttaaacaaacataacccatgataaatcaatcaatcaaaataaagggttttttaaaagtaagataaatacagccaggtgtagtggctcacacctctaattcaagcactttgggaggccaaggcgggtggatcacctgaggtcaggagttcgagataagcctggccaacatggcaaaaccacgtctctactaaaaatacaaaaattagccgggcgtgatggtgggcacttgtaactccagctactcgggaggctgaggcaggagagtagcttgaacccaggaggcggaggttgcagtgagcccagatcgcgccactgcactccagcctgggtgacagagcgagactccatctcaaaaaacaaacaaacaaacaaaaggtaagataaatacgaaatacaaaataagaggcaggaagagcccaaagcatcagaaatgtgccagttataatgggccaaaatcccctcttgtgtctccagaagtatttgaaaaatacgttaggatctgcctcacagacatgctcccaggacactcgacagcaaggaggtacggcgggcccagccagccaaggcagaggaggacatcactgccacagcagggggcctgactggcagcaaaagggacgactccggcgaaaagtcagcaggaaacaggacaggggctggaccaatggcctccctcagccccacaccccacccaggcaggagcggtgcctggcccggggcaggcgggtgggagagctcactgagtgggcagcagggcatggcccctgatgctgcaggtacccaggctgcagctgcagaacctcaggtgggaacccaggtacaaagatcagcatagggtcccccagaaccacccatccccagtaagactcaagaggggtgggggccccgcagcttcccccacacagtgagtggggtccacggggcctcctgggcctgcaggtcacaaccttcactgacactcacccctaattagggagcatgtatgttccaattttcatttctttcttgaaccaaaggtatttaaaaggcttttgaaaaggtaagatgagccatttctctttctctgttgttggtttccaatcctattgcaatgcacgcgtctgcaccgacactactctttgcaatttgtataggtctgaggcacgaccaactctagtaaagataccgcgagtttttgggaaaatacagactacattctctgtggagaacaaagctcttcacatggagaaaatcttgaagtcagtagaagaaaaaaaggagatagcctagtggcaccacaagcaatgggcagagctgggccccaacccaggcagcctgaggtcaggagggcccctgggcagcgcagccccagcccccacctggaggaactgtaaacgtgtgtgccaggaagccctgaaacagacaaaacaaaaaactgacaaaactgtgggtaggacaggacggatccagtcactgtgccaggtcttcatgcacactctcggtggcagacacagagaaccagccagtggagaggaagagggatgtgctgcgctgcacccgcttcctgcaggaaacgcattcaagcgcccaacacacatgcacgtccacaaaactggccttccacccggccacggctcgaagcatttccgaagactgaaatcacacagagggtgctctctactgcagaagaatcacaccggcagtcaggaagaaaggcgctgactatactcctctactagtaagtccacagcaggacaaggaaaaaagcacaagggaagcgtaaggatccatccactctgctgtgagggatcatcgcaagcccaactacccctgccagcctaggtgtgtcggtgctggccacccgtcggcagcagcagccaggagcagaggcaggtgctcaagagcccggcctcctggagatggcccaggagaaaacagccagggtgacgtgctgtccacaagagatgttctacctgtcccgaccaccttccagcatccacactaaggctgcaggacatggctgcaccgatcacaagaatccctcacgtggtcctcaggttcctgagagtgtactcaatgaaacagtgaagccaaagagatcctagcacaaagtatccctgcctggactgacccacggccaacccacactcaatggtgaagactggatgcttccccaggatcaaggacaagaggatgtctgttcacaccactgctattcaatgtggtaaacaaaaaaaacaaaaacaaaaaacaggcactagactagaaaggaaagataacacgatcttgtaccgaaaatcctaagtgatccgctaaaaaactattcagcataaaaaatgagttcagccaggctgcaagatacaagatcaatacatatcaactgagactaaattcgacaaaagaagtacaaaacttatactctgagaactaataaaattgttgaaacaaattaaagaagacccaaataaatggaaagaaatcctgtattcaggtatcagaagactttacactgtttaggcggcagtgttccccaaaatgaccaacatattaacgcaatccccgtcaaaatcccagctgacttcttggcagaaactgacaagctgatcctaaaattcatattgccactcaagggacttcaaacaggcagcataacacttttgaaagagagcagttagaggactcacagttcctgatttcaaaactgactgcgaagcttcagtgtcctgaacagcgtggaacgggcaccaggactgtcatgcagtcactaagccaaactgaggatccagaaatgagcttttaggtttacggtcaatcgattttcagcaagggcaccaagaggatgccaactggcaaaatacagtgttttcaacacatggtcctgagaaaactgggtctgcacgtgcaggagtgaaggcaggcccttaccttacatcacatgcaaacgctgactcaatatggaccaaaacctactggaaagagaggaaggcgcaaaactccaaaaaatcataagcacaaatcttcacgatttggactggattaggcaacatttgttagttatgataccaaaagcacagccatcaagagactaaataggtaaactggatactatcagaatttaaaactttcatgctccaaaggataccagcgaaaaataaaaagacaaaagaaaatgaaaagaacgcatgaaatggctgaaaatgtcctataaatcacacatccgataaaagacttgtacctaaaacacataaaatcacacatccgataaacgacttgcacctaaaatatataaaatcacacatccgataaaagacttgtacctaaaacacataaagaactttttcaactcaatcataagacaaataacccagcagacatttctccagtttgtggtgaactggcactttgacaaaacgcagtgagaatgtcactacaatatccaactgctataaatgtgttatttctgcctccatctcactgaggccatcaagcaatggctgtggatcctgtgggatccactgggttctccccaaacagccctggcagagtctgcaggacacccaggaggggactcagggcacaattcctcctggaaagcagcctgggctgggcgtgcagggtgacgaggaagtggcaggccatgaggtccatggctgagtcagtgccctccaccctagcaccaccatccccatctctgggacccgccgcacgctcagcagcatccgcggtgggaaataccattctgcagggtctgcgctctcgactccttccccagattcacgtggaagccgccacccagagtcggggttttgccagcacctggaaacacaaaaaaagacagatcagccaaaacttggagatctgcatttacaaccctttcctaacatccacagacacaaagtgagaacaaagcgggggtcagcactcatgggggaagcagcaggtcggccccccgcacctccgtcactgagccaggaaccccagtgggggaagcatctctcactctgcccagccagcagggttgagggtgggccaactgcactttccgcattttctttttttttttgagacggagtctccctctgttgcccaggctggagtgcagtggtcccatctccactcactgcaagctccgcctcctgggttcacgccattctcctgcctcagccttccaagtagctgggactataggtgcccgccaccacgcccggctgggattacaggcactttctgcattttctaaccatgtccctaacacactgcaagtccagagtggacgctgtcaaatggctgccgggcgagaacacagatgtacctccaaacctctgcaagtggtgcacacacagcatgggctggccgtcccccttgccccaggccagcccactcagatatcactcctgcatggtgaccacatgtgaacacatccacctccctgctggactgcaggggacgcaggtaccatcccatgtgccccaaggcactgcaaccagccagtctgcagaaggcccccacgcctcagtccacccacccatggggaggctgcagctgaacctgctggacactctactccgaagctctgccaactgacagcatgcctacgacgtccaccacattctgccctgcagggcttcggggttaagacctggccctggtacctctggaaacatcaggtggacatttggattgttcaccaggttcaccagcccgatcgctgcagcctgatctcccaatgagcatggtggacatgtggattgttcaccaggttcaccaacccaaacgctgcggcctgatcttccaacgagaacagtaaggtgaggccccaggcatgcccaaagatggggagagctggaaagtgccccccgccccgcagcgtcggccctcagtggttggcacaggggccagtgcatttgtgacaaagcacagacacaggactggaggctgctgcaatcgggacgcgcagacaaccttggccacttgggggaaggcaagtgtgtagggcctgtcggaggacactggaaggataggatgcagaagcagaaagccaatcgctggagcctggggccaggccctccagggaaaccatgaggcagggacctcagcgtcatccaggggcagccaccagcacagacaaggcagaacaggcacggcctctggcttcacaatgaatgtaactgaatcccaaacaaatactaacaacactctttaaagactccagtaaaatgattctaaagttcagttggaagcaaaaaggaattagagcagccaagaaaagttttgaagagagcaaggggcagctactgggcccgtccggaaactcagagctgaacagggtcaggtggcactcagcttttcctggtggcagcagaggcaaagcccgggcctccttcaggctgaggcccagagccggcctcctggtgggtaacgtggccacaggggtggccggcagcagcagcagggcaccagcactgagcacaggcctccaacaaaggtggtgccgggacgggggcagtgcctggagactacctaggttgtcacaactgggatctatgtactagttttctgtggctgccataaaaattgccacaaacctagtggctttcaagaagctgtagaaggtccgggcgcggtggctcacgcttgtaatcccggcactttgggaggccgaggtgggtggatcacgaggtcaggagatcgagaccatcttggcgaacatggtgaaactctgtctctactaaaaatacaaaattagccaggcgtggtggcgggtgcctgtgatcccagctactcaggaggctgaggcaggagaatcgcttgaacccaggaggtggaggttgcagtgagcagagatggtgccactgcactccagcctgggtgacagagcaagactccgtctcaaaaaaataaaaataaaaataaaaataaaataaagtaaaaaagaagctggagtggtggccgggcatggtggctcacacctgtggtcccaacactttgggaggccggagcaggaagatcgcccaacccaggagttcaataccagcctgggcaacacggggagacccatttctttctttctttctttcttttttttttttttgaaacagagtttcgctctgtcacccaggctggagtgcagtggcgtgatcttggctcactgcaagctctgcctcctgggttcatgccattctcctgcctcagcctcccgagtagctgggactacaggtgcctgcaaccacgcccggctaattttttgtgtttttagtagagacggggtttcactgtgttagccaggatggggggagacccatttctacaaaaaaaaactgaaaaaaattagctgggtgtggtggcacctgcttgtggtcctactactcaggaggctgaggttggaggatcactagagcccgggaggtcgaggctgcaatgagctgagatcgtgccactgcactccagcctgggtgacagagcaagaccctgtctcaaaaaaaaaaaaaaaaagaagctagaacaggccaggcatagtggctcacatctgtaatcacagcactttgagaggctgaggcaggaagactgcttgagcccaggagttcaagaccagcctggacaacatagcaagatcccatctctacaaaaaaaaaatgagcggggtatggtagggcatgcctgtggtcccagctactcaggtggctgaggcaggcagatcgtttgagtccagaaggtggaggctgcagtgagctgtgatgcacctctgcactccagcctgagcaacacggtgagaacctgtctgaacaaataataaactaaacagaagctggagcaggtcgcagtggtgtctccttgtgggggctggagaggacctggcagggccacagtgaggtgcctgctgatatgagaatccagaagagaggccagggagaaacgcaggactcaggagagacccatcctggaataagggggctttgagcagcactgatgagccaattctaaattctgcagaaatctggcccaggcctccccaggctgagctccaggtgcctgcaactccgaccctccctcagagttctttgttttgtgagcagtgtgtattctttttttttttgagacggagtctcgctctatcgcccaggctggagtgtagtggtgcgatctcggctcactgcaacctccgcctcccggattcaagcaattctcctgcttcagcctcctgagtagctggaactacaggtgcgtgccaccacgcccagctgatttttgtatttttactagagatgaggtttcaccacgttggccaggctggccttgaattcccgacctcaagtgatccacccacctcggcctcccaaagtgctgggattacaggcgtgagccaccacgccccgcctgttttttctaagcgttcgaattaagatcaccattctgtgtagcccctggcatgctggtctccagcacatgctccctcaccaactttcactttagaaaaagaaaaatctcactatattctaattagtgtatataatgcttttaataaataactcatataacactacattagaaaaaggacaatgatcaaagtataaaaagccagctgggtgcagtggctcacgcctataaccccagcactttgggaggccgatgcggttggatcacctgaggttgggagttcgagaccagcctaaccaacaaggagaaaccccgtgtctactaaaaatatgaaattacccaggcatggtggcacatgcctgtaatcccagctactcaggaggctgaagcgggagaatcacttgaacctgggaggcagaggttgtggtgagccgagatcgcgccattgcactccagcctgggcaacaagagcgaaactccatctcaaaaacaaataaataaaaagcccctgaagccccaccttccaagaacaggggacgccgtacagcctccattatagccacgtttccctgcctaggtacagtgggctgcaggcgtgcttctgacagaacagggccacagtgagatgccacgttaaattacagtgatgatttcgattctggttgtgttttacgcaatctcttcactccttgacccatacccatcagcttgcaccacagcacactgcaaagctgcatgcgtcagcagctccacgctccacctgccacctctgccctccctcctccatcactctgtcttgcaccctccagcctcccataccctcctcacaccccaggacctctgtttcctgtccctgtgttgttctccctgtcccccaacaccacagtcaccctccctggggccacgctgctgcacctgctctggaagcgcctcctggcttctgcttgcctcacaccctggtgcgtgcacacttgcaggcacacacacacaggacacatgtggacagtgtgaaacctcagaacactaacccacagggaggatgaaagaggaaagtgccacctctggctgaaactgccaggatgccctctacttctaaaaacatttggtattttccatagcgtgtttctataacaaaaaatatgtgctagttcccgttagctggaactgacatgtggaaggggccaggtcttgtggggcctggccaagactgcccccctgtgtacagcaagggaggacctgcggttccaccagagccagagcagggccagaggccgcaggggcacctctgagctccgacaaagccagcaacaccccataccgccgaacagacagaaaggcgggccaggggccctccatgtcctgaaagacccagcacagcactgtccatttcacaccaggattcttccaacatgagaaagcaataacctttaatattcacgtgctcattcaacttaactgggggcgggctcagtggctcatgacagtaatctcggcattttgggaggccgatgtgggtgggtcacttgaggtcagaagttcaagaccagcctggccaacagggcgaaaccccgtctctactaaaacatacaaaaaaaaaattagccaggcatggtggtgtgctcctgtagtcccagctactcgggaggctgaggcaggagaactgcttgaacccaggagatggaggttgcagtgagccaagactctgtcaaaaaaaaatttttttttaactggagactttctgttgctgctgtgaaacttcctttttttaagagacagggtctggccgggcgtggtggctcacgcctgtaatcccagcaccttcggaggccaaggcgggtggatcacctgaggtcaggagtttgagaccagcctggccaacatggcgaaaccccgtctctactaaaaacacaaaaattagccgggcatggtggcacatgcctgtaataccagctacttgggaggctgaggcaggaaaatcgcttgaacccgggaggcggaggctgcagtgagatgagattgcgccattgcactccagcctgggcaacaagagagacactccatctcaaaaagaaaaaaaaagaagtctcactctgtcacccaggctaaagcgcaggggcaccatcacggctcactgcagcctcaacctctcggactcaaggaatcctcccacctcagcctcccaaataggcgggaccacagacatgcgccaccacgcctagctaatgttttcttattttttgttttctttgtttgtttttttgaagacaagacagagtttcgctcctgtcgcccaggctggagtgtaatggcacgatcttggctcactgcaacctccacctcccgggttcaagcgattctcatgcctcagtctcccaagtagctgggattacaggcgcccaccaccatgcccagctaatttttgtattttggggttttttcttgttttgtttttttagtttttgtagagacagtttcactatgttgcccacgctggtctcaaactcttgacctcaagtgatcctcccaccttggtttcccaaaatcctgggattacaagcatgagctaccaaacctgactggaaacttcttttaaggggagacacctgtaggaggcctggctggctgggcagtaatggatggagaggaattcaggggtcccacaggtgagtgcccaaaggaggctggaccagaccgcagtgcatccctgagagctggggacggggacccgggaacacagagcgtgtgcctactggtggggctggatgcagtagcatcagacatctgggaggagcactgacaaacagggccaagcacggcagcccacaccccttcccaggcgcagacccttcccatgcgcacaccccttcccaggcacagacccttcccaggagcaaccctttcccaggcccacaccccttccccaggcccacatcccctccccaggtccagaccccttcccaagcccaggccccttccccaggccactgcggaggagctggttttgtagtgattacaatttggttacggaaaacaggacgtgtgtcacgctgcaggctaaccagcagcttcctccctcacccagatggcaacgggacagaattcacccgtttcctaagagcaggcaccttcagccacaacttagggttctgggggtcatggagcagaggcagaagcctggagccttccaccctcaggactagagccccgccaggaggccaggcgcatgctcagaaccccaggccgcagggagaggctggccggtcacatccttctctgaggcagagggagcttcccagcaggcgagggcaactccaccacccatgtccccctccagggccagcgccaggtgacatgcagccatgtcacaaattaggtccggctgcatcgtgaccccaaacggaaaacagcagcactcacggacaccccagcttcgaagttctaactgtgaagccactgaaagttgtgattacgggaaacgctccccacccccacaagttctggtgacactgaggtgtgctgctccttgcacaggacgaggagggacccctgcaagcaggagcccaggatgtctggtgtgtgggcgccatcaccatcacctgctggcagagggaagcctcagggcacacacagtgcaggacactgatgtgggctcacagggaagccccgccttgcctcagtggagcagacggcctcctcagggcactgccaacggcccccaactccaccgtctgcctggcccctccagccacgctgagcctcagtcctcacccacccttctctctgcacagtctctgctcgggtgccccgggacgctggagcaccagtgtggtttcccccgtggggcctggcttccaaggtcaggaccctctggggactctcctgaggcctctggtcacctgccctgatgccttagttaaatattccagagtaaactgcgaagctgtatcaggcttagttctcaattaataggcaaaacacctaggaaagacagtggccttgggactagaaaacgacagctcagagagaaagctcagctttcaagatgaagctggaggaaggggcggctggggcctacttgtgtgccagggaaactgagaagccaccaaggtttccagccccctgtgatcaccactgtgacgagggaggaaggatgccaagtgggcacctagagagcctgcctgggagacagaggggctgcccagagcaacagatcccctctctcctccccactctcggcccaggcaccacctgcgccggtccccaggggctaagaacccgccgcctcgcagcacttcccccaggaccaccacagttggttgctgggcctgcgcctccctccagagagtgtgcctgggctcagaggcgtcttggggccacctgacagcgctggctctgagcttgttctgacagcacccgggtgacagacttccagctctgcactgctccacaccaccatcctcccccggcagggcacagtgagggcagtgcgctgtcaccaggcccggatgcacttaacactgtgcctgcccgggaaaccctgcgtctgctgccatgacaacttgctttcattactgttgttatcatcccaacagacatccaagtcttggcaactgtgacacagctgcaaactctgtgcccagcagtcctaggaagatacccagggagtatgagcatggaagacgatggggagggaagagcaggagagaaaactcaatgaagcccaagccagttcttagaaaagatcaaaaacacggatcaacttctagcaagagagacaaagggaaaaaaagacacaaaacaccaacatctgaaaggaaaaaggaggccactgtggaccccgcagatatcaaaaggataagggaatgcttcgaacaactctctgggcaaattcaacaactaggtcaagtggaccaattcctcaacacaagcggctaattcaccccaggtgaaacacagcatcttaaatataactagaacctcagtgatgaaagaagccgaaaccacagtgcagaatcttctgagaaagaaagctttgggaccagatggctacgctggtgaattctaccaaacatttcagaaagaaagaacaccaactctacataatgtcttccagaaaatagaagaggaaacgtttcccaacccattccataaggagcagaaccctgatacccaagacaaggacgttacaggaaaaactacaggccaatatcccacgcaagcatcagcaggaaccctcaacagaacatccggcgctgagcaaagcagctcatgccgctaatcccagcactctgggaggccaaggtgggaggatgccttgaggtcagaagttcgagaccagcctgagcagcaaagcaagaccacatctctacaaaaaaaaaaaaaaaaaaaaaaaaattggcgttggctcacacctgtcatcctagaactttgagaggccaagacgggagaattacttgagcccaggagttccagacgagcctggtcaacatggcaaaaccccatctctacaagaaaaatacaaaaattagctgggtatagtagggcgcacctgtagtaccagcaactcaggaggctgagctgggagggtcactggagcccagggggttacgactgcagtaagccatgaccactgcactccagccagggtgactgagcaagaccctagaccctgtctccccaaccaaaaaaaaatttttttaattagctgggcatggtagtgcatgcccgtagtcctagctactctggagtctcaggtggaaggatctcttgaacccagaagttccaggctgcagtgacctgtgatcacaccactgcactccagtctgggcaacagtgagactttgtcccagaaaaaaaaaaaaaagctgggtgcggtggctcacgcctgtaatcccagaactttcaggggccaaggcaggtgtatcacttgagattagaagttcaagaccagcctcaccaacatggtgaaaccccatctctactacaaatacaaaaaccagccgggtatggtagtgggctcctatgtaatcccagctactcaggaggctgaggcaggagaatcgcttgaacccaggagggggaggttgcagtgagcccagattgcgccactgcactccagcctgggcaacagagcgacactctatctcaaaaaaaaaaaaaaaaaaaaaactcaaggagtgtattaaaaactcttaggggccaggtgtggtggctcacacctgtaatcccagcactttgggaggccaaggcgggtggatcgcctggccaacatggcaaaaccccatctctactaaaaatacaaaaactgcggccgggtgcaacagctcacacctgtaatcccaggactttgggaggccgaggtgggcggatcacgaggtcaggagattgagaccatccatgtaaccccgcctctgctaaaaatacaaaaaattagccgggcgtggtgctgggcgcctgtaatcccagctacttgggaggctcaggcaggagaatggcatgaacctgggaggcagagcttacagtgagccgagattgtgccactggactccagcctgggtgacagagcaagacgccgtctcaaaaaaaaaaacaaaaaacttagctgggtgcggtggcgggtgcctgtgatcccagctacttgggaggctgaggcaggagaatctcttgaacctgggaggcggagattgcagtgagccaagatggtgccactgcactccagcctgggcaacaagagcaagacaccagctcaaaaaaaaagaaaaaaaaaaaaaaacctcttagaacaagtaagtttagcaaagccataggaaacaggacaacacacagaaatcaaccatatttatataaacaagcaatgaagagttgaaaactaaattaaaaaaattccacttataataactcctaatagagcttaggtacacatctaaaaaatgtccagagggccaggcacggcagctcatgcctataattccagcactttgagaggctgaagtggggggggatcacttgaggtcaggagttcgagaccagcctggccaacatggtgaaaccctgtctctactaaaaatacaaaaattagccaggcgtggtggtgggctcctgtaatcacagctacttgggaggctgaggcacgagaatcgcttgaacccaagaggcagaggttgcagtgagccgaggttgcaccactgcactccagcctgagtgacagagcgagactccatctcaaaaaaaaagtccagaagctgtatgctgaaaactacccaacactgacagactatatcaaagaaaatctaaatgaatgcaaacatacactgtgttccatggactacaagattcaacatagaaaaaatgtcagctgggcacagtggctcccacctgtaatcccagcactttgggaggccgaagagggcggatcacgaggtcaggagttcgagaccagcctggccaatgtggtgaaaccccgtctctactaaaaaatatacaaaaattagctgggtgtggtggcgtgtgcctgcagtcccagctactcagaaggctgaggcagcagaatcacttgaactcgggaggcggagggtgcagtgagctcagatcgcgccactgcacttcagcgtgggtgacagggtgagactctgtctcaaaaaaagagaaagaaagaaaaaatgtcagctctccctaaatatatcaagaggtttaatgcaattccaatgaaaaccccaccaggacttttgtacaggttgaacatcccaaatccaaaaatctgagattataaatgctccaaaacggcccggtgcagtggctcacgctggtaaacccagcactttgggaggctgaggcaggtggatcacgaggtcaggagatcgaaaccatcccggctaacacggtgaaaccccgtctctactaaaaatacaaaaaattagccgggcgtggtggcggtcgcctgtagtcccagctacttgggaggctgaggcaggagaatggcgtgaagccaggaggcggagcttgcagtgagccgagatagtgccactgcactccagcatgggcagcaaagcgagactccgtctcaagaaaaaaataaaataaaaaataaatgctccaaaacatgaaactttttgagtatcaacacgatgctcaaaggaaatgctcactggagcatctcagatttcagatttttcgattagggatgcttaaccagtaattataatgcagatattccaaaatcagaaaactctggtatccaaaacacttctggtcccaagcatttcaggtaagaatatgtgacctgcagagatgcacaaacttactctaaaattaaaaagagaaagggaaattaatagccacaacaactttgaaaaggaagaacaaaggttgagggactcacaatatctgatttcaggacaatataacaggtatagtaaaaaagcgtgtgatgctgacaaaggaaaacggcacctgatcaacagggcaggacacaaggcccagagacagacctgcacggacggggcccagtgagcacagccgagggagcaaaggccttcagtctttcaacaaacggtgttgaaacaaggggacctccagataaacaatgagcctcagcctacaaagcacaccttatacaaaacatagatggaccacagatttaggccaggtgcggtggctcgcgcctgtaatcccagcactttgggaggctgaggcaggcggatcacttgaggtcaggtgttcaagaccagcctgacgaacagggtgaaaccctgtctctactaaaaatacaaaaattagccaagtgaggtggcgcacgcctgtaatcccaggtacttgggaggctgaggcacgagaatcacttgaacctgggaggcagaggttgcagtgaaacgagattgtgccactgcactccagcctgggccacagagcaagattctgtctcaaaaaaaaaaaaaaagttaaaacttctgctttgaggccgtgcgcagtggctcacgcctgtaatcccagcactttgggaggccgaggtaggcggatcacgaggtcaggagatcgagaccatcctggctatcacagtgaaaccccgtctccactaaaaaatacaaaaaaaattagccgggcatggtagtgggctcctgtagtcccagctactcgggaggctgaggcaggagaatggcgtgagcctgggaggcagagcttgcagtgagccgagatcgagccactgcactccagcctgggcaacagagcaagactccatctcaaaagaaaaaaaacttctgctttgaaaatcacatatacaacaaagggcttgtaactacaatccacaaagaactcccaaaactcaacaataagaaaacaacccaaataaaaaatgagagtcagggtgtggtggctcacgctgtaatcccagcaattcgggaggccaaggctggagtatcacttgagcccaggagtttgagaccagcctgggcaacatagagaccttgtctctactaaaaataaaataaaataaatgatcacagcatggtggcatgcacctgtagtctcagctactcaggaggttgaggcaggagaattgcctgagcctaggagttcaaggctgcagagagccatgactgggccattgcacaccagcctgggccacagagtgagatcctgtctcgagataaataaaaaaataagacttgagcacacatttcaacaaagaggattcgggcatggcaaataagcaccctaataaggttgaacatcactagccagtagagaaatacagaataccactatgatgagatgccacacacctgttagaacaaccgaaataaaaacatcgacaacaccaagtgctggtgaagatgtggggcaactggtgagaatgcataatggcacagccacatcacaaaacagttcatgacagtttcccatagagttacacatacagctaagttccccagagaaatgaaaacgtatgttcacacagagagctgcaaatgaatccttttagcagctctattcacaaccacctgaaactggccacagtccagctccttccacaggctggggtccatccccagcccgcaatactgcccatcactgaaacgtcccctccgaggcctgcagcagcctgagtggccctagggcatccgcccggtaaccaccaaggccaagggcagcagcaatcggattctaagtaccagacattgctgaaaacaaaactgcaggcacagagagtgacagtgaggggcagcttgaggggccttctgggctccccaggctctcttcaaccctccctgtgctggctgccctggcccacgcgtgtgtcgaggaagtccacgcacgccacgggggtccacaggcgcgcgaagaaggtctacattctcgccaaggggatccacactcgcgcccagacggcgcagaaccgcgcgccccgacagagcgtgcggtaccgaggcgctggtcccggccgcgccgtcaccgcctccagcccgcctaagccgcaccgagaaatccgcgcagcgccagcccgcgggactcaccgtccagggacacgaactggcccacggccgaggagccgccgccgctgctctccacgaactgcacctcggacacgatgatgttgtcctccagcactgagccgcaggcggtgcacaccgcgtccccgcgcgccgcgtccagctcgatgtccgtgccgccgcaaccgcggcacacgcggcccgtcatgccggcgaccgcgcgggcagcgcccggagcctcccaagactctcaagccacccgagcctccggagcagcccgcgccgcccgcccaggcccagccgcccaggcctcgccgctctcgcgaggccccgctccagccgattcgcagccgcagattcgccgcgcgcgcccgggccgcgccgcccgcaacggccgcgcccgcgggatgggacaggcaccgggaccacggcggggacgcgaggactggagccgcgacctccccactgcgagcgagctggcctcccttgcggcgcgccggcgtcggaggggcgacctgcgggggctgggcttcggcggaacccgagcggggcctaccggtgagcgcagccgaggactggcgcttgggggcggggccacggcggtgagcgcagcccgggactggagtttggggcggggcctcgtcggtgggcgacaccggggactagagctaagggtggggcctcgcggtgagtgcagccggggacgggacccaaggctggcgacgggacccaaggctggcgacgcgacctaaggcagtgggcgggcccttggcgatgaacgcagtcggggactaaagctggacgcggggcagaggagggtcctcctcggatagtgagcgcggtctccagcggcgagcgaggcctggggtgaggactcagccggatgcggggctgagggtggggggcggggcctcccgtggagagacggcctgcgaagggaactggagctgtgggcgggggaagggggcggagcctgggtctggacccgaactgtgggcggggcttgaggcgagggggccgagcgtggtgggcggggccttggctcctgagggcgacctgggacccaaccccgggctctgggagtggtgggcggggccagggcagctgcgctggggggcctggccgcagaggtggagacacccgccaggggccaccctgccccgccctccgcatttgcggcgtccgccgctccgctcgcccaggttccagagcctccccgtgcgccccgctattctccgttttctgttcccctaaaattcccactttctagcagtcattcgtggccacctgtggttacccgtgagtcacctcgctgtgccccctgcccagagcgggaaccctggctgcgcacgccctcaaatatctgcaggtgctgttcacaatcgccatagggccggtgacatacccaggaatgagcctaaaaagaaatgcgtaaccaggcgtagtggctcacgcttgtaatcccagcactttgggaggccaaggcaggcggatcacgtaaggtgaggagttcgagaccagcctggccaacatggcgaaaccccgtctccactaaaaatacaaaaaaattagccaggcttggtggtgggcgcctgtaatcccagctactcgcgagtctgagacaggagaaccacttgaacctgagaggtggaggttgcagtgagctgagatcccgccattgcactccagcctgggtgacgggtgacaagagtgaaactctgtctcaaaaaaaaaaaagagaaaaaaggaaatgcggaagaccccaccctcttttttttctttcttttttttttttttttgagacggagtctctgctctgttgcccaggctggagtgcagtggtgagatatcggctcactgcaacctctgcctcctgggtttaagcgattctcctctctcagcctcccgagtagctgggattacaggtatgcaccaccacacctggctaattttgtatttttagtagagacggggtttctccatgttggtcaggccagtcttgaactcccgacctcaggtgatccgcccacttcagcctcccaaagtgctgggattacaggcatgagccaccgtgcatggccctatttcattaatttctgctctcatttttgttagatccttctttccacttaatttggttcaatgtgttccctttttctagtttcttcattttttaaaaattgagatagtgtctcattctgtcacccaaggtggagtgcagtagcataatcaagcctcactgcagactctacctcctgggctcaggtgatcctcccacctcagcctcccgagtagctggaactacaggcatgtgccaccacacccagataatattttttgtagagatgggtttttgcctcatttgcccaggctggtctggaactcctgggctcaagtgagccacccgccttgtcttcccaaagtgctgggattacaggcatgagccactgctccccgccctgtcctcccaaagtgctgggattacaggcatgagccactgctccccgccctttctctagttcttttttttttttgagatagagaacacccaggctggagttcagtggtgccatctcagctcactgcaacttccacctcccaggttcaagtgattctgtcacttcagcctcccaagtagctggaattacaggcatgtgccaccacgcccagctaatttttgtatttttagtagagatggggtttcaccatgttggctaggctggtcccaaactcctgacctcaagtgatccacctgtcttggtctcccaaagtgttgagattctacacgtgagccaatgcacccggcccctttttctagtttttgttttgttttgttttttgaggtggagtctcgctctgtcacccaggctggaatgcagtggtgcgatcttggctcactgtaacctccacctcccgggttcatgccattctcctgcctcagcctcccaagtagctgggactacaggtgcccaccaccatgcctggctaattttttgtatttttagtagagacagggtttcactgtgttagccaggatggtcttgatctcctgacctcgtgatccacctgtctcgccctcccaaagtgctgggactatgggcgtgagccatcgcgcctggccttttcctagttttttaaggtgaaagatgaaatcattgatttaagatctcttttcctttataaataggcattttattgctataattctccctgtaattaccactttagctgaatcctgcacatttcaatgtgctgtgttttcattttcattcagctcaagattgtctccactcttaatttcctcccggatccaagggttattaggaagtgtattgttttgtttctaaatgttggggatttttcaaatatgtattattgatctctatgcaaaatgctctctgtccatgatgacatttcatccttatggcaacactagcttgcagacactgttgtctccattttatggagggagcccttgaggatgtgaggggtgacagccccaaatctcatagccagtaggtaacaaagccagaatccaatctgaggccatgtggccactggatccttgctctcacctgacagactagaggggttatttcgtgtgctccctcaccaaagcctgtgaggtgcctgcaggtgcaaggggcagcatgcctcccaggccacagcggtgcaggacagtcaggcagtacaggacagtcaggctgtacaggacaggattggccagaggagcagagggtggggaagaccacacccacaacggtaagaggtttaaagggtgtggtttcagccaggctcggtggctcaggactgtaatcccagcactttgggaggctgaggagggcagatcacgaggtcaagagatcaagaccgtcctggccaacatggtgaaacccatctttccaaaaaatacaaaaattagcaggtgtgatggtgggcgcctgtagttccagctactcgggaggctgaggcaggagaattgcttgaacctgggaggcgggagttgtggtgaggcgagatggcgtcattgcacttcagcctggacgacaagagtgaaactccatctcacaataaataaaataaaataaaataaaatataaaaaagggtgaggctctactgggcaatggcccaaggtgcgtgctgccagaactaagcctttgctcagatgggctgcagaggaggggtgctatggtctgaatgtgcattgtatcagtctgttttcacactgctgataaagacatacgtgagactgggcgattaacaaacaaaagaggtttattggacctgtagttccacgtggctgcagaggcctcacaatcatggaggaaggcaaggaggagcaagtcacgtcttacgtggatggcagcagggagagagagagcttctgcagggaaactccctcttataaaaccgtcagatctcgtgagacttattcgcaatcacaagaacagcacgggaaagacctgcccccatgattcaattccctcccaccaggtccctccacaatatgtgggaattcaagatgagatctgggtgggtacacagagccaaatcatatcatgtgtgttcccccaaagtccatatgttgacgtccttgccccaaggcgatggttttagagaggtggggcctttgggagatgaggtcatgagggctgcttccctcatgagcgggattaatgccctcagaaaagtggctggctgggcacagtggctcacatctgtgatctcagcactttgggaggctgaggagggaggattgcttgagtccaggagtttgagaccagcctaagcaacatggcaaaaccctgactctacaaaaactacaaaaacttagccggttgtggtagcatgtgtctgtagtcccagctacttgggaggctgaggtaggaggattgcttgagcccagaaagttgaggctgcagtgagctgagatcacaccactccactccagcctgggcgacagattgagaacctgtctcaaagaaaaaagaaacaagaaaaaagaaaaaacgtggctggagggagcttgtctgctgcttcccccatgtgaggatgcaggaagagggcactgtctatgaaccaggaagtggccctcaccagacacggcatctgccagcaccgtcctgtgaaatgaatagtggtttataagccacttggactgtggtggtttgccattgcagtgtgaaccaactgaggcagggagtaacgctccccacgtgatgtgaaggcataaagaatggagccaggttagagggagaatgcggagaactgccctggggaccggttaggtgccccatgctgcaagcgccccaggaagcttggaaacatttaggactgactgacaagctcaaagagtcaagcaagggcggccaaggggcaccagtgccctcagagcacccacactgggcacccagcaccagcttcctgtgcccagggtcctctgtactcctcattcagccctgcaaggcaggaccctcactcgcaccgcgccaaagaggacgctggaaacgtgcagtgatctccgctctggctgtaaacagggagaggctgtgggcttgcccctagacctgactccagcacacagcagcagagcggggcccaggctgggggtgtggggcaggaacattccttcatgggggccccagagagctggaaagtaatgtaggtgttgcactgaaatgagagaattgctttaatctgaactgaacgtgctcgtaacacttagaccaggaaggatttccttttctcagggcctgagaaaaatgacctgaccagcagggttagagttttgaaggacacgcctaggcacctgcaaacttcccctcctggaggctttcttcattcatggtgtcttttgtttttgggtttgttttgttttgttttgttttgttttgtttttgagacacagtcttgctctgtcccccaggctggagtgcagcggcgccatctcgactcagtgcaacctctgcctcccaggttcaagcgattctcctgcctcagcctcccgattagctgggattacaggtgcatgccaccatgcccggctaattttttgtatttttagtagagatggggtttcaccatgttggccaggatggcctcgatctcctgacctcgtgatctgcccacctcaacctcccaaagtgctgggattataggcatgagccaccacacctggcctgttttttgggggttttttttgagactgagtctcgctgtgtcgcccaggctgtagtgcaatggcacgatcttgatgtaccgcaatctctacctcccgggttcaagcaattctcctgcctcagcctcccaagtagctaggattacaggcacctgccactgcgcccagctaatttttgtatttttagtagagtcagggttccatcatgttggccaggctcgtcttgaattcctgacctcaaatgatccatctgccttggcctcccaaagtgctgggattacaggcgtgagccaccgtgccaagccccatcgtgttctcatctgtggtgctttgacatcttggggtctcgtggacctagagagggactcccctcccagggttagctaattcctagagacagctgaccacttgcctctgagtatgccttatttactttattttttctttttttcttttttttttgaggcagggtctcactctgtcacccaggctggagtgcagtggtatgatcatagctcactgtcgtctcaaactgctgggctcaagagatcctttggccccagcctcccaaagtactgagatcccaggcttgagccaccgtgcaggctgagcatacctttgatatgcagagcaaccatcatgagtcccacctgcctcctttcatcaggctcctgcattcctgaacactagccccctgccctaaatcaccccaaggccaggtaccagctagctagataccacccccaagcccagagcccactgaaatgacccagttctaattctgctcagcttgcctcctctgccttgcctggaaaatggcaataaaggctcttgcccaccctttcccttcaccccctccctgtcctgactggccctgggtgcttccccacgtgcccctcctcctgggaactgtgagtaataaactcctctttcaaaggcggttgtctctgtgtctgtcatcttatcacatttgatcaaaataactcctgggtactcaatagccctgtccccccatgcagcagtcagcaggggaaatgagaaagcaagcttctatggccttctcaccttctcacctgctgcctggccttgggcaagtgcttcaatctctctaggtttctacttcctcatctgcataacagggataagaatagcccaccctagcactgcggagtatgatggaggacatgtgtctggtagacagactgctcagaaggcaagtccctgttcctgtctgttctccgcaactcgagtgagacttggtgaggctccagtccaccttccaccacagaagtcaagggccaggccaggacagtggctcacgcctgtcatcccagcactttgggaggcagaggtgggaggatagcttgagcccaggagttcgagaccagcctgggcaacaaagtgagatccctgtctctacaaaaaatttaaaaattagctgtgcgtggtggtgcgtgcctctagttcagctacttgggaggctgaggcaggagaatcgcttgaacccaggtgactgaggctgcagtgagttatgatcacaccacagcactccagcctggaccatagagtgagactctgtcccccccaaaaaaacaattaggccgggcacagtggctcacacctgttatcccagcactttgggaggctgaggtgagaggattgattgagcccaggtgtttgagaccagcctgggaaatatggcaaaacagcatctctaacaaaaatacaaaaattagccaggtgtggtggtacatgcctgtggtcccagctactcgggaggctgaagagggaggattgcctgagcccaggagacagaagttgcagtgagctgagatggcaccattgtactccagcctgggcacgacagaggcagattctgtctttttttttttttttttttgagatggagtcttgctctgtcgtccgggctggagtgcagtggtgcaatcttggctcactgcaacctccgcctcctgggttcaagtgattctcctgcctcagccttctgagtagctgggattacaggtatgagccactgtgcccagctaagttttgcagttttagtagagacagggtttcaccatgttggccaggctggtctggaactcctgacttcatgatccgcctgcctcagccccccaaagtgctgggattacaggcatgagccactgtgcccagccatgactttgtctctaaataaataaataattttttaaaacccttagggacccagcacagtggttcacacttgtaatcccagcactttgagaggctgaggcaggaggatggtttgagtccaggagatctggcctacagtgagccatgatggcaccactgcactccagcctggttgacagagcaagaccctgtcaagaaaacaaaagaaaaaaaaagaaaaagacaaacaaaacctaacaaaaccagaaatccatcctgcacgaagagcactgaggttgagtgttggttgacacgtgttgcggtaattgctgttctgatgtctgtgaatgtccttggctgatttctgtattagggcctgggtgttttcctttcttttctaatatttaagttatgtcctggcttattgtgatgatattctattgtgggaaagaaagaagtgttaaaatttatgcatcaaggtccctcttaatcttggggctcaggataaccacagtcaagaggggagagttttattcctgaatccaggtcatgctgtgttcaactttacaccctgatttgtcacacaatcacatatctgagaatttccccatgttgctaaaactgaggcagcgttccgttttgctggttattccacatcccatggggtggatgtgccagggcaagttttgtcatttcccctggactggacattcctttctgtaggtgttgctgtttgaaatatctcacacacctggacctgtgtccctgttgacatttccagtgtcacctgcaggatgccatgggatacccatgagcccaggcaaatctcccaagacgctgccaagccactctgcagagctgctctgggtcctgccccaggtgctgtgtgagggagctgcgctgcctgcgcccaacccaggaggggagcagcgtgcaggacaccgaggatgtcatcacgaccttaggtctgtattaggtctagattagcctgcattaaggagaaggtggtgatgtgtgtcttttttttttttttttttttttttttttagacggagtctcactctcttgcccaggcaggagtgcagtggcacaatctcggctcactgcaagctccgcctcctggattcaagcaattctcctgtctcagcctcccgactagctgggactacaggcgcccgccaccacacccgactaatttttgtatttttagtagagacggggtttcagtgtattggtcaggctagttttgaactcctgacctggagatccacccgcctcggcctcccaaagtgctgggattacaggtatgagccaccgcacccagccatgtgcatctttttataatttacaattcgtgatagtagtgacaactgtctcacttattcttttgtgaatcttttgtagcttctctaaccattttccactgggaattttttagtggtcttatggacttgtatgatttcctttgatattaagaatgttaccctagtgagccaggcacagtggctcacgcctgtaatcccagcactttgggaggtcgaggcgggcggatcatgaggtcaggagatcaagaccatcctggctaacacggtgaaaccccgtctctaataaaaatacaaaaaattagccaggcgtggtggcaggcgcctgtagtcccccctactcaggaggctgaggcaggagaatggcatgaacccgggaggcagagcttgcagtgagctgagatggcaccactgcactccagcctgggcgacagacagagcgagactctgtctcaaaaaaaaaaaaaaaaaaaaaagaatgttaccctagtgaaacattcagtattcttacaaagatcatcctcaatagtttgttgcgttgggtgagggttccctttgcacgtttggttttttcaggacggggcgcagccccagccagatggcgcccggctctccagccagcggcagctcaccctgctgtggtttgattttccctacacaattaatacatgttcatcatggagaaaataggagataaagataagcaaaaaggagaaaccaaatcaatggaatccccatcacacagagatactttcttaacactttggattaatttgtatcctatcaatatttttctatacctgaaaataggtgttttatatgtataatcactaacatgtaaatacatactgcacatggacatgcattttcacatacatttttgttttcttgagacagagtttcactcttgtcacccaggctggagtgcagtggcacaatcttggctcaatggaacctctgcctgctgggttcaagcgattctcctgcctcagcctcccgagtagctgggattacaggcgcgcaccatcatgccccactaattttttgtatttttagtagagatggggtttcactatgttggccaggatggtcacaaactcctgacctcaggtgatccacccacttcggcctcccaaagtgctaagattacaggcatgagccactgtgcccggcctttttatttttattttttgagatggagcctggctctgtcccccagactggagtgcagtggtgtgatcctggttcactgcaacctccacctcctgggttcaagtgattctcccacctcagcttcccaagtcactgggatcacagatgcgcaccaccatgcccaggtacgtttttgtatttttgttagagatgggactttgccatattgcccaagctggtcttgaactcctgaggtcacgggatctgtgcgctttggcctcccaaagtgctgggattacaggtgtgagcccctgcgactggcctgtttttagctacttttaactcactatttctgccagctgtagaatattctatcaggttctatcatggctcacctaaccctgttctactctacaaccccggggttgattccaggcctcactctcagcagttgagctgctctaagggtgaccgtgggaactgtccacaggtgcggctgcgggtgcagcgatctcagcggtcttagagctcttggccatcccccacatggcttcccagaaaatgcctccaggaggagggccctgctgtaccttttttgtgaccattcctcctcagcctcagtcatggccatgtgctccaaccatgggagtggatgcggcagggcctgtctaggggttcggcagttctgtccctctgccatagcatgggctgggcagggacctggccacgtggggctgcttcctcagcccagctcctggcaggagaaggagtaggggcgctgtgggctggagccgccaactgaccagtgctggccctggaggaggcccctcccccactccccgacttcagcagggcctgctgtgtgtctgtgtcatcttagcccaggctgaggagatgaatgcgtttccaagcagcccatggtcctggcgcccgactggaaaagcctgagccttcaccctaggtggagggacctagcgaagccaggcggacagaggaaaggcctcggcccatcctgtcccatgactgggggttggggcttcgtctttttaataccaatggaatcctagccaagcattcagaaccttgaagctttaacttcttaaataataataactcccacaacctccggggaccccgggcagcacgtggtaggaccagctttcaggttgtcctcctgagaccccagggctctgaaggatcctcttcttggacctcctccccaaccgtgcccagccaccccagtcatccgagaggtttgtctcaaaccaagttcctgctttaaagaaaacgctaccagagaaagcacctgtgctccaaacacgggggtgagggctcacaccatgccagggtcatagcatggggagggatgcctcccagccttcaggggatctcctcctgtgacccacagccctcaagagaaggaccagcacagcatcattttccgacagaggagggcagtgcaaataacaagttctggctaaaaagttactctgatcacccaagggacatctgtgcacttggaaaatacagaagaccacagtcccatcaccaccatcccaccttaaaaacaaacataaacgtggtcgcaggcgtgacacatggtgtgtttcgtgtccctgctttcctgcctggcagaagcattgatgtagacccaccatacgggttcttcgggccactctggtacagactgtgtgggtcatatcccgacccctggcagctgcataacctcacaggccgccatctcctcttttgtcacttgggatgggacagaactgtcacgtcccttaagggctcacaacggtgcctggcacagaggaggggcaccgctcaatggtggcagctggtgccaagccctgctgtgcacggcttagtcaccccgcatctcctcacttgacccccagttgtagtccctgcctgggttagacgctggcatacacaggcaccatgtgtcaggcggcccatccgtctgactgcaactgcacgctcgccaggtccagcagcgccgtacgctcagttctggggtcaatgggtgcctgtctcctgccctcccatcacagacagcctgtcctcctggggtatggctaccccctctctggacatagtcacttctccccctaccctgtctcaaaggtatgagatccaccggccctctgcccgccgagcagctggccaaggtcagacagaccctcatggctctcagtgtaccaccttagaggagccaggggcgcgtgggaaacacagagtcccttgttctctccgaagtgggaccctgactttaagcagtcgcagctgtttgcagttctagatacaggagttacagctggaggctgagctctctcaacggaggaagcagcggcatgagggcctttgcagaaggagctgacggggcactggggtggcaagccccgtgggccaggaaagaaaccagctccaggtcaatttgctcgggctggatttgtttcagtaaaactacttgtagacaagacacagggcgaagagaaaagcaactgtaaactaactgtgaaacaaggaaacagaagagaggccagaaaaccgtttcctaaatctcggcttggcatctggtgctggaccacagccgctgccaaacagatgggggaagcaccctccctgagccccagagcctacacgtcgggccccagcggctctagccattgcctcctctttgcttgggtccccaagttcactgttaaccccagggccaggagccagccttggccccagacatttgttctccattgtcctgagcacaacgctgaaaagcggcgctgaataaggatgctgggacgcaaagagggcgcccggggtcatctggagccctggaggctaagctcggcagcctggcgccccgagtggcttcgagtccccgcgaccgccgccaggcccggccacctccttgccacctccctgcgtcccggggaacccacgcaggggggcgcgagggaggggctcggggacgggcggggcccgcacagccgggccaacccagcgggggtcggcaggagacaaggggcggcgagggcaggggggcggggagactcggggcatggcggggtggaggcgggaaagtgtcgaggccggggaatccgcgcgtggggaggtgggcatcgccagggcgacgatgagctttccttagggggcggcgcctgaagctggccgggacccggtggacccccacgactctcccggcccttgcccgcggctcccggggggcggggcggggcgccccgggcggggtctgtgcgcaggcgcgtgagtgcgcgctctcgcgcaccggcgggcggggacgccccgtgaggcgccgccggaggaagcgcgcgcgcacctcacttccggcgcgcgctgcgccggcggcgattggacccgaggcggcgagctggcgccccgcccagccaatcggcggcgccggcgcgggtcggagggcgccgggcgcgcgcggggcggccgggggcgcgcggggcgcgggcggggcgccgggcggggcggggcggagcggccgcagctcgtcgccgcccgcgggcctgtccgacgccggggcccggcccgtcccctccgccgcccggcagccatgtgaccgcgccgccgccctccgcgcgcccggcccgcccgccgcgcgtccgcggcccggccgcagccccaggccgccgagggagcggcggggccggcgccatggccgagcgaggccgcctcggcctccccggcgcgcccggcgcgctcaacacgcccgtgcccatgaacctgttcgccacctgggaggtggacggctccagccccagctgcgtgcccaggtacgcgccgcccgccgcgctttgttcccgccgggcacctgctgggggtgtcctggccgcggcctctgcgcgccccatccccggcccgggtcccccagcggagcccaggtcgccccccgcgcccccgcccgccggttcgacgcgtgcagccgccgcccccccgcagctccggcaagcgcggccccagccccccaggtcccgagcaccgggggccgcgctcagcttccgaggacccggtgctgctcagacccggcgggaccttggggctcccgggcggcgctcacctggctcgccgcaaccgcacctgcacacctgcctcaatgcggtgccggccggggtgacgagggtgcttcctctctcgggtaccacacgcttcctttcgcgttcggcgacactgtcagacctcggcctgggagcgacccccggcgcacggggcgcgcaggactcggttgtatcctccgtccagcgcgcggtggagatgccctgtcctgcggggcggggtcgtcctcgcgggtacctggttggcgctgtctctcatttagaggcgtcgccaagccagtactgctatttgcgcctcccagttgatcttgccattgcggaagactggctgttctgcacttggtaggggggcgcccggtcgcccagcggtaacgattggacagggtttaccctccggccatagcccagccttccttggacttgcagcttccctgagtctcctgctcagtttgaaacttttgtaatttcttcgtgacttggtagttcctgctcaggaagctcccaggctaaggaggagagagacacgctctccggaaaagttctggttctagaatagacagcaggcgagaagaggaggcggttgggggtagtgagagttctccctggggagatgggagggtgagcggaccttccaggcactggaagtggccagtatgcctggaggggaccccacgtggcattgagttgttccacccctagtcagctgcaggtgggcctctccgtgctttcctgtggctcccacagcctgcatctctgagcgtggtgttggagttgcagagccgctggacagtggggcttgccctcctggagcgcagggttgggacctcggggctttggttttgctgagtggacaggaaggatgcccacccggcacgactcttgcacctggcggggcctcccgaaggacccagtgtccatatgagacctaagggtcagcatttgcccaaggtctggggccgagcactgcagatgtgcctgcttgcctctcttctgggaagtctctggggcctcaaagccaaagccaggagcatctccccaggcctggctgcttctccattccaggtcttggcgattgccccaatgtcaggtcccacagccccacagcccttctcctgtctgcccctctgagtcactgcctcacccacagccccagaaccttcatgcgggctgttggcgctcccctgctccagcactgcagcacatagcctgcccttgctgaacctctgcagcagcttcctggggccctccgaatgagcagcaaagtctttaacccaagggaggtgggggcgtgtggcaggaggggccgggggccttatcagcccccctgtggagctgtgctctattctccaggggtctagaaagcccactctggtgtctgtggggagggtatgggtagggcgggtttcgagaagcctggttaggacaggcgggggtagatgggggcacctgggctgggtagcactaagtgctggggggggtcccgagctctggcctggacagggttgggaggaagggtaggcaggaggacaggatttgttctgttggtgtggagttaatgggcggaggagttaatgggcggaggggcgagtggcgcagctgaccaggtgggcagatgcagtttgttcgtaggacatgctcagcctcataatgagctcctgcccttacctgtcctggaacagggcccctcataggcgggcttgcccctagctttgctttgtgcttgtgccgcctgtccgtgcatcctcggacagtctgctacttagttttgctttgttcctcctgagttcttctgtactcctcacttttgcccagccatgaagcttctgggctgcgtgtgtgctgatgcctttcggcgtgttcactgctgcgtactattcactggcgtgacagtacctcggctttgcttctgtcaagggaccttggcttgtttccagttttttggttaattacaagccccgtgctgctgtggacatcgtgtgccagtcttctgcgtgtgtctttctggatgggcagggcctgtcttaagcatgtaccgccagctaccaggatttatggtgggggtgtgcacgcactcagcgttactgctgggcagttttccagagtggttgtgcctgctccggcccccactgacagggacgagagtccccactgctccacatttgtgccaacactcatttgacttaatttttgccagtctggtgggtgtgaagtggtatcgtggttttaacttgaatttctctgattactaatttaggccatttgtacttccttgtcagtgaaattcctgttcctttgccagtttttttttctctttttttctgcttgagtttcagcagtttctttagagatagtcatcctttctcggctgtgttgaggatgtccccgtccagttatgagcgagtctttgctctctgagcagcctctgggtgcactccccgtgtcagcctggtggagtgtgcacattgactgtttgccaggctggggtgctggtctcgtttcggttctccttctgggaggcagccggagaagtctgcccccgggagcttgaactgggcatgctgggctgttgttggggaggcctgtgctccgggtttccttgcgacgcttttggctcagcactgttacacacggtgctcctaggtggtccacggggtatgcgtcagtgcctgtctgtggcctctgcctcctgggttcccagagtgtcctcctggtgcccatgtccctgagcgcccccacctgctcttcagcaagggctgggctgctttgtaccttgcccttcccacttgattgttttttcggttgatgtttattaatttgtttttatttatgtattttgttgttgttgttgcagagacagggtctccctatgttgcccagactggtcttgaactcctgggctcaagtgatcctctcacctcggcctcccgaagtgctgagattacaggtatgagcccctgggcctggccatctgtttggtttttagagacagagcctcactttgtggcccagactggggtgcagtggcttgatcatggctcattgtaacccctaaaacctgggctcaagcagtcctcccacatcagcttcctgagcagctgggactacaggtgtacaccaccatgtctgtctaatttttttgttttgttttgtttttttgagacagagtctcactctgtcaccaggctggagtgcagtggtgcaatctcggctcactgcaacctccgcctccctgtttcgattttcctgcctcagcctcccaagtagctaggactacaggcgcctgccagcatgcccggctaatttttgtatttttattttatttatttatttatttatttttattttattttattttattttgagatggagtctcgctctgtcacccaggctggagtgcagtggtgctgtctcggctcactgcaagctccgcctcctgggttcacaccattctcctgcctcagcctcccgagtagctgggactacaggcgcccgccaccacgcccggctaattttttttatatttttagtagagatggggtttcaccgtgttagccaggatggtctcaattttctgacctcgtgatccgcccgcctcagcctcccaaagtgttgggattacaggcgtgagccaccacgccctgcctattttatttttttgagaagctctgtcgcccaggctggagtgcagtggcacgatctcagctcactacaacctccacttcccgggttcaagcaattctcctgcctcagcctcctgagtagttgggactacaggcgtgcaccaccacgcccagctaatttctgtatttttagtagagacagggtttcaccatgttggccaggatggtctcgatctcttgacctcgtgatccgcccgccttggcctctgaaagtgctgggattacaggcgtgagccaccacgcccagccagaattatctttttaagtttcacacaaagccacatttggtttataattggaagttctttaactctgtagagcaggttggggagaattgacgtttgtgtggtactgagtcttctcattcatgatcaagctatttacttaggtcttgaatgtattttgagagttttacaagattctgctgtcatgcatatcctttgttacatttattcctagatgcttgtattttagaagtcatagtaaaagtcagctttttattatgtttgttgctaacatatagaaattcagttgatttttcaaagaaatcagtgattttactatttttaacctagtaacttatctatagattattttgtattttcaaaatgtatgttttgtcttttgcaaaagacaaagttgtttcttttcaatcctcatacttttctttctttctcttgcctgactgtgccagttgtcatagtacagtgttgaatatggttggttgcgtggattacccgtgttctgtcttgaccttaaggaaggtttccagtgttttacctttaaggacgatgtttgctgcaactttttgtggatagcctttatgcacttaaaaagtctcatcctattcatgacttgcaaaggctttttaaagaaatcattatgagtggatgttgaatataatcaagtactttcattaagaggattatataatttttatcttttcattactattgtggtaaattacataaattgattttatttcttttcttttctttttgagacagagtctcgctctgttaccaggctggagtgcagtggcgtgatctcagctcactgcaacctctgcctcccaggttcaagcaattcccctgcctcagcctcccaagtagctgggactacaggtgtgcaccaccacgcccagcgaatttttgtatttttagtagagacggggtttcaccgtgttggccaggagggtctcgatctcctgaccttgttatccgtccacctcagcctcccaaagtgctgggattacaggcgtgagccaccatgcctggccgtaaattgattttctaacattaacctattcctggaaaaatactagtttaagcatgttgtattaccctttttaaaaattggtggatatatatttatttatgtatttattttttgagacagggtcttgctcttttgcctaggctggagtgcagtggtgtgaccatggctcaagcaatcctcctgcctcagcctcctgagtagctgagactacaggtgcatgccactggcctggctaattttaaattttttgtagagatggggtctcactatgttgctcaggctggtctccaactcctggcctcaagtgatcctctcaccttggcctctcaaagagctgggactccaggtgtgagcctccctacctgcccacattggtgggtttagatgatagtatcttgtttaggacttctgcatgtgtgtctggggtctatgtgcttcctttcttctgtagtccttagcagattttggcgctaagatttccttgtgaaatgaaatgagtactgcctcttttgctgtatcgtggtatagcttatgtaaaattggaatcatttcttccttgaatgtttgggataattcacttataaaataacctgactggccgggcctggtggttcacacctgtaatcccagcactttgggaggctgaggtgggtggattaccggaggttaggagttcgagaccagcctgggcaacgtagtgaaatcccatctctactaaacatacaaaaattagccaggcgtggtggcacgcacctgtaattccagctactcaggaggctgaagcaggagaatcacttgaacttgggaggcggaggttgcagtgagcccagatggcgccactgcaaaaacatttttttttgaacctgctttctgggtcagtgtgtcaattttaatgcacgttctgtttatacttaaaaggaatgtgtgtttggcagttgatggtgcagtgtttgtctattagatcaagcttggtttactgtggtcttcaagtccgttccctttttttgtctactagaaatgtatgttaaaatcttataatctgagaatagattggtccgggttttctaacagttctgtcagtttctgtttgatactttttttttttccagacaggatctcactctgtcacctaggctggagtgtagtgggacgatcacagctcactgtagccttgaactcccaggcttaatcgatcctcccacctcagcttcccgagtagctgggactacaggtgtgcaccaccacacctggctaaattttgtattttttgtagagactgggtttttccatgttgctcgggctgatcttgaattcttgggctcaagcagtctacctgcctcagcctcccaaagtgctgggattataggcatgaaccactaacgccccgtcacttaatatatttttgaggctatgttattaggtacatacatgtttagaattgtaattctaggtattttgaacttttctcattgtatgactgcttttatatctagtaatgctttttgtctttagtattgactttgatgcaagcattcttttggataatttttgcctgttagctatttttctatcctttttaaaaacctttgtatatccttacatattagatgtgtctttggttattcagcatgtatctagatttcattttcattcactctgaccttttctgacttttttttttttgagacagagtctcgctgtgtcgccaggctggagtacagtcgtgcaatcttggctcactgcaacctctcctcccgggttcaagcgattctcctgcctcagcctcccgagtagctgggactacaggcgcctgccaccacgcccagttaatttttgtatttttagtagagacggggtttcaccatgttggccaggctggtctcgaactctcgacctcgtgatccgcccgccttggcctcccaaagtgctgggattacaggctgagcctctgtgcccggcctttttttatttttattttttattttttgagacggagtctctctcttttgagatggagtcttgctctgttgcccagggtggaatgcagtggcgcaatcttggctcactgcaacctccacctcccaggtcaagtgattcttgtgcctcagcctcccgagtagctggaactacaggtgcgcgccaccgcacccggctcatttttttgtatttttagtagagacggggtttcaccatgttggccagactggtctcgaactcctgacctcaaatgatctgcccgcctcggcctcccaaagtgctgggattacaggcataagccaccacgcccagcctaccctgtacattttaatgtgcatagttaattgtatctttactctcctgctgaactatgcagggaccttagcccactttattctaatccaaccctttcatgtttatatttatatgattttgttactgtgtatcttaattgttttcttgtgaagcccacaagatgttgttactgctttatactgtgatatttgatgagcttcaaaactcaccacttcctttgttgctcattcttcttgcatgtcaggaatcattttccttcttctgttgaatatttgttcttaggatttcctttagtgaggatctgctgataactaccttctctttctgtttgtctgaagatgttttagtttaccctcaccctgagcagggcgtgtgctggttgtacgatgctggggtggtgtgtgctcctcccacaggtccaggcagggcgtccctggctttgacttccagctttgctgtaagaggtcagcggccgtgacaggctggagggagacgtctgggtggctttgtggtcatgtcatcgttgccaacggtcgtctcatggtgggtcctggtgtgggttctcttgtgattgcctgagtcggggttactagacttgctgactttgtggatcgatgattttcatgagtcccgggaagctctcagccactttttcttctgctgttggttctgcgctattctctctctcacctctggagcaacaattggacgtgttgctcttcctgccggatcctccacatccatagatgcactgggtggtgtcagtgggcggcggctggctggggcagtagcctgtctccagcccttccccctgcctctgtccacgtgcaggggcgtctcctcaggacgcatgttgcctactgaccgctgccagcctgcacgagactctcacggcgggaccctgtctgccttgctcggtgctgcccagagcctgcacagtgtagctccttggcggacgttcctgtaatggaaccaggatgtcatgccaaggagtgtggtttcattttgagtggtggggaagtcgctggactatttcaagtgtgtgtatttgggagagcagtgctgctggagtggtggaccacactggaggtggagattgcctcagggtgtgcaggtggagatgggtgggaggtgtcgtgcagggcttgggacagggctttcggaggtggtctgcagtgatccagggaagatgggctgctctgagggaggggctgaggaagctgacctgggcagccagtggcctgtaggctgggcagcactcgagctggggccaaggggcagcaggacggtgcccgtagccctggaggccttggggattcggaggacctggcccatcgccgtggcctgcacggtgcgtgcacaccgctctgtccgcgcaggctgtgccctgctttcaagatgcctggaaacctctggcagctctgtcctgctgtcaacactggagtcacatgtcagtgggtctcctgctggggactggcttttgtgcaggagatggagggcagggggctacagtgcccttggactaaaggatgctttccttggatctgggcactagaaccagccctttccctctctctgcccagcattctcagcatgcgtctcaggaaggtttgatggagtgggcagctgcggtgctgtggcggggtcggggggctgctgcagagagcgggtctgcggtcagtcacagtgacgggggtctctttggaccctgtgacttgtgtgtggtggtggcaggcagtggcgttgccgagacagggtgctcaggtgcaggtgggaaggggtggcaggatggaggttgtacagtgctttccccaggaccagggggcagggtgtggcgtgcttattcctgcctggccgtggagggtctctgtaggacaggctcccgctgagggcagccctgaggcctgtgagctgctggccccgcagggtggctgggcctggctggctcagcagctgctctgagaggcagccctaaaaatagccgagcgctgagaggccgtccctttctgctccgcaggcgcgcgccgatgtgtgctcagctcaggccgacttagcagggttgtgagagtgatgagagcgtggctgctggtcatggtgctggggtcgtcagcagctcctcgagggctccggcctgtggaggccggtggcgccccgtctcaccccacggatggggggcaggctctccaggagccccagggagcactggctactgctgggctgctctcaggcccgggacattcatggccgtagccccaggtcctctgcatggtcaggggccatgctgggtcccctggggtgcagatgccgctcaacagaggagtcaggacccaaaaggggcagaaatgggcaagggaagacactggggaaggggtgggtctgcccttcctgctgggggtgcacacgggcctggggctgagcaacccgctctgggcctggctgttccgctccactgccccaaccagcctttcctcagcaccccctggccaagctgtgggcaccccctgcccccggacacaggcagcacctggccaagtgcagagacactccagctggctcttcgcctgtgtcccagccctgagggcaccgtcgtagggtggtgggacgggggggggctcggacacagtggttgtggaggggtcagtgctgtggctcggggtggggtggggctgggggagggtttgcttcagggtagcggctctcttcaggggttcagcaaggagacagatgggttctaatgacccctgagtcctgagacaaggtggggtgagctggagcaggggaggggacttggaagggccttcagtccccatgcagcccttgcacaacctttcgggccaacatcctgggccttgcttggcagaggagtttgggatccacgggcttgaggcccaggtggtcagctcgctcggtgcaatgctgtgtctcgcatttctgtctctcgactgccccatccagcccgtgtcctaagagcagctggcagcagccgccacgcacaggcagctcagctcagcagccccaggagccaggtgtgtcttgagctgggcagcaaagtggccatgcagtccagcctcccttcagccttccccaggatgcctttcatcttggggagatggccattgtgggggtgaccagcactgtcccttccctggcaggccaggatgtggatccacagcgaggcagacctgcagatgcacatccctcttctcaaatgctgttcttgttctggtgagcacggggaacggcaccaagccaatgctgatgggaagggccctgaccttgggctgctgtcctgcgagcttggcccctctgctgggcccctcctccatgcctttgtttactctccaaccttctgggagtcccacatctgcatcaggacagaggtgaccagggaccagttgacagctaggatgccaccagcatcttttgtttaatttgagtctcatttcccagtgtaattctgtagctgaccttgcaggaggcattgacaatatttctttattgtatggccccagccaggacttccctctttttagatgcaaaataattgggcaagacttttcatgggcattgcatgctgggctcgtgcaggtgtctccagggccgcctcgagaccagcgcccgcctccctggtcctggatacaggtggggcgggggctcccccgcagcagtggagttgagacccgcacctgcttcctggtcctggacacgggtggggcgggggctccgcagcagcagtggagttgaggcttccgtatgagctcgctcctggtcagtttgagggtggacataccagacatcctgcatcttcccagtcgccccaggagcgcctcaggagggtgagtggcaggaggccgatgccctgctagcaggcagtccctcggggccaggccttcctggtgcggtgctgaattgggctgttcgttcctctgagcaccaaggagagggatggcggctcaggcttcaggcagtgcccgccggtgcctctagaaggtgctccgtggtggggcccgggagggtggcccttccacattctcgggctgcctgtgtgccacccaagtgtcaggtcatgaggcccctcggtctggcctagggctctccttcctcccccacctcaagcctggggtgtggcctagccagggaggggagcgggagctctggccgtgaagacccaccctgaggtctgggctctcctggcctgagcgtgctttctgctatgagctccacgttcaccctgcggccaggactctactgttcctcctggtgggagctgctgtggtgccctgggtggcctccagtcaccgccagcctgccccttgcagtcagtcctgctgttccttcggctcctgcagtttccagcttggccctggacttcctgtttttcccacctagctggacgtaaaggttgtcgcgccttggaaagttaagtcactacacccgaatcgacgcactcttggctcgcctggctatggcttcagctggaaacggagctgagcgtggcttatgtttataaatacagcacctatcaggtccagcgtcgctgtctcctgcgggaggtgtcagctttgggcgtgaagaacagctgcaaggccacagggccaaggggtatctcaccagctgggaggccggcgtgcctgacctggccacacagagcgagcctcagaagcgagggggaaggagggcaggccttggggaggggtccaggaaggtcgagaggctgcagtggtggtagcctgaggggatgtgcgcggccaggtcagtgcctgccgctactgcctgctgcgctgactgcctgagcactggggatcgtgggcctgaggggcggggaccttggctcccgtggatagctcctgcaccatcctcttgcttctcagaccctcggcaagtggtgacagggggctggggtggagttgttctcctgccgtggtcctgtcaaatggtgctgggggcggggccaggaatcacagcaggtgtctgccgctagcgctcggagcctgtgctgggggcagggtggtgcatctcatgcctctgccgcttgctcactgtacttgcctggggaggatgtggcaggggcagaggacagctggccaggctcttggactgcacctgactctggtgggctatcgaaggttttggaggtttctttaattagcaacatgatatccagagattgcgactgtggctcgagcggttccctgccagggagcaggaccattgacagccgagccttgactcaccggcccaggccacccgaggggccattgacaactgagccttggctcaccggcccaggccacccgatggaccattgacagccgagccttggctcaccggcccaggccacccgaggggccattgacaactgagccttggctcaccggcccaggccacccgaggggccattgacagccgagccttggctcaccggcccaggccacccgaggtttcactgcggattctatcagaacagtgcctccccccaggattcgtcaaccttcagtggaccaggccctgcagtggttccagttattccctgggaaaatttccagcactgattagggggtgactcttggtcagaggttgagtgtttccctaggtgtggaggtgcacggagaagagaggggtgcagttcttaaaggacacatggcttatgccacaccccctgccccaacccccggagtggccagctttcctttgactggggaggaggcagctgtccagggttgtcctcacctctcctcctggagaatgtggtcccttcagaaaggggacccagtagtgggtgacctggtgcaaaccacccactgcctcctctgggccttcctggggctcttcggctctcaggagaggagggagctcaggctgtggctgctctgtgagttggacacggacgctccagccgctgggcccagcagtgtgaatggccatagagaacaggggcccagaggctgctctcgaggacactggcagcagttgtgctctgggctcgccatccttgaagctggaatattccacaagtgccacgcacttgctggaggtactgcctgggggtagactgtggccaggccctcccagcagcccgagtcttggcgcgtgggctggactcccacactcagcacctttctgctgacctgaacacccagggcacagtggcagcggcgtcattaggatttccaactagctgtttctgttaagagtgaagaggaaaccttgtttgattagactcattgtaaaaaagattccagtgaatctcttgcctgctgtctttgcagttgcctctaagggtcacgaggcagggcggcgtcctctctcagtgccactgtgacctggcagcacctcttttgcatattattgacctagagagagaggtcaattgtaattcggagctgcacagtcggaaaatttgtagcaacagagaattataggcgctctaggcattcgatgaatcttctccaccttgctgtggggttaattcaggggagcagtggggagtgtgctgggagtgagattagagggaggactccctggaggctggccctgcgccctggaggccagcatggccctggtgctggctacatcctctggggctcttcctcatctgtctgcagaggaggcagctgtggagcgagggtgtgtacgggagcaggatgggctgcacagaagcctttccgggggtgcctgtggtttgcaggggcctggctgcagctgccctgtgtgatctctgtccccgtcttctcccggcttccttgggtcctgtgtgcccaacttggcacttcaagatttgctccctggcaactgttgcctttcccagaagagaagtccctggaaccaggaccagcctgctgtcacctgcctgctgctcctgccccaccagaaccatcctgagtccaaactggctgagagtcaagggggtgttcagggcctccaggagctctgggagagtctaggatgctctagatccttgggctcatggggcagtagagtggggggctgtggtcctgggcaccctctggagagaccgctctggtgtcagccaagtggcgggcaccttctgggcttgggggcggggcttctcacgatggctcagggaggtccagacagcccccttgtctaggtgcgcacctggagtcctttcctgcgtgacttgcaaacaggccttgcagggctctagtgtatcagctcccggactgcaggcagcagcaaactctgccgtgtggtactgcttctcatggacaggagaccaccaggctccttccaggagggtgaggtctctgcagcgggagcatccaggcctggaactcgagctgtggtgtggtggtgccagcccaggagccaagcacagccaggagatgaaacccatccctgtggtctgcacgtccatgccagggccgagcccccagctgggatgccctgggagggtgcagggtgggctctggatgcctgctgggggatttcagtgagaaccaggaagggttgagccagagcctccgagaagcctggggtccatgtgtgggaaggaacggggacagggagcctccgagaagcctggggtccgtgtgtgggaaggaacggggacagggagcctccgagaagcctggggtccgtgtgtgggacggaacggggacagggagcctccgagaagcctggggtccgtgtgtgggacggaacggggacagggagcctccgagaagcctggggtccgtgtgtgggacggaatggggacaggagcctccgagaagcctggggtccgtgtgtgggaaggaacggggacaggagcctccaagaagcctggggtccgtgtgtccgtaggaacgggggacaggaggttgtgaagggcgtgtgggttccgggaggctcactatagtgatgtcctgccttagacgaggtcacacaggggaaggttactgtgccgcagagttttctttccgagcactcaatgctcacctcctgggagggagtggggccgcagccagccctgacccagctgggtgtgtggccgctctctggacccccggtcccagggtggcagctagtgcagcctaggccacaccagcatgacccctcgcccctgtctccacggagcaccgtgggactctggcatcagaatcctggggccccacccaacacccacgcatttcctgtcttttctcaggcaatcgccatggtacccagggctggccttgtttcagcttcctgacgagtgccctgtggtcagtcatttctgtcctcgcctttacctcaaatcctgctttttgccttaagtgcgttcccaattccatctctgtgccagctgtgccccatgcagcctctaccggcatctcacgtgatgtcaaccttctgggtccttggggcctagccttgctctggtgaacggctttgttggatgctggggttggcattttttttttttttgagacagagtcatcctgttgcccaggctggagtgcagtggcacaatctcggctcactgcaaccttgcctccagggttcaggtgattctcctgcctcagcctcccgagtagctgggattacaggcatgcaccgtcacacccagctaatttttgtatttttagtagagacggggtttcaccgtgttggccaggctggtctcaaactcctgacctcaggtgatctgcctgcctcggcctcccaaagtgctgggattacaggcatgagccaccgtgcccagcctgggttggcttttaactggcaagtttagtctgtgtttctgtgcgatgatatagttgcatgtattcctgtcattttgatcattttgattgtgtttattacgtatttcctctcctaagttttgttatttcctcctcggaaattaaggaaggatcaagactgattgaatttatttgtatttttgagacaggttctcactctgttgctcaggctagagtgcagtggcatgatcatagctccctgcagcctcaaactctggggctcgagtcatcctcccatttcagcctcctaaagtgctgggattaacaggcacgaaccattgtgcctggcctgagttttatgtattacccactccaggaaatcactgtagtccttttaactgttactgatttgcttaaaatgtgaaaggcctgttgacatttaaggatagtcaacaaccctcccaccctccaaaggaaggagagctgaaatgcaggagaaacagcaatgcctttgatgagtatggctttgctgctactttgctcacctgtggccctgcctttcccaaggatagtttttgttttcctggagcacatccttcagaagctctttcagtctttcagtgcctgaagatggcgtttttgtccccctcatacttggtgatcacagagttcttctaggttgacagttttgtctcctcggtactttgacgattgttttattgtcttctggcctctgttgtggttttgaggagtctgcgatcagcctgctccttgttccttgtgggacacatgtgtgatctgtggttgcttttagcgtttttattttgatttggtgcggatttgttatcaacattgcttttgatcctccttgggacttactgaatatgagcatctctcttcttgttttggaagaatcctcagtcagacattgcatctccttccttgggtggaagctgctcagtcactgtcctgtgccttgccgtggggctgcctgtgcctctgtgcctgcttctccttccatggggagcccctcccagcccctcactggcgctgggaagcacagtggtcctcccctctgtgggctgtgttgagaaatgttgctggctagtcccagacccacaacacggagcacgggggttttgcctggtgcccgtgatatcagtggggagtgagaggagcaggtggccccctcggctgtgttcagggtgtgcctgtgtggccgaccacctccaggactgaggccacacaggaagcagttgggattgtgaaaacccccatgggaagctgtgctgatcctcccctgagcctgtgacagctgagggcacaggcaatggtggggctcggtgcctggggctgagttgggaaggtttggtgtctgacccacttcttcccaagtgggagctccctcctcgggcactgcatggcttctctgcggggcctctgcctggtcctctcgtgggcggtccaagacctggagcccaggaggtggattctgaggtctgagtcccccgcaggacagcagttccatcctctggtccctctcctgcccccaggggccagtaggttacagacaccttcctgaaactccctggaggggagcagccttgattcctaaacaagaagttggtcctaagtgcatcctcttgatgtggggcagagaagaaatctgagacagtctcatgcccccaccgccatcgtccccccacttttttgtgggggtgcccaatctgtgctctgccccctccccaggctccgctcctgtgggctgcgtcgtggtttctcctctctgtgggacgtgtgctgggcccctgggggtggatgcagaccgagcctgggcccatgtagaccaactggcgtgggtgtgagagagagagacgcatacccactcaggcacatacacgtgcacacacacacccatgcacgcgtgtgcacacacaccctggccctgttccctaccagtccccaccccctcctgctgcatgtgctcctggttccctctcttcacctgacagctggagtcatcctcctgcccacagccgtgccctgtgcagagcaggtgctggttctgccctcccctggcctgccccaggcggggacactacactgggaagctgccccgttgcaggcgttcccatggcgccactgctgtgttagctgcctgcagcacaggccggccagtcctggggtgctggacagaccctcctggaagccagtccctggccgtcctgtcctgctgggggcacagtgtctcggcagaaggttctggctgctccctggggtgctggcttgtgtcacctggctttgctgggtcccagtgacatgcagtctggggatgttcctgggacccgttgggcttgcggtggccacttgggaaagctgagcactgaaagtgccaaaacctgggacaccttcttgcaggcccactcttcagcctttgccccgtgggccattggggagggaggaggtgggaggttttggcaaagcagcccaaaggtccacacagacccagggctggcaaccggcccggcctgtcacccttctcactgagggtcacagcctgtggcccatggcagggctgcccaggacaggggcttggccccggaggcctgcagtgtgaggcgtggcccacaggccttcccagagggggttctgggagcctcccccagctgtcacacgcacctgcctgtgcctcacccgggctaaaatagcccctgcacagaaacgcccttgctgggcagggcccattcctgctgggagacacctgtcagggcccttcctgcctggggccatatggagtgtccagcctgggggtggtcgtggggtgtcgggggcctgggcctggatccacgatgccctgtctggtctagagcctggcctggcttccccttggcgtgactgcccacaggcagtggccgccgtctgctcagctgcatcctcctgcgttgggctcatctgtctgccttcccctgacacctcctcctgccagactccagggccaagggagtgggccccggctgcagaggcagtgccagctagctgagtgggtcaggccacagaccccacctgactccagggcagcgtggccaggagagcattggaaggagagagctgttcccaccttgaggctgacgcagaccagacctggctctgtcctgagcagcagaaagtatgtgcagggcttcaccctcttccctctgtctgtgtagagctccacctgaggcccagtgtgtgcgtagagtcccacctgaggcccagtgtctacgtagagctccacctgaggcccaatatgtgcgtagagctccacctgagggccagtgcctacgtagagctccacctgagggccagtatgtgcgtagagctccacctgaggcccagtgtctacatagagctccacctgagggtccagtgtgtgggtagagctccacctgagggccagtgtctgtgtagagctccacctgagggccagtgtgtgcttggtgcccacagctgagttagcccaggctcgtggtcatgctcacaggtgcacgtggccacacaagtcactgagcacagacccagatgggatgcagctcataacgtgcactgcgggggggagctgtggcatcttttcccagagcccctctggtctggcagcctcgggagtgtgtgcatggtatgggaggtgggaacagagctgggaggggctcccctccatggggtggggttcccctccagctgttggtgaggcacactgtacacctgcacacctgtgcctgggactgttgggctggacgtgtaggaacatggaatggcccctgggccttcgggtgactgagacagaagtacaggcccagcaggtctgaggacagggcctcctgatgactggacccagcctggacaatggccggcagctcccagccttgccacaggctgactggaatgcgtggtgtggtggagcccagcactgagggccggacgtgtgtttgcagcattgttctcacagccacctcggaggcttccctgctctggggcagatgccgttgctggagccgtggtgctcccagaggcaccctgggctcagctcagcccccataggccagtgcctggagtggctgtgacgctgtggccggcgcctggcgtggctgtgacgctgtggccggcgcctggcgtggctctgacgctgtggccggcgcctggcgtggctctgacgctgtggccggcgcctggcgtggctctgacgctgtggccggcgcctggcatggctgtgatgtgctgactccggcaccatcagttccttcccctattctggggcaggtggggaccacctcttcaccctccctcatgggcagggctggcctctgctgaggtggcccctcactgggcccaggcatggagacccagtggtcctagccctcggtgtagtctatccatgaggcacctggctgagcctgttcctctcactccacagcagcctccttggccctgaccactggccaacgaggacactgagaaggcaccctgaccttctgtcctcattagcagggagcagccatgtccagataaggctgtacatcagagaaagctgagtgaggctggcaagagctggcagccgccctcggccgcccgggcgagccttgggacgggctgggtggtaagtgctggtgatgcaggagcagagagccccgtggaactctctccatgaggacggcggtgccctggggcccagctacgaggatggctgtgcaggcacctggagcctggggatggcagggcgtgggctgagcatgtggagcaccagcctgtgacattcctctgcccaggggcagcagggcacggagcgtgtgtggccagctgccgccacaggcccccagctcccacgcgggcaggctcgcgaccgcaccaagggggcagctcctggagacaaaagctcctcagttttcccttccaacaaaacacagtcagcaggtttgggaccagctgcctggggtcttaaccatctgtgctctgtgcgcgcccccacccccttgcctgcctggaggaaagtggtggggttgacatgcgcctcgagggccagccgggcgctggtgcatttctcagaaatccgtgaagtgctcccttgtcctgctcgtgttctgtgctgtccttgggagtggcgcggccgcttgccagggctgcagagttggccacgcagcctctccaggaggccttgagccaagcacaggatgcagcccagcagtggtggcaccgtggagtggctgggcggaagagatcctggtccacgctgctgtctggagggcagggtcctcaggtgaccagagtccgtgcaggagcgagtgaggacagggctggggcaggcggcaggatgaggccgcccagagcaactcagtgagtgaatgagtgaaagcacgcacgccccatgctccagcggggccagagtgtgctgttgggtgagtctggccttccttcctggggttgtgggccctacttgtgggaggccactgtggggagggcgtccttgtagaagtgttaatcagagtgaaagccagtccctgtgcactgctgctgggaatgtagcatggtgcagctgttgcggggaacaggacggcagcccctcgggaaatgagacagagttaccgtcagagttactgtgtgagctagcagttgcacttctcagtagaacccgggagcactgacgcagggcctccaggggagatctccaccctgtgttcacagcagccttactcacggtgactgcgtgatggacgcagcctgtatccatcctcggacaaacaagtcagcaccatgtggccctccgcaccacccagcatcactgggccctcggtcagcaccgcgtggccctccacactgtggaatattacttagccctgaaaaggaaggaaatggacacaggctgcaacgtggatggaacttgagtatattgtgctgagtggaataagccagtcacaggaggacatgcactgtatgatcccatttgtgtcaggtccctagagtcattgcattcatagggacggaggtaggatggtgcagcctggtgatgccaggggccggggaaggtgggaatggggagttggggttgaatgggtagtttcagttgcgcaaggtgaagagagttctcgggatggatggcggtgagggctgcacaacagcatccacgcacgtagtgccactgacctgcacactgaaaaatggttcaaacggcaagttttacgttatatttaccacaataaaaaagagaaatagacatcgtcaagctgttctccaaaataaggctgtcaccgtttaccttcctaccagaaaaaaacagttaagtcccaaagccagggggagcaccagtgttaacctcctgggttggggctggctgagcccgtggctatgcctccctgggcttaggtggcaaccctgcgaggagcttgggcctctcgtcttttgggttcctgttcaaaatgggaagtggtctccaaaccccagggcccacctgagccccctgagatgggaacctctccagacctgcccctgagatcctgtcccacccctggacaagggcctctgtgcctctgaacaaaactggggggcctggtgcagagtcctagctcaggcttccagaagtcagtggtttgaaggggtgcccacccttgctccgttgggacatagggacgcaggtgcctgtctcagcccccacatgtgcacccccaggggcagcagcgtcccctccagtctctggtttgcatcatgcacaggagtgggtgggtgggagtttcagtctcccagagagcatactgttgggccatgctgtctctggcctcctcacccatggaggtcctgccccgcccccatctgaggctgggtggccgaggggtctgttctcagactggggcctggcgctggcccggtttcctggaggaggaagcgggggagtgacctgcggaggacttccagcctccccttccgcctgctgtgggctgcatggcgctggggctctgcccagccctggagagtgttggctgctctccttccagctgacatggaaatgccatgcagggcacgcacgtggggcactttctgctgagtcaggtttctctgaccttcctgaaatgtcacttgttctgtaactcacaaaaactggggtgctgggatatggtgccttccttctcccggaagtccctgccgaggggggcggtggtggggcattcccagggggtgtttgtcctttgctgtctttactttcccaccttgttccttgggcctcccctgacctattgaccctgccacagctcgctcaccccaggtccctgggggctgtgcaggattccgggtcctccagggccagtgtgatccttgctgggttctcagagtgaccctggagggaggtcccctgccgaccctcacctcccgttcccaggtcatctgccccagggccaggtgtccatccaccctgactgtgaccatgtgcctgtgacctgcgtgactgacccctgcccttgggtgcccaggcctagcagtgccccatgccactgggtccccaggcatctgccaggaaaggacagctctaaagtggccagggcagcaggggtcctgatgtctgttgaaggcccttggaattccctggcttcattgtgccatctccccgctcttctccctccctcctgcctcctgtcttcctactctctcccctccttccacccacccagctgctctcctctctgagcctggccccacaaccagaggtgctcactcctgccttcaactgactgcaggtatccaggcatctgggctgagggtgcctctgtggctttgttgaccaacccaggctgacttcagaggtgctcttcagcccctgctttgcaagttcctggggacccgtggctgtcactttggccccttgatgtttatggtggttcccgtagctaagtggatgctgccaaagatggaaagtgggggacgctattccactgccactcagagcgagaccaggtgcttcaaaaagactagcagggttgggtgtggtggctcatgcctgtaaccctagcactttgggaggtcaaggtggggggaccacctgaggtcaggagtttgagatcagcctggccaacatgagaaaagcccatctctactgaaaatacaaaaattagccgggtgtggtggtatgcacctgtagtcttagctacttgggaggctgaggcgaaagaatggcttgaacccgggggcagaggttgcagtgagctgagatcatgccattgcactccagcctgggcaacaagagcaaaactctgtctctataaaaaaaaaaaaaaaggaagaaaaagaaaagaccagcagggccaggtgtggtggctcatgcctgcaatcctagcactttgggaggctgaagggagaggatctcctgagcacaggggttcaaggctgcagtgagccgtgattgcaccactacactctagcctaggtgacagagcaagattctgtctctattaaaaaaaaaaaaaaaggaatggagatgacaaagaacaagtcttaattgaatattaacaaaagccagaagctgattggaaaagcttaataaagtagcaaacatgcctggctaatttttgtatttttagtagagaggagtttcaccatgttggccaggctggtttcaaactcctgacctcaggtgatcagccctcctcggcctcccgaagtcctgggattacaggcatgagccaccacatccggccaatttttgtattttttgtagagatggggtttcaccatgttgcccaggctggtcttgagctcctgggctcaggtgatccacctgccttggcctcccaaagggctgcgattccaagtgtgagccaccgcgtctggctaaggagtattttccttagcagatacaaatttatttaaattagctatgctagttaaaacaatatggaattggcagaagtataaacattgactaatggaatgtaccagcagaaacacatgcgatcgtaatgtgcttcagaaatggcctcattcatctgtggggaaaggatatacttctgggtaaatggtttggtgataactgaacattcatgtaggaaataaaatgcaatcacaacacacacaactccaaatggatggataatctcattgtgaaaaagaggaaggaacaaatgggggagtgggatggattaaagcagtggtccccaacctttttgccgccagggaccggttttgtggaagacagtttttccacagacggtgatgggaatggtttccagtgaaactgtcccacctccgatcatcagccatcagattctcataagcagcgtgcagcctggatccctcgcgtgcacagttacaatagggttcttccggagctcaggtgggaatgctcactccctggtgctcatctcctgctgtgcggccagttgctaacaggccaggaacctgtcctgggggttggggacctctggtctacagcacaggtgacttttctgtaccagagctaggaatgaagggctggctgagctggtgcttcctgccacctgtgtagtggtgcaggtgtccatggtccagggctggccaggggcatctcctgtcctggcttggcttctgcccctgggtccgtggtggctgcctgggacctgcccttgcagccagggtgaaaggagtgggcagggcctgctgcctctgctcagggcccctagtggggctgcttgctcagcacccttgccccgtctctggccacgtagccgtcacccagctagcatggggaggctcgctaccaaggggtggggggctggagaacggagcttggagacagctggcagtctcggccacacatagagacacccgctcctgagacctgcagtgcctgcagaggggaagaaacggggctggcggggagagcacacagtgcgtttctgtggtcaggcccctttatttcttcaaatagatcccaagtgtagagaacatgtgctcattcttgttggcaggcctgtgggtttttgtgtctcactctgaacttttcctgtatgcctctcgcttctctctgtcagaaaacaaaacagaagcctctattctctgggattcggattcaagtcggctcttttattcacctatttcgagcagacacaatgaaagaggaaacagataacactgtgggtattcagcaagttgtcttggatgtgaacattgagtttccacttgtcactgtgattttattttatattgagttgtttttaaaatatgctttgcttcactttcgttgctgttgaatctattacagctgcacggtgtcctgaacacagtggcaggctggtgatgaatcgtcttctgtaggttttctggtgtctttgttatgattctctcagggccaagtgtggtgcacctggcctgggcaaacctttaggcctcgctctcagaaccaactgtggataataagcaaataacatgttttgtttatctgcgcagtttctgaatgcaaatgattctttttattccttattttatttatttatgttttagagacagagtcttgccgtgttgcccaggctggagctttttattcttcgtgtttgcacagtggctgtagctatgtgtagtgacagcagagacaggcctgagaggggcagccacgttccccctgggcaggatctgtctgctacgggaccgcaagctgcgactttttccttctaagtgtgcggagaggagcccctgcctagggacggggagccgtagcctgctgtttttgtgacaagcatcttgggcgagggggcactgggctgtgctgcatagatggtgagcactggactcacccccagccccaagtcaaacgaatgtaaggaacgtgagcttctggaaacgagcgtggaagcctgagtggtgaggaagggaaatcttgcagtacctgcacactccccaaatgcctcttgtgggtttgcagtacctgcgcactccccaaatgcctcttgtggatttgtttgtttgtttgtttacaattagttcatccacagcaggatccaagctgctgcctgtgtgtgtgtgtgtgtgtgtgtgtgtgtgtgtgtgtgtgtctatgtgtgagagagagagagacagggtcctctgtcacccaggctgagtgtagtggtgcaatcacagctgactgcagcctccaactcctgggctcaggtgatcctcccacctcagcctcccaagtagctgggactgcaggtgcgccccaccaagcccagctaatttttgtatttttttgtagagacagggtttcgccatgttggccaggctggtctcgaactcctggcctcaagtgatccacccgcctcggcctcccacagtgctgggattacaggcatgattgtgcccagccacagtagagcttcttgtttgcagttggttggtgtgtgtcttgtggctgtctttaataaaacaaaaactttgcaagtatcgtctggtaggccaggcgcagtggctcacgcctgtaatcctagcacttcaggaggccgaggtgggcgggtcacttgaggtcaggagttcaaaaccagcctggccgatatggtgaaaccccatctctagtaaaaatataaaaaattagctgggtgtggtggtgcacgcctgtagtcccagctactcaggaggctgaggcaggtgaattgcttgaacccgggaggcggaggttgcagtgagccaagatcgcaccactgcactccagcctgggtgacagcaggactctgtcttaaaaaaaaaaaaaaaaaaagacagtattgttatggtaaaggttcacccctcacaccttttttcgtatgcagctctgagcttaacatccaccatacaaccaggcacagaacactgggcagtccacccaaaacagtccccagcagccaccctccctactgacctggccttgtgcccccagctctgccttttccagagtgccatagagatggacaaaaatggtgtgtgccctcttgacacgggcgtctctcactcaacacgatgccttccagatccatcctatcacgtatcgatctgttcctagctgttgctgaatagtaccaaaatgtccttgtctttgtgtgaaggacatcggggtttccagtgggtggcagttatgaatagagctgctgtgaatgtgcattagggatctgtgtagggacatatgctttcatttcccttggaccaattccaaggggtaggattgctgggtcctgtatgtttaactttgtaagaaactgccaaactgctttccagtgactctgccatgtggcgttctgcacgttcagagtatatggaagtcccagtggttttgcttcctcgccagcatttggtattagctttttttatttttcatgttttttaagccattctaataggtgtagttggtatctcgtttggttttaatttgcatttccctaataactaataattttgagcatcttttcatgtgcttatttgctatcaatgtatcttttctggtgaaacgtctgttcaaatattttgctcacttttttttttttttgagatggagtcttgctctgtcacccaggctagagtgcagtggcgcgacctcagctcactgcaacctttacctccctggttcaagcaattcccctgcctcagccttccgagtagctgggactacaggcttttctcactttttattaggttgtttgttttcatattgttgagttctgagagttcatatatttatatattctggataaaatttttgtcgaatgtgtgatctgtggccaggtgtggtggctcatgcctataatcccagcactttgggaggctgaggtgggcagatcactcgaggccaggagtttgagaccaggcctggcctacatgtagctgggactacagatgtgtgctgccgtacttggctaatttttatactttttgtagagacagggtctccctgtgtacccaggctggtctcaaactcctgggctcaagtgatccacccacctcagcttcccgaagtgttgggattacaggcatgagccacccttccctgcctcaacttttaatatatggttgaatttgcctggaagtttttttttgttttgttttgtttttggaagatttaattaattaattgatttatttttgagacagagtctcactctgtcccccaggctggcgtgcagtgatacgatctcggctcactacaacctctgcctccccagttcaagtgattctcccacacccggcccagaaaatttaacaattaattcaatttatttaatagttgtaggactataccagctatctatttcatcgtggggagttttagtagtttgtggctttctagggaaatgaaaattggtacattttatcaaagtagtcaaatttttgttcatgaagttgtttatagtatttcccagtagtctgtaaggtctgtagtgctttccttcttttacttctgataatggcaacttttgtctactttcttctttgtttgggtagaggttttatgaattttattgatcttcccaaagaactagcatttggttttattttattgtttatctattttcagtttagttgttcctctttatcattataatttccttccttttgcttacttggggtttaatatgttcttctagtttcttaagatggaaccttagggctgggcgcagtggcccagtaatcccagcactttgggaggccgaggtgggtggatcacctgaggtcaggagttcgagaccagcctggccaacatggtgaaatcgtgtctccaccaaaaatataaaaaattagctgggcgtggtagtgcacacctgtaatcccagctgcttgggaggctgaggcatgagaatcgtttgaacccaggaggtggaggttgcagtgagccgagatcacaccactgcactccagcctgggcaacacagtgtgactccatctcaaaaaagatggaatctggctgggcgcagtggctcaacgcctgtaatcccagcactttgggaggccaaggcaggcggatcacgaggtcgggagattgagaccatcctgcctaacacggtgaaaccccgtctccactaaaaatacaaaaaattagctgggtgtgatgtcgggcgcctgtagtcccagctactcgggaggctgaggcaggacaatagcgtgaacccaggaggcggagcttgcagtgagctgagatcacgccaccgcactccagcctgggcaacagagcgagactccgtcttgagaaaaaaaaaaatggaatctttagattgtgtatttgaatcttttttcttttctgacataagcacttaatgctataaattctcatttcagaacggctttagctgcacctggcagattgacgtgctgcgttttcatttacattccattcagagtgttctctgatttcctttgagacttcctttgatccataggtttttgttttttagtttcccaagcatcccaagaggatttccccgccatctttctgtgatagattgctagtctaacgccattttggtcagagaacgtattctttgtatgatatcagctcttttgtatttgtgaaggatttgtggtgtgacccagcctatggtctatcttggttcatatcacctctcttagtctctctcctctgtctttcttcctcttgcattgtgttgagtaagagagagtctgtgggaatccgggcagccccagtggagtggggtggaaccaggacgagggtccctgctggaggagcgccccctcaggccaggcccttccgcgtttctgccaagtcctaggagactctgacttaatgcctgacttattttgtgatatactgagttatgagaatgactttaaagctcacaggtggcctcagagtgcaccttgtgctcacaaacactgacgggcgacagtggacagtctgactgcagctcggggaatgagttgaaggactctgacagagatgtctgtagtaggcaggcttgtcacactcattgtttaagctccatgcctgtttacctaaaaagctggacttaaatacatcgaacttggaactcagaaaaataaaacatcttctgacctgggtaggtccgtcttccagtgttggaaagcagactcatttccgggttagtcctgtgctgctttttgacctacactgacccgatcttgtttggaacaggccgccctgtgcatgatttggtcccatgcagaatcacacagcccggttggtgactttgatggctgtcaggcactgctcgcgtctgcagccctgtctgcagagagcaccccgtggccctgcatgcacggctcccccacccccgcccacacaacatcccccccaccgcctgcacggctcccccacccacacccgcacaacttcccccccaccccctgcacagttcccccactcccacgcgcacgacttccccccctaccccctgcacggctcccccacccccacccgcacggcatcacccccaccgcctgcacggctcccccacccccacccgcacggcatcacccccaccgcctgcacggctcccccacccccacccgcacaacttcccccccaccccctgcacggctcccccacccccacccccacgcgcatgactttccccccaccccctgcacggctcccccactcccacgcgcatgacttcccccccaccccctgcacggctcccccactcccacgcgcatgacttcccccccaccccctgcacggctcccccacccccacccccacccgcacggcatcaccccctaccccctgcacggctcccccacccccacctgcacagcatccccccaccactgcatggctcccccacctctgcccacacagcttccctacccccgcctgcacggctcccccactgcctgttgtccgctgtccccgttgcacctcccacctgctgccctgctgtcaagtcaggcgcgtcccacccagagtgctctggtgtctgccccttggcttctctcagcagctcagtggagtgtagacagtgtagtagatcatcacctgagcagccaggatgggagtggggtctctgtggtctccattttacaaatgggttgacaggtgctcaggaagccctgtgatgtcctgaggccgcccaggcagtcatacacaggctgtacccatccagtgctcccgttgcctgggggcagggatgtgtgctggaagggcctgggactgccttcccaccgccatgtccacacccaatgcccaggggtggagacggaagcacgtggcggccactgtggcactggtgggtggctgcgttccatggcctgactgtgtctggcgcctgttctggtgttttacattcatactttgagggccaagcaccagcccaggaggtgggtgccacaagtccagacttccccaagggaaagtgtccccagcacagactcagccactcagaacttgttggtcttagagcctgaagccgggcagggcagacagtgccatccctatctggatggtggtgccttcacccttctgctgtcctgagcaagaagaaaaatgagccaagcttcaaagagagctgtgccaaagtttccggaaagcttgccagtgtgggtgttgcaccccacacaccttcaggcatgggtgggtggtgtgggcatcttcactggatggatttggagccctggcgcgtgtacggcagatgccccggggagatggcatgttcacacggggcagcactaggcagagtggagggtagggtctacacccctccactcctcagcaacagagccctggacactgggtgtgtccttcagactgtccctggcgtctccagcactcctgtggcctcaggacggaatgatggaggtgaaatgaacagaaggaaggttgggggaaagcgtatcccagctatgggcagggggtcctggggtgggcaggatttggggcggctgggcctggggctggatagggccgcgggagaggggaggcctgtgctctcacagctgggagctggctcaggactctcagatcttctctttgtggcctgtcatccctcctacctgcctgtccacaggcccacactgagtgagttccatgggagggaggctcaccctcaggggccttcaggagatgggacctctggcccggcagccaacggatgctgaggggtgcccaccatgtgcagggacagctggggtgatgtcttggagccctgtgaggtcctggggccgcccaggcagtcacaccccgccctgcaccccagggtgcaggctcccggggtgacacagtgctgggacggcacagggccgcgtcctgaggagagggcggagccccgaggctgagctgtgccttgcctcacaggttgtgcagcctgactctgaagaagctggtggtcttcaaggagctggagaaggagctgatctccgtggtgatcgctgtcaagatgcaggtgaggccgcttgtgaccccggctgtggctgggtgctgtgtaggctttccatgtgcctgggagacgagtcaggcggtgcgctactgtggggccttgtgccaaaacagcgggcagcccatgccatctccgggagcccggggggctgggaatgacaggatgctcctgggtccagtcctgtcccgcacaagggaggcaggcccggccttctgggatgtggaggtcacatgcatggggccttcccagggcagagctgccctcgagtcacctcacagtgatggacgggccccaagcacctggagccagggcttccctgctgcactcagcacccacttcctgcccactttttgtggggtggagggcgtcggtgggagaggggagcagggcactctgggaggcgagggcctagccagaactcccagcccctggtgccagggcctctctcctgaccctagtgggtcctgtgacctctcgaaggctttgaacaagtagcggttccagaggggtcatgctggtgtcttccccatgcctggcccaggccccgccccctccttggggtagagctgccatgacccttgcagcatggcctttgcccagtggcccagacagggaggtgtccccgccaactgtcagggccacccctgccctttcagggtcatacggttccaggtgtgtggcctgtatagggccaccgccagcgggctctccctagccggcaccactcatgggcaagtctcacccatgtcctcagcatacaggagtgtccttctgtgtggccgtccagcgtgacagggtggggtctcagtggctgttgtgctcctgaccccagcccatcagctcctcgaggatggggccctgcccttggagcccatgtccaaggccccacacaggtccctgcagctggccggattcttgacacctgctgtggctctgacacggggtctccgggtctccccgacctgcagagtagcacctgagcctcggccagtgtggctgaggtcaccagccaagcactgggtcttgagtgcgaggaggcctgaggcttgttgtctgtcccagtcaattgccactatgtgaaacctactgcatcttaaataaacgtctggagaaacccttttcctcgctgaacatgctcgtggattagcagcagcctacatctgcggcgtgtgctggtggccaggttccccgggtggtggggccttgccccaggaacttccaggagcgtgtggctaatagcaggaccccaagaacttccaggagtgcgtggctaatgcaggacccggagaacttccaggagagcgtggctaatagcaggaccccgagaacttccaggagagcgtggctaatgcaggaccccgagaacttccaggagagcgtggctaatagcaggaccccgagaacttccgggagcgcgtggctaatagcaggaccccgagaacttccgggagcgcgtggctaatagcaggaccccaagaacttccaggagtgcgtggctgatagcaggatggaagcgtctctccgcctgtcctgcccatgggtgtggccatgcccagggtgcccagtacctgctgcagtctggctgcgggtcgtccctggggaacagggagctctctgtgggccattgccaccaggccgtgaggctgtgtctggacctcttggcttggggggcaggggtcagggtctcattgggtcttcagagcaatgcagaaaggcatgaaggcaagagtcgacccctcactgacttctgagtctggtgctgttgacctctaacctctggcatggggccccaccccacactgaccctgttccttggccccattccttcctctgcctgtctctggtcctgccccagcctgtgtcttgaccgagagcttggccccagggcccctcagagccccacctctccagcccctctgtgtagcgcatggactggctgcccatgccctccctgcccaccccagctcagcagccacgtggcccttggcctcccttgatcaccccagctcctcatctgcttctcttggggtgtcctctccgcccaggccccctgtgggggaagcagccagcctggccccgcagccccacctgcccctcagccttctctggcgtgcaccttcgcctcactggctggtggcacacactgtccttttcccgacacagctgggtccctgcaggtcctctgaggggggaatgctaagagggacccgacgcagagcacatttgcagggaaacatctctgaagggtcaaggggaggagcagggagagtccagaccacaacgcaggggcagctggggagaggagaggggacaggagggctggccgaggagagccgcgctgcctcttgccacgctgcacgtgaggccccagcacaaggggaggaccagagtccgccatggacgtctcatggagcccgagtacggccatgcgggccgcccgcacctgtcctgaggccccgctgctcccacccgaacctgggctggccccgggctcccgttgtctgtcctggacccccgcccgccctccagccacctggcacctctcatccactgtgtcccgcgcgccggcctccgggaaccttgtgcctgggaccccgcagcggctgcttgtttctcggggcacgaggtccccaagctcatccttgttgggatggtcccatttaaaacagcactgcgataagcacgttcaatccattaggaatctattttgatataaagtttgcggttggggtcctgttgtctttcacgcaaatgactcgttatccatttagcaggtgcgtgtgatgtctcctgctggcctgaagctcactgggtatgaactgtgttttcaggtgctcatgcatttcctgcacctacatctaggcttctactaccctcatttttgtgacagcatctccgtattttaagtattgtatctctgtatgttttactttctgagaggaccagtcaggcctgatcattcttctttttagaaaatgctttaggccaggtgcagtggctcatgcctaatcccagcactgtgggaggccgaggagggtggattgcttgaactcaggagttggagaccagtctgggcaacatgactaatccttgtctcttaacaaaatacaaaaattattgtatatttttttgtggtggtacatgcctgtagtcccaggtgctagggaggctgaggctggaggattgcctgagcctaggaggtcaaggctgtagtgagttgagatcgagccactgccccacagcctgggtgacagagaccctgtctcaaaaaataaaaacaaaaaataaaaaaatgctttaagccaagcatggaggcacatgcctgtaaggctgagctacttaggaggctgaggcaggaggattgcttgagcccgggagctcaagtccagcctgagcaacacagcgagacctgtctctcaaaaccaaaaccagaagaggcttggtgcctccagatttgttctgccagacagacttgggcagcgcagtcaggtgctgctgcacctggccgtggaatctgttttgtgatcgcgttaacttcagcaggagccgctcctggtttctctctcatgtcttagggcagattcctggaggtggaacctgtgggccgaagggtctccatgtttttaaggttcttgggaaagatgccagggcacctctgagaattaccccagcctgtgcctaccacccccagactgcagggctgcaatcctgccagttttagagtgcaggagtcacggtgtctttgcctggtttcctgctgatatgcagtcctttgagctagaacaggtcttgcttaatcacagggctccaaacgaatcctgcggtcccatgagattgtgctgccccccagtggacaagtggagacagacctggccctgaccttctccttgcaggtgagtctttcaccagtggtgacgacaccctcatcactgtcccctggggagacgggcccccctcatcactgtcccctggggagacgggcccccctcatcactgtcccctggggtgatgggcccccctcatcagtgtcccctggggagacgggcacgcctcatcaccgtcccctggggagacgggcacccctcatcaccgtcccctggggcgacgggccccgtcatccctgtcccctggggtgacgggcccccccatcactatcccctggggtgacgggcacccccatcactgtaccctggggagacaggccctccccatcactgttccctggggagacgggcccccccatcactgtcccctggggagacgggcccccccatcagtgtcccctggggagacgggcacgcctcatcactgtcccctggggtgacgggccccctcatcactgtcccctggggagatgggcccccctcatcagtgtcccctggggagacgggcacccctcatcactgtcccctggggtgacgggccccctcatcactgtcccctggggagacgggcacccccatcactgtcccctggggagacgggcacccccatcactgtcccctggggtgacaggccccccccatcactgtcccctggggtgacgggcaccccctcatcactgtcccctggggagacgggcacccccatcactgtcccctggggtgacgggcccccccaatcactgtcccctggggtgatgggcaccccctcatcactgtcccctggggagacgggcacccccatcgctgtcccctggggtgacgggcccccccatcactgtcccctggggtgatgggccccctcgtcactgtcccctggggagacgggcgccctcatcactgtcccctggggtgatggccccccctcatcactgtcccctggggtgacggccccccctcatcactgtcccctggggtgatgggccccctcatcactgtcccctggggtgagagcatttgtctcatcattgccatcagtgtcctgcgttactgcagatcttctgttgattatggtttattcttaaatgattagaagatttgtatttgtttattaggttgagtttttctttgttttttctttgttttttgtttgtttgtttgtttttgagatggagtctctccttgtcacccaggctggtgcagtcttggctcactgcaacctccacctcccgagttcaagcgattctcctgcttcagcctcccgagcagctgggattacaggcatgtgccaccacgcccggctatttttcgtatctttagttgagacggggtttcaccatgtcggccaggctggtctcgaactcctgactgcatgatctgcctgcctcggcctctcaaagtgctgggattacaggcgtgggacaccatgcccagcctagtttttcattccttatctatgataaagagaatataaggccgggtgtggtggctcatgcctgtaatcccagcacttcgggaggccgaggtaggtggcaggagaatcgcttgaacccgggaggtggaggttggttgcagtgagctgagatcatgccatagcactccagcctgggggacagagtgagactccatctcaaaaaaaagagagaatataataacgagggcaaaaaaacacttactgagtcaaggctattttgctcttctatttaaaaagataggggaaactcagagttcacaagcaatcccagctcttcgggaggctgaggcaggaggattgcttgaacccaggaggtggaggtgacagtgagcccggctaatttttgtatttttgtagagatggggttttgccatgttggctagggtggtctcgaactccctacctcaggtgatccgcccagcttggcctcccaaagtgccgggattacaggtgtgagccaccgcgcctggcccaatgctccatggttcagtgggttttgataggcatgctcaggcatgtcagcaccaccgcagttagggtggtgaacagccccattttcccctaagtatttaaactgatttttatttgtgaactctgagtgtctaagagatacctgtgaacatcagcttgctggagccctgctggacagggagcctgtggtgagacgtgcaggcgagttgggtgaacagggggcctcggagggagagccctccccgccctgtgtgcccctcgcggaaaagcgtcctgggtcccaccttgctgattgcctcaggcacatgagccgccacactgtttccgagtgtccacaggcgcgctcggccatcccggacactgcagcacatagtccttgtccacctgccatggctgttagcgtggcgcggagccctcagggcctgagctctggcgactggctcactcttgattgtgttgggtaaaggatgggctctggggaccggcatgccactgggatgaacttgggggcccgtctgtgggtgcccttccgatctcatgggcagcaggttggcctggtcgcaggctgcagggtggctgggccgtcagaggccgtgatgctgcctggggccccggtgcaccctcagctgccactcgcacttgtgcccacagtatcctcacttcttgaagagggaaggcaacaagcttcagatcatgctgcagcgcagaaagcgctacaagaacagaaccatcctgggctacaagacgctggccgcgggctccatcagcatggctgaggtgagtgctccgtctggcgtggcctgcgtcgggctggccacctgggtgccagagcattcgcccgtgggagatggagatgtctctcccgggtccagatgtccagggatcaggtgaaaatgatgagaggagcctgggcggccgggctccgccataagggccaggtgcggccccaggtggtgcttcctctctgaccttcccttgccgcctagcatggctccccgcatgcctgcagccgcgcgcactcccctctaacgagcctgtcctgcccttcagtggaggctgggttttgggtcaggctgctctggagtccttcccatggaggaatcgctgctgtccccacaccacgggtgcgtcctgtgatgggttcgtgtctgcatcctgctcagcacgtgctctggcccaggattggctgagcaggagcaggacaggtgtcagttctgtgaaggggctagcgacaatacccgagcagggcgggggcagcacccagaggtcagaggggtggctggagttccctggaggggaaagaaggggaagtacctcaaaaggaaaagaaacagccaagcagcagcccaccttgctccagagaacccagcgttccaaggaggctgcagtagggcgtgggggcctgggagaagacaccccaggctgaggcctcggactttctcatggaccctttcggggctgcaagattggctctgggagaaggggcagcccagggccccagaccagtttgtctcttttgcttcagaactttccccatcgtggggttgtgttcaggggtccaggggctgcgggcgtgagtggtgcttggggcatgtgaagctgggttgctgcctgcctggggcctgggaaggtcagccagcgcagcccctcattgggagccggagatgccagagccccccagcccctcttcttcccactttgtccccctgctcctggggcttggggctgggacagtgggggtgcccacttgtagctggttcccccacacccccaggcccagcctgcaggcctcctgtctcccaggtcaagcgctaggtcccccagatcctcacacacccccacttacgcatccaggacaagtgccaagtactactctgggctcagccctccctgctaccccaggagatgggagcgtggagggtacaggaagcagcagtggcgtcccgaggcctcgcttctccgtgccgccgcagggcctcagacaagctttgcagtcttcccgattccttcggcaaaccacggacagcacgggtggaccgggcctccaggctgcacttcccagggccctgggacccctctggtggcctggagctgcccatcatcccagcctccctcctgcaggctgagcgatgggtgaacaggtagctcagggatgctctctgggctgtgagagcctcctgggagccaccgcttgcttcctgtggagcaggagggtccaggcactgtggggaggtcatgcaggctctgtttcccattagccatgcaggcgaggtcctgctgatccctgccggtccctgtgtttcccattagccatgcaggcgaggtcctgctgatccctgccggtccctgtgtttcccattagccatgcaggcgaggtcctgctgatccctgccggtccctgtgtttcccattagccatgcaggcgatgtcctgctgatccctgccggtccctgtgtttcccattagccattcaggcgatgtcctgctgatccctgctggtccctgtgtttcccattagccatgcaggcgatgtcctgctgatccctgccggtccctgtgtttcccattagccatgcaggcgatgtcctgctgatccctgctggtccctgtgtagccatgcaggtgatgtcctgctgatccctgccggtccctgtgagctcctgccccaggctgctccgcccacatctctcagtctgcaccccagtgccccaggcggctcctcccagcccctctcagcactggtgcttctgtgtttgacgtccttgccctgaatgctggcctctgctcccaggcccctccctcacctgtcctcccagccttgggctgtcccctcctgatccccggggagaggctggagcaaccttcccccaccccaggtcacaccagccacatcgtctgctgcttgaaatcccatcatctgttcttcactcttggcagaaaagccccacccctggatgtagttccagtgccctgcccctgagcctgtggcccccaccccaaggctccctcgccctgcacctgtggcttccaaagccgaggtcatctgactgctcctcgctctcccctccagcatctcctccaggccctcggggcatccttccaccttccactggcagcctggtcccagaacctagttgggtcctcccatgtgtccccgagcaccagggcggttcatgggctccctgtgtcctgccaccttttggggctggttcccacctgtgagcgttgctggcttgttgagagtatgagcacgggagattgcggaggcgggacagccccgagggcacagacggacacaggtggcagaggtggggggctctcaccagctgggctcaggcagctgtgccatgggggcttgctggctccgagactgcacgcctgagacgggggtgagggcatgggtgctgccatagggactgtcgtgagagtggggtgtcggtgaggctggcgccatgcatttgagagtagtgctcggcggtggggaagggtccttgagggcacagggtggggtgaggcgggctgttgggcggactcgaggccagggctgagagtgtggtgggagaggatgtggggggcacctgcccaggacctccaggctgtggggagaccaggaggcgatggctgtggggacacaggtgtcatctcccttcaaatgggtgcacacgcagggggcaggaggggctgggagcagcctgggcccctgccacaccatagctctgccctcacctggcactcattctgtgtgagctgaggcccagagccctggacttactctgaggctgaggaagtggagtccaaggtggcccagggtaggggccgggcctcatgggtgccaggagctggacgccggcgtggggtggcttaggtctgcaggctgaccagcagttctggctgggaccatcaggagtgaccgcagccccagggcctgctgggcacgcgcctctgcctgccacttctcaggaagcttgagctgactgcaggtggtccctctcagaggcagctccgcagaggcaggtgtgcggtgggggcagacgtggggccttctcctgtggtgtggctctcagaactcaccccagcacccgtagagggagtgtgtaggggtgggcgttcgtgtggccagaccaccctggggctgcagcctgggagacgcaggcatgccagctggtggccattgtctgaggctggggcctgtgggctccccgacaagacaggaaggttgacagacccatgaccaggcgaaggggtgacctgggagtgcggtggtggctgagggagcagccatgcttctttgcacagccggactcctcttgtggcctcgccacaagctgcacatgccactggggccaggtccagcccaaggggacctgtgaggggcgggcggctcatggtgggacacaggaagacctcagggtaaggacagcgcgggagcgtcaccctgaccgtttgcatgctggattccctttagtttctctctatgagtgtctgcacagccacaggctgctgatgacagcccagtcaggtgtgggctgcatatcaatgggtggccccgtgagaatatgatggcactggacacttcctatctcctgatgacatggtagccatcgtaacaccatagcacagttactttattcctgtgtgaactcagtgtggcccaggtgtccagggcctggtcacacacacgtccatccctacacggcggtgcatggcgacctcccaggccttcgcatccacacacacgtccacccctacgcggcggtgcgtggtgacctcccaggccttcgcattactcactcacccaccagcttgtccagagccacctccagccccgcaggctctgccatcgtcagtgccctattcacaggcaccacttaatgtcttttatactttatttttactgtgcttttttttttttgctttttatttttaaatttttttcgtgatgtggtttcacttttatagtgcagtggcgcgatctcagttcactgcaacctccacctcccgggttcaagtgattctccttcctccgcctcccgagtggttgggattacaggtgctcatcaccacacccaactaatttttttatttttagtggagacagggtttcaccctgttgtccaggctggtcttgaactcctgacctcaagtgatctgtctatctgggcctcccaaagtgttggtatttctttcttttttttttttttttttttttgagacagaatctcgctctgtcgcccaggctggagtgcagtgccgcaatctcagctcactgcaacctccacctcccaggttcacgccattctcctgcctcagcctcccgagtagctgggactacaggcgcccgccactacgcctggctaattttctgtatttttagtagagacggggtttcaccgtgttagccaagatggtctcgatctcctgacctcgcgatccgcccaccttggtctcccaaagtgctgggattacaggcgtgagccactgtacccggccaagtgttggtatttcaagcatgagccaccgtgcccagcctactttttctgtgtttaaatgtgtttagacacataaatacttaccatctgtaacaattgcctacagtattcagtacagtaacatgctttacaggtctgtggcctaggagcaggaggctgtctctcatataggctgaccttgaagatattgtgtgttcagttctaggccaccccaataaaaacggatattgaaataaagtgagtcacacaaatttcgtggtttttcagtgcatataaaagttatgtttacactgtactgtagtctgttaagtgtgcaatagcattacgtcaaaaaatatatacatacattaattttaaaatattgctaaagctgggtgcggtggctcatgcctgtaatcccagcactttgggaggccaaggcgggcgtatcacctgaggtcaggtgttcgaaaccagcctggccaatatggtgaaatgtcgtctctactaaaaatacaaaaaaaaattagccgggcgtcgtggctcacacctgtaatcccagctactagggaggggaggcaggagaatcactttaacccgggaggcggaggttgcagtgagccgagatcacgccactgcattctagcctgggtgacagagtaagacttcctctcaaaaaaaaaaaaaaaagaaaagaaaaagctaacaatcatctgagccttcggggagttgtaaccctttggctggtgggggtccttagtgtgggtgggtgctgaccggtcagagtgttggttgctgaaggctagggtgcctgtggcaatttcttaaataaaacaagaaagaagtttcctgcatacttgactcttcttttcgcagaatagttccctgtcgcatgcggtgctgtttggtaccatgttacccaccattatttcagaattggggtcagtcctctcaaaccccgttgctgcgttactaaccgagacggtggactctcccaagtcctgtgttgtcactccgcagtgttcacagcatcctcaccaggagcagattccatcttaagaaaccactttcgttgctcatccatgagaagccacttcttatcagctgaagtttcttcatgagactgcagcaattcagtcagtcctcaggctctgcttctaatcccagtcctcttgctatttccaccacatgtgcacttccttcctgcactgaagccttgagccctcaaagtcatccacgagagagttggaatccacttctcccaaattcctgtcaatgctgatatctcaactttttcccatgaatcacagatgttcttcatggcatcaagaatggtgaatccaggccacgcgcagtggctcacacctgtcatcccagcactttgggaggccaaggtgggcggatcatttgaggtcaggagttctaaaccagcctggccaatatggtgaaacgctgtctctgctaaaaatacaaaaaaagaaaaaaaggctgggcacggtggctcacacctgtaatcccagcactttggcaggccagggcgggtggattacctgaggtcaggagtttgagaccagcctggccaacatggtgaaaccttgtctctactaaaagtacaacaattagccaggtgtggtagaggacacctgtaattccagctactcagtaggctgagacagaagaatcggttgaacctgggaggcggaggttgcagtgagctgagattgcaccagtgcattccagcctgggtgacaagagtgagactccgtctcaaaacaaacaaacaaacaaaaaaattagtgggccgggtgcaatggctcacgccggtaatcccagcactttgggaggccaaggcgggcaggtcacctgaggtcgggagctcgagaccagcctgaccaacatggagaaaccccgtctctactaaaaatacaaaattagctgggtgtggtggcacatgcctgtaattccagctactcaggaggctgaggcaggagaatcgcttgaacccaggaggcggaaattgcaatgagccaagatcacgacattgcactccagcctgggcgccaagagtgagacttcatctcaaacaaacaaacaaaaaaaacgaattagtggagtgtggtggcaggcacctaaagtcccagctactcgggaggctgaggcaggagaattgcttgaacctgggaagtggaggttgtagtgagcgagatcgcaccattgcactccagcctgggcaacaagagttagaatctgtctcaaaaaaaaagaatgggccaggtgtggtggctcacgcctgtcatcccagcactttgggaggccacggtgggcggatcacgaggtcaggagatcaagaccatcctggctaacacagtgaaacaccgtctctactgaaaatataaaaaattagctgggcgtggtggcgggcgcctgtagtcccagctactcgggaggctgaggcaggagaatggtgtgaacctggaggtggagcttgcagtgagccgagatcgcgccactgcactccagcctgggcgacagagcgagactccgtctcaaaaaaaaaaaaaagaaaagaaaaaaaaagaatggtgagtcatttccagggggtttccaatttaccttgcccagatccatcagaggaatcactgtctatggcagctatagccttatgaatgaaatacattttttttaaataataagacttgaggccaggcgcagtggctcacacctgtaatcccagcactttgggaggtcaaggcaggtggatcatctgaggtcaggagttcaagaccagcctgaccaacatgttgaaatgccatctctgctaaaaatataaaaattagccaggcgtggtggcgggcccctgtaatcccagctactcaggaggctgaggcaggagaatcgcttgaacctgggaggcagaggttgtagtgagccaagatcgcgtcattgcactccagcctgggcaacagagcgaaactccaactcaaataataataagacttgaaagttgaaatgactccttgatgcatgggctgcctgatggatgtcgtgtgagcagccatgaaaacaacattcgtctcctgcgagtctccagcagagctcttgggtgaccaggtcatgtcaatgagcagtcatattttgaaaggaaccttttttttcccaagcaataggtctcatagtgggcttaaaacattcagccaattgtgctgtaaacagatgtgctgtcatccaggctttgttgttccattttcagaacacagacagtcgactttgcataattcttaagggccctaggatttcaggaatggtaaatgagcactggcttcaacttaaagtcaccagctgccttcactcctaacaagagaggcagcctgtcctttgaagctttgaggccaggcatcgacttctcctctctagctatgaaagtcctagatggcatcttcttccaatggaaggctgtgtcttctacgttgaaaatctgttgtttagtgttagccaccttcgtcaagatctgaactagaccttctagagaactcgctgcagcttctccgtcagcacttgccgcttcaccttgcatttctgttatggagacggctgctttactaaaacctcatgaaccaacttctgccagctccaaacttcttctgcagcctcctcgcctctctcagccttcacagaggtgaagggagtcagggccttgctccggatgaggctttggcttaaaggagtgttgtctggttcaatcttcatcccggccactcactctctccacaccgtcactgaggctgctctgctgattctccttcctgtgttcgctggagcagcgattttcctttccctcaggagctttctctttgcattcactgcttggtgatttagtataaggggcctcgccctcaccctgtctcggctctgacgtgccttcttcactaaactcagtcatttctaggttctcattgaaagagatgtgcaacccctcctttcacttgaacacttaggggcccgtagagttagtaattggcctaatttccatattattgtgtctcggaagagagaggccacaggagagacagacatgggaatggccggtgggctgagcagtcagacgcacacacctactgattaagttcactgtcttacatgggtgatgttcgtggtgccccagagcagttgtgatagtcacaccgtagctcactgatcacagatcaccatacagatataataatagtgaagaagtttgaaatattgggagaattaccaaaatgtgacacagacaccaagtgaacacgtgctgttggaaaagtggcgctgatagacttgcttgatgcagggttgccaaaagccttcactgtaaaaaacagaagatcagcaaagtgcagcagagcagagtgagggctgcagcccgggtgcgcggtgggcggcggcctgcgggtgtggtgggcgtcccgggtgcgcggtgggcggcggcccgggggtgtggtgggcggtgtcccgggtgcacggtgggcgtcccgggtgcgcggtgggcggtgtcccgggtgcgcggtgggcggtgtcccgggtgcgcggtgggcggcgtcccgggtgcgcggtgggcggcgtcccgggtgcgcggtgggtggcggcccgggtgcgcggtgggcggtggcctgggtgcgcggtgggcggcaccatccaggcttgctgcgatgttggcaagaggacgaggtctcctcaccatgcatgtctcagaacatacctctgtcgttacgtggtgcatgactgtttttgtaaaatttttattgtagtatttgtacaattaagtgtgacatcctgagcaattttcttttctttttttttttttttttttgagacggggtcttactttgccacccaggctggagtgcagtggtgtgatcttggctcactgcagcctcaagcccctgggcccaagcagtcctcccacctcagtcctcaagtagctgggactacaggtgcgcaccaccatgcccagctaattttttatactttttgtagagataagagtttcgccatgttgcccaggctggtctcaaactcctgagctcaagccatccacctgcctcaacctcccaaagtgttaggattacaggcgtgaaccattatgcccggcctcaattttcctagtcactaaaatctatttgaaaatggaagagggaggagcctgtcagggtcaggggtggagggagctgggccctggggccaccctccctggtgaggcagctccagccctttgctgaggattgcagagcatccacagagcatctgctggactaacccgggagggtggtctcagggtcagcaggggcaggagtgggaatggccacagtccaggacagtgacctgccggccagcatcaccccaggggagtgcccagctcaggggtggctggccccttggcaggaggacgcacgccccaaggagcactgtcaggaggagaggaacatgcagcctggagtgtcggggcctgggacttccagggcctgcagatatcaaaatagtgttcacatataggtcgaccacaggctgagtggagcgggggctaatcaacaacccgcccctggcccgctgcgggcccagcagagcattcccactacagccagctccagggatcccggcaaaagcatctttgataagaggccccattccttcctgccctcccacctgaaggaggaagcgagcagggttttcttaggagaaaaagggcccagacccctctgagccccgtggaggttggtatgagcaggtgcagcaccacctgagccccaccttgattcctccgggaccccagcccggcagccccctcccctctgagctcattttactgggatccccagcaagggctcagcatttctgaccgagggcttctgagcttccaggttctcacccctgtgtgacactgagaccctgccacatcagatgccactctgagaaggcgactcagggtgctgggggcctggacaacagcagcctccaagtacgtgaagctgcgtgtgccccggcgagttgtgggcacgagggcgtcagcagtgggtgcgagtgttggcagaagctgccagctgcccttcgtcattttctgaaatgaagatgagggcaaatgtaaacttttaaacatttttttaccttgattaattgaagaattagcagcccaaatcaggaccccacaatcaaaataaatctggtcggctgggcgtggtggctcacgcctgtaatcccagcactttgggaggccgaggcaggcagatcatttgaggtcaggagtttgagaccatcctggccaacatggtgaaactgtttctactaaaaatacaaaacttagctgggcgtgctggcagatgcctgtaatcccaggtacttgggaagctgaggcaggagaatcacttgaacccaggaggcggaggttgcagtgagccaagatcgcaccattgcacaccagcctgggccacagaatgagactccgtctcaaaaaagtaataaataaataaatctggtctataaaatcctaacatctggatgtgaaccgatagccccaaaaggcggcttctagagcacagctggccccaaggctgtgagtgtctgagagttgtcgtcatggcgtgtggttctgaggctggcgtggggcacggcggggctgtgcctgggtacaggtcgtggctgcaggaggggccggggcttgttctgcagctccgtggtttgagtgcctcacaacagaggagctggacctggcctgtgagccaggcctggtgggtgtctcctgctgctggagattccggcctggctgagagtgctgggctcctccttggtcccccacagacactggtccctgggcattggctcctgtgggttgggcagccggcttcacacactgctttgctgctgctgagctcttgggtgggtggagggtggaggcagggttggagcagggggccaggatcttcctgggtggcactgcatggacagcagtcgtgcctgagatcaggagggccgcggacacccctgtctgtccatctcagtccctcgtgactgtgcctggcactggcctctccagcacagcccagtgccctctgcttatggcccgttcgtgaaagctcccacgtgttcctctcgtctgtccgcctggctcctgtgtcctcctctcgtatctgtcccctctccccagtggccacgtttcctgtccactggatgctccctgccctgtggctgccctgctgagggtcccccttgctgtcactgagagagaaagcccttcagaaaccccagcccacacatcagggcaccggggctccttcccgtcgtgctgctttctagaaccgtgcccctggcctgcaggtgatgcaacacccgtctgaaggtggccaggtgctgagcctctgcagcagcatcaaggaggcccccgtcaaggcggccgagatctggatcgcctccctgtccagccagcccattgaccacgaagacagcaccatgcaggccggccccaaggccaagtccacgggtgagtgtggtgccagcccgctcctgcccctgctgtggggaggccctgccttccagccatggcacatcgggtggcagaaactgtccagcctggcttaaggagttgggggtccggagcacgtgtcagttgctctcctgtctggaagccacagcagaggtgcgcgctgttgtagggtccgggctgccacaggtccctgttctgcccccgtggctgcagctccttggtcaagaggcctgagtcctgagtgtcctcaaaaaggaggtgtggggtcgcactgtgatgcccttgctggtctgggtgcagggcccgccatgggcaggtgccacagctgccgccaccccagtggggtcaccagggcctcccctactcctcaggcgggggagacccagtcggtgcaaatccaggctgaaatgccagctggcaggaggggccgtggaggccggagcagttcatgtggccccctttgccctccctgcccctccccacttcctgccaaccccgacctggaccgttgccagtggacttgggggactcgggggctcggggccacggcacctgtgtctggagcccctctgtcctgcatggatccacctcctcgctgcccccactctgtgtccagggaagcctgggggtggtcactgcctggtttcccgggtggaatctcacggcaccctcccttctgtctgttcattccgcagataactactccgaggaggagtatgagagcttctcctccgagcaggaggccagtgacgacgccgtgcaggggcaggtgacctggggccggggctccgcgccctctcctggctcacaccgggtgtcctggggtctgtggggtcctcaccagctgtcaccagggcctcgtgagggtgggtgagccacgggcctggcccctggttggccgcccatctctcgtctcccgaccccaggggcccgagtttatgctcaggtggctctgagagtcttgggacacaggtgggctctcagtgccgggcctctcccatcgcccacgctgaggctggcagggtcctgccagcactatgcaggctgccgtggcctcagccactgcatatgtctctgcaggacttggacgaggacgactttgacgtggggaagccgaagaagcagcggagatcgattgtaagaacgacgtccatgaccagggttggtggagactgcttctatgaatgctggggaaggcgagggtcggggaggacgctgggagcctgggcgtgggggggacacgggcgtgggaagtgagatctcaccccaggtcacagcagcatgtcccgtggcagaccccctgattgccagtctcctgccgggtgccactgtctcccctgcctcgccacatctcctggctttagccttgtgtggccgctaggctcagtgggccctgagcaaggctgggaggctgcctcgctgccaggctcactccatgtgcagaaactccgggaggccatcctcccttttgtcccgtcaggtgcccacatacacctgagtgggctggttcccccatttttgtttgggatctggcctacctacctccacggtccccaggagcttggcagggctgttcagcattttttccctgaggaaagctcaggcagctctttcctcagaggccgtgtccggcactggcacagagggtccaccgcctggcgcctggacaccccaaggacaggcacggttccagggaggccagcgcaggtgggcggggagctctgtgcctggtgctgacaagggacatgggcacagcccagcccggacaccgccgcctcctctggcagcattcaagggggcgctgtgggcagacggtgccagggacgggcaagctgctcccaaagtggtgaagctgtgtcttgctggcctggagagcagcccccgctgtgcagaacaccagcttgagcctccattccagggcccccttgggcccaactgttgtgaagggagggcgtgggctgcctttgtagggttggtccccgagagggtggctgagggtcccgctcacccagtggctggagccgaggttctgcagtccagggtggcacgaggcacccacggggctcaggctcttggagcacgccccaccccacactcgcccacctgcccaccccacgtgggtgcccagcaccttccttctggggtcggccagggcctttcctgggagggggtgctgagggaagggccccgtgagcctgggaagggctgcagaggcttctggaagaaccatggagtccgcacacgcctccccgggtcccccttggccaggaatggaactgtcagacctcaggcctgttgggaagcctctgggagccacgagcgaatccatcagcgtggctggtgctgaggccttgctgctctcccacggcgggcctgggtgcggcctgggcctgaggaaggggctccagcggcgggtctgcagctctggcggcggctctgactctgcaccgcctgtcttgcagcaacagaacttcaagcagaaagtggtagcgctgctgcggaggttcaaagtgtccgacgaggtgagtgcgccgcgccttctgctcgcggcccccacgcctgcaacagcacctggtcgggaggaggcctctggggtctgtctccgggccacctctggttctgccgctcaccgtctgcacggccccgccagcatcgcacagtctgcgaggcgcagtgacagtggcactgcctcccgggctccaggtcacccgctgggtctctgctgaagtagaagtcgtgaataccctggaagtcggaaagtcattttcagggggatgtaaccattagtttgtgtgtttttttttttataaatagactttagtttttagagcagttttaggtttacagcaaaattgagcagaaagttcagagttcccatggacccctccccacctgacagccccccactattgacatgggccccccctccccacctgacagccccccactactgacattccatggatttttaatgttcatcttttagcttttctctaatctctgaattttctacaatgagcttgtataattttcataccgaaaagaaaaacatggctgggctcagtggctcatgcctgtaatcccagcactttgggaggccaaggcaggcagatcacttgggcccaggagtttgagaccagcctgggcaacatagtgaaaccccatctctacaataaaatacaaaaattagctgtgggtggtggtgtgcacctgtagtcccagctacttgggaggaaacctagtaggccaaggctgcagtgagtggagattgagccactgcacttcagcctgggcaacagagcgagaccctgtctcaaaagaaaaaacttcaaatctcggctcactgcaacctctgcctcccaggttcaacagggtttcaccctgttggccaggctggtcttgaactcctggcctcaagtgatctgcctgcctctgcctcccaaagtggtgggattacaggcgtgagccaccgcgcccagcctttgttgtttctttaacgtcagaagaaaaacgtgcctgggttcaggacctgaagtggagaggtggcgtttaagcgtctcagccttgaagcagggttgtcacccgtcggcctgagagcacactgcctgtagatggcgctgtgtcctaacatactcgggatgcatccagctcagcccctggggcacacactcagcgaggctgtcaggtccatgtgccgaaacaggtgctttgtggcccggtggggcaggcagcatttctgggaacagcgtaacatcaccaactggccgcagaggaagggcagctccgccactgggatggtcatcgggcccctgtgtcttttggtttgcatcttggattggaacattcccaagtgcagctgaagatgggacttagccaagtcggctccctggcctggggcttccttgagccctgctgagcgcctgtgggttcaggggtgggtgttcttggttgaatcttgaccgtggggttctgcactcacctgggcaactgaactgagtcccagaatgcatttcacttacacagattatggttctgagactcacaacccaaactgtgaaaagatgggccaacgtcacagacgctgttcagggagaggacatcgttttcatagggataattgcacagcgttgtgtgaaattcatgcaggtcaacacagtactttaatggagtgatgggatctctttccgtattttccacccatcactccctttcctgaaaagaccagaccatctccgccacagctctgaacctgtgtcttggccactaggagtgccacacctggcactgccccctgcccaggacttcacagcaaccctcagggggcaggagatgcacagtgagacgaggtcaccgcctggattacagccatctgagattgttcatgctgctataacaaaatactttagactgggaaattaataaacaaccaaagtgtatttctcgcagttccggaggctgtgagtccaagatcaaggtgccagtagactcggtgtcttgagggcccgtttcccatagagggcaccttctgtgtgttgtgtggtgagagggcctgacaagctccctcaagcctccctcatcagggccctgagcctattcagcgggcagagctctcgggccctaaccacctgttagaggccccacttcctaattctagcaccttggtggtcaggtttcagtgtaggaattttgggggtacaaacgttcacagcccccaggctgaccacagagcactggcatccaggctgccctgtgcccaggtgccacacagtgggtctggtgaggaggagagcagggctctgcttgggacccatcctgtgaggaggaaccagagtgaagtctgttccttacagccctcagcttcagctcacagcgaaagcgtccgctgagggctgccttctgaatttttcattgtaaaaggtggcacacctggatagtcagttgattttcaacaagggtgccaagttcattggagaaaatatcttttcgcaaaaaaactgaggcttgacaatgcacaccatgtgcagaattcagcttgactggatcatattcctaaatgtaaaagcctaaaatttaaattacctagattctaagccttaaaaaatatgaacttaaatcctgcactaatgccactgaactgtacacctaaaaatagataaaatggtaaatattatgttttatatatttttaacacaataaaaaaagtagaaatttgctttctgaaaggtactgttaaaagaatgaaaagatggccaggtgcggtggctcacgcctgtaatcccagcactttgggaggccgaggcagtacgaggtcaggagatcgagaccatcctggctaacatggtgaaaccccatctctactaaaaatacaaaaaaattagctgggcgtggtggcaggcgactgtagtcccagctacttgggaggcagaggcaggagaatgatgtgaaaccaggaggcagagcttgcagtaagccaagatggggccactgcactccagcctgggtgacagagcgagactccgtctcaaaaaaaaaagaaaaaagccacaggttgacagaaaatatttgcaaataacatacctggtaaagatttgtatccaatagatatattaaaaactttcaaaacccaataagaaaagcaacctgatttttaaaatgagtaagactcatacagtgaaactatgaaacattttttaaagaaagaagatataaataagtggaaagatgtcatatgttcatgaattggaaaacttagtcttgttaaggtggcaataatccctaaattgatgtacaaattcaacaaattcaagtgcgtatcagattcccagctgtgtttttgtagaaattgaccagctaaaatttatgtgtaaatgccagagactcagggcagacagaacagtcttgaagaaagaagacttatacttcccaatttcaaaatgtactacaaaaccacagtagtaatcctgaccatgtggggctggcccagggacaggcatggagatcagtggaatggaggtgatagtccagaagtgaacccttccatttatgggcaagtgatggtcaacaaagatgtcaagatatccatgggggaagaatagtcttcaacaaaggtgctaggaccactggatatccacatgcaaaagaaggaattacagccagctgtggtggcacatgcctgtaaccccagcactctgggaggctgaggcaggcagattgcataagtccacatagtgaaatcgcatctctactaaaaatacaaaaaattggccgggcatggtggtatgcacctgtaatcccagctactcggaaggctgaggtgggagaatcacctgagcccaggaggtggaagctgcagtgagctgagatcatgccattgcactccacctgggcaaccagagtgagaccctgtctcaaaaaaaaaaaaggaatttggacccctacctcacaccatattcaagaattaactaaatggatcagctgggtgcggtggctcacgcctgtaatcccagcactttgggattagtggccgaggcttgaggctcaagtgacccggatcacttgaggtcaggagatcgaaaccagcctggctaacatagtgaaatcccgtctctactaaaaatacaaaaacaattagccaggcatcgtggcgggtgcctgtagtccctgctacctgggaggctgaagtggaagaaacacttgaacctgggaggcagaggttgcagtgagccaacattgcatcattgcactccagcctgggcgacacagcgagactctgtctcaaaaaaaaaaaaaaaaacttgaaatggatcaaatatctccatctgtgagctaagattataaagctcttagaagaaaatgggccaatcttatgaccttgggttaggcaggggtttcttagatgtgacatcaaaagcataagcaacaaaaggtaagtttttctggaccacagcaacattttacagttttgtgcaccaaatagtgccatcaagaaaaccgaacagtagaacagaagaatgttttttgcaaatcatatatgtgataaggggcttgaatccagaacacataaagaatgcttataactgaaaaataaagacacagacagtctagttaaaagctgaactgtccattgctttgagaacgatgcagcctcaggtgccacggagctggggcccgcccactcctgccctgactcgctgctgtccacttgtactgagaagtcgaccaggaagccgcctcgtggccacggcttttaaagacaccgggaggacacctctggagcccgtggagtgattccttgaattagaattaccctgaccagctgcaatgtaaaatccctggaggtgtgtgctggcttatgaggggcacggagaaaaacaatctcaaagtgaaagaaccagttctgatgcctgccaagtctttgagaatcactaagagaaacacaccttgtggtgaaggttctcagacacaggatcacttccagacgagaatccataagcagctcgtggacctgcctggtccatcctggattgtgaggctgattgctctgttggaattgagctgcgagccgcggttgacatcaccattgcagatgcttaagccaagtgttttaataaagtgattatcacttgtcagaaccaggcacagtggctcacacctgtaatcccagcactttgggggctgacgtgggaggatcacttgagcccaggaggtcgaggctgcagtgaactatgattgtgccactgcgctctaccctgggcaacaaagcaagaccctttctcaaagacaaagaacagtgaattgtccaattaaaaaatgggcagggggctgggtgtggtcgctcacacctgtaatcccagaactttgggaggccgaggcgggtggattacaaggtcaagagatcaagaccatcctggctaacacggtgaaaccccatctctactaaaaatacaaaaagtagccgggcgtggtgatgggcgcctgtagtcccagctactcaggaggctgaggccggagaatggcgtgaacccgggaggcggagcttgcagtgagccgagatcgtgccactgcactccagcctgggcaacagacagtgcgagactccatctcaaaaaaaaaaaaaaaaaaaaaatagggatctttctaaatagatttcttcaaagacacacaagtagccaataagtacacgatcatcatgatcattatcactggtcattagggaaatgtaaaccaaaccacaatgagacactacttgatccccactaggatggctggaacaaatgaaatgcaacagggtgaggtgtaacagcaggaacccacaccctgctgggggaatgtaaggtggtgtggcagccacaggaagcagttgccagacacccagcacccctgttcttcagtgttgacttcagggaggtgaacacacacatgcatggacccactcagacgttcacagcagcttcatctgtgatggtcataatgcccgtcagctggtgatctgttagactggggtccacccactcagtggcgcactgcagaaccatcagaggaagtgaataaaggaaagaggtttagttgactcacagttcagcatggctggggaggcctcaggaagctgccaatcatggcagaaggggaagcaggcaccttctttatggggcagcaggtcggagtgggtgcctgcaggggaaatacaagatgcttataaaaccatcagatctcttaagatgtgctcattatcatgagaacagcgtggaggaaaccacccccaggatccagttacctccacttgtcctgcccttggcacgtggggcttatggggattacaattcaaggtgagacttgggtggggacacagtggaacatgaagtgtgccacgctgggtggatgacgccctcctccccccgccaccgagagctgcaggccacatgattccttttgggtagcactcgggaaagggcagaatgtacaggaacagagtgagattcgcagggcctggggctgagggaggggacgcactagaggaaggcaaaggggagcctcctgggtgtggggagcactttctgtcttggttttggtggtggctgcacagtggcccacacccgtcagagctcacctgcctgcacccaggccctccgtgcaccctggcagcccagatgactgcaccagcccaggggaggtggaggaatgccacacgcaccggtacctggggaccgggggtcctcggtgatcatcccgagctccaagacagaagctggactacagccgtgctgagtggaggggtttggtggctgggtgcccgcctcctattgctcctgcagactctggggtctcgggcgcccccagtggggcaatgtgggctgctgcagggaactcacgcgtgcctggcacccgtgcaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggtgagccctacagggcggggcggggaggaacagccatttcagatgccccggccactctgcgaccactctggcagacccatgtccagccctggagacggggtgggcagggccagctgcctcgaagcctgggaaggctctggtggctggaaggaggggtgtgcggctgcctggcaggcccaggctacggctgcactgagccaggcagctttcctttcataggccagggggtgcaagctctgggctggggaggaccgagaggggtcccccagggtgctggctgggctgggtgtggcaccccgttgtaggggatccgtctctgggggatgccctgggaactgcaggggacctccgttcactcaggtggggagtagagctcccatgctgggtgcccctccctgaggaggaggaggcagaggcaggtggggagggggagggcaggtgtctctgtggctggatgggaggaggggctggctggggtggcctggcctgggcaggaggagaggatgcagggcaggcagctctgtgcatgggtctgggtatggaggcctcggtcagctgggggcaggaaggcaagcacaccaggcagaaggcaggtgccagcctctgggcagctgctgaggagccagaggccccagtcagagtcaggaagcttggtagaccttttgctctcacacttttttaacctaaacaacacgaagaaggtggccttgctgcatgttggaggcgcggccccagttagccctgcagccacgcagcggcctcccacctcacctgccccggcctggcagccccagcccaacttgctgctccttcagttgccagcagccaccataacaggtgaccgcggatgtggccaccagaaacagcctctgttcctcctgttctggagattgccatcccgaggctgtggcctcattcttggccagggtctcgctgggctcgggtggaggtattggtggctgccctgactggggctccgaggtcatgcagtgcaggcccagcgtggtggttggtggagttcagctccgtgtggctgcgggatgggggtctggctgccctgccgcctggtggccgttggtcattcttgccttctggcaaccgtcctcgtaccctggcccagggtccctcctccaccttcggaaccagcaaggcccagtgaagtccccctcacactttgggcctccctggccttcctgcctcatctcttctgccttcagccggagaaagttttctgtctttaacggctcacgtgattccataggagacatctttgtggcccagatcctctcccatcttaaactccgtggtgttggctgtatctgcagagccctggccagctagcattcatagtttgaggagaggcgtgtgcgtctcggggctatgatcttgaatgggcacacacagcagcaagtttccacgtgggtttgtcacccagggtggagcagcagacactgctaagtcccgtctgtttttttagggggcgggggagttgtttgtttcttgagataaggccttgctctgtcagccaggctagagtgtagttgtgcagtcgtggctcactgcagcctcaaccacctgggcccaagcggttctcccacctcagcctcctcagtagctgagaccaatggcgtgcgccaccacacccagctaatttttatatttttgtagagacagggtctccctatgtttcccaggctggtctcgaactgagctcaagcgaaccacctgccttggccacccaaagtgctgacactacaggtgtgagccagtgcacctggcctcctgtcaaatttttttcacttgaaaggtcttttaagtcttattgaatctgtaggtctcccttcctcctttttcttcgtacatattatatcaaccagggatgagacattcggcctggatggcctggatcggccagatggtctgcaagggtctggtttgtctggaaaggcatgggtggcctggatcagcctggatcagcctgggtggtctggaaaggcatggatggcctggatctgcctgagtggtccggaaaggcatgggtggcctggatcagcctggatcagcctgggtggtccggaaaggcatggatggtctggataggcctggatggtcgggaagggcctgggtggtccggaaaggcatggatggcctggatctgcctgagtggtctggaaaggcctggatggtctggatttgcctgagtggtctggaaaggcatgggtggcctgcatcagtgtggatagtgtggaaaggcctgggtggtccggaaaggcctggatagtctggataggcctggatggtttggaaggacctggatgggcctgggtggtctgatctgcctggtgggtccggaagggcctgcttcatctgatgtgcccttgttgttttgtcgagcatgttcacctgtttgctgcaggctggctgcagatcccagggctgccctccagcaggattggccagtggagctctccccagagccccttcgtgtttgtggcagccttgcctggagctaaggctgcgagtttcaggggtgtgtgtttcctgcagctgatgtcagggcaggtggaagaaccaggacggggcagccaggttggcccagcgcttagtgttgccagctccagaatcattctgtgccctgtgctgcagctggtgcgagcggggtgtgcgctgacacgggctcttctctggacccagctctgctctgccgttggattctgcagtctgtccctccaggtgtggtgggagaactgcgctttcagtgcaagaagggtcctggaaattaacgtgtcccccacccctgttccctgagccaggccatactttgaaggcctgtcgcactcgagctcgcagacggagattgggagcatccacagcgcccgcagccacaaggagcccccaagcccggtgagtggggccacactgatctcccagagcagaccgtggtctgactgggctgtggtgtggcccaaatctcccagcatgtcctgggcccagggccctgtccagctgtcctggagccactctgcacccactgtccagcacactgccacgcaggtaccccgggcctccctgagtcccagcattcccagtccagaagtcagcgccttggcacctgcagttgagcacaagctgattcccatctcctcccccacaggctgacgtgcccgagaagacgcggtccctgggaggcaggcagccgagcgacagtgtctctgacacggtggccctcgtaagcaggcttgggccgcacccacccgttccacacatcaggcacaccaatgctgcctttaagggtctgacctggaggggcggggcccacatataggtcctcatgtcacacctggtgtgcagaggtggggtcagccctcaggggtggccaggctgccagatggtcagagtatcccaaaattcactccagcttcagggtcagggcgccctggactcaccccaccctcagggtcagggcagctggactccccccacccgcagggtccggatgccctggactccccccaccctcagggtcagggcagctggactccccccaccctcagggtcagggcagctggactcaccccaccctcagggtcagggcccctggactcaccccaccctcagggtctgggttccccagactcaccctaccttcagggtcagggcgcctggactcaccccacccgcagggtcagggcccccggactccccccaccctcaggtggatggcacccaggaacgcctggttcccccctgctgcgttgcatggggtctcctcagttaggaggtcctgggcccagggcaagtcaggtcctgggaggttgggggctggtcaccctgcatggcccggatgggagccctgtgcttggaatttggctcagctaggctccctggtcagcgtatggccgggtccacatgtaggagccacggcctagagaggcctaaaccctcacccgagccagaggccacagggctggagaggccgcagcacgggtgtggtttccacgggaggctccaggcccgtctctgctcagcagggtgtgccaggcccgagggagcaccctggacagcctgaggacagccccgaggctgaggcctccaccctggatgtgttcacggagaggctgccgcccagcgggaggatcaccaagacagagtcccttgtcatcccctccaccaggtgatgggggctgcacggcggggcggggcggtgatgcacctgtcgggggaggggccgtcacgggcatcagtcggggtgggtgcgtgtcagtccatcctgatgagctccctcgggtgtagacagcagattcagggcctcgtccttcttaaaaaggagaagcaaaccccctggcccggcattgggtgtcaagcctgcagccccagattccaccctacctgtttgagggcagggtcaggcgggtctgccctccagcaggtgcccccacatccccctgagtagcccctgcctcagccaaaagacacacatacaccagcttgattcttccaggatttcaatttcatgtttctgtgatatttgggactttttccaaagcagcgagtctgggcactggtttttaccttgtggtggcacgcaggtgcctgtgtccgcgctttggagccaggtcgccctggcagcctcagtgccctgcactggcctgcacctggctctgcccagctcttggcccgggcagggagggtgagctcagtcctcacggtggctccaagcctcctggcctggctcgaagtctcacaggcagagctgtgtggggtcccatcggaggcacggcctcacttgtactcagctgctgctgtggccctcccagggctggtgacctctctgtgcagcccatgttcccactgcccatcagtcagccctgtgctcacccttccctgtccccaccacaatgtgtaggccactgcaggcctgcccctgcctctgcccctgttcctgttcctgctgccacagccacttagcctgtcctggtccccaataggtccgaggggaagcaggctggccgacggggccggagcacatccttgaaggagcggcaggcagcacggccccagaatgagcgggccaacagcctggacaacgagcgctgcccggacgcccggagccagctacaggtgcagctgcaggtgggggtggagggcgtggcacgcccaggaggcagggctcgtggtcaccctggcaccaaccagagcagggcaaaaagagaagcacagggggccaagggtgctgggccacagagcatgcctgggctttggagggctcctgctacacagcagggcgggcgggccatgggttggtttgtcaggaagaccatgtggaccccagggcaagttctagtccttctgctgccctccctggtccagggcagcctcattgcttggctgatttagcccagggcagttctccaagctggccagctctcttcctgccaccgagcctctgtggctgcagggggagcaggggcactgcaggcaccagggctggcgtggtggggatgggcgctgtgcttctcttctgggtgtggacagggctctgtgcctccagatccccaggaagactgtgtatgaccagctcaaccacatcctcatctccgatgaccagcttcccgaaaacatcatccttgtcaacacctcggactggcaggggcaggtagaggggcagtctcttggagtggagggtcagggtgtaggacagaggagagtgggttcctgaagctgccccctacccggcacacctgggtgctggagctgctggctgtggtttgcctggacgtgcctggggtctctggagcccctgagagctttggtgagggtcaggtgctgggggtggcctgggcggctgtgccgaagtcagcgtctgcctgtcttctgccagttcctctccgacgtcctgcagaggcacacgctccccgtggtgtgcacgtgctctcctgcggacgtccaggcggccttcagcaccatcgtctcacggatacagagatagtgagttgggctccaccctgtactcaccacccaagtacccctcggggtccctgcacccccacctctgcccattgctccggggctaggtgcgtcctggacctggggctgtggctggtgtccacagaggctgacccatgcgctcttcgcagcctggcctcccctcagttgtgggcgggagcagcagcctggtgggtgtcctgccacactggagtggtggcctcctggcctgtccttggaagcctgggctgaggccatgactgtgtggtccctcagcctgggcacgtttgggcatgtgggggtcctgggcttgggcagctccagggcagttgtggcatgagcggccacaggcacggagccccctgggctcacactggcatccttggatggaggacggctcccctgaggcgtctgtcccctctccgtcccacctgcctctggattgcagctgcaactgcaattcccagcccccgacccccgtgaagatcgccgtggcgggagcgcagcattacctcagtgccatcctgcggctctttgtggagcagctgtcccacaagacacccgactggctcggctacatgcgcttcctggtcatcccactgggtgagcaccacgccgtccacctgggcctgggcacagatgccacgggcagtgtggcgtggcatggagtggtgtggcgtggcgtggcgtgttgtgtggcgtggcgtggcgcggtgtgtcgtggtgtggcgcggtgtggcatggcgtggtgtccctgcttgctacacatttgttgtttttaaatgtttgtttgatacagtaacactttgttaattttaattatatgcaagataacttgattgccctaaaacagccatttgggtcaagataaagccatcgccctctgaaggggcctgagctgggtgtctcctccatcagtcgctgtgataactctatgccagtttcgatttccaaagtcagaagtgcaaagcagggctcgttattaatcctctcaaatcgtccaggtcctgtgtcgtcgaactccattacttctttaggtccatacgatgtgtcttaccacgaaacaaacccacccagccttaatctgttgaccagcagcaaggcctggaggcgacacctctcccgtgtggccctcacgatgccgacgtcagagccctgagccagccgaggcctctgcacggtcacatgtgccctgctgggccttcctcagtggcactcagggctctgggacctcagctcagggctggagctccttcagcggggccacaggcatccaccagggaggggcagtggtggctttctctttcggtggcaggaaagtgggcttgtctggaaggcagcagcacaggcctggggtcgggtggcccagcttttgtgccgcggtgggagccttgcagctccgagtcccccgtggtgacaccagccccacccctggcatgcaggctcccaccccgtggccaggtacctaggctccgtggactaccgctacaacaacttcttccaggacctggcctggagagacctgttcaacaagctggaggcccagagtgcgggtgaggcccgggcgcgtccacagcccacgccacggcgggaggaaggggccccggtttccccagatgctgtgcccaggaggccctgcacctgctcaggctcagcctcagggaagaggccatggacagggcctgctggggccttggccaggatgcctcctattcccctgagccttggaatgttggaagctgtggggcctgtctgggaaggggcgggcacagcccttcaggtcttcccacgcttgccctggtactgcctcgagagtagagcaccagggcccctcagctgcaaccagcgagccctgccgcgcttcggggtacgggaggcctgggcggggcaccggggaggcccagcttagccccgcctgcaaccccacctggcaccagcctaaccccccaccgcctcctccccctgcagtacaggacacgccagacattgtgtcacgcatcacgcagtacatcgcaggggccaactgtgcccaccagctccccatcgcagaggccatgctgacctacaagcagaagaggtaacgcggtgggcccaggcaccataccacaggctgccgccagccaccaaccctccgtgggcctccccacccgctgctgggcttggcctggtgggccgcagagccctgcaccgggcttagaccagagcctgggccagctgggcagctctgggcctccctgacagcaggtgcttccccgcaccccagatccctcatagtaagcgccatttccgcacctgtttctgtgcatgttgaaaccccgcgtgataagaagttgacagaatggatagctgtcatggggccagggtggcagtggcccagcccctccagtctgggcacctgttccttccacagcctgggtttctcgggctggggaacgaaggattccctgggcctcgggccctgtgggtgagtgatcagctcgtgtcctcacctgcccagagcaggacggtgctcaggagcccccggccgaaagtcctgcggagacctgtctgtcccgcccggcgcctcctccctgcacatctggcgccactgtcccacaccttccctagactacaggggagagagccgagtgcaaggcgcaaagccagcgctcacgggctctcccacgcaggagccccagtgagatgggagccactgagtgccctcggcggtccctggaggggtcctgagggcgtcgtaacgtgtctgttttctcttttggtggctttctgaaaaggaaaaagcattttcattttgactttaccctaaggtacggctctgtgggtctgcctcccaccctgtctgtccccaggctggtcttcagggcttgtttggcagagtcacgtaggaatcaccccgctgtcctctctccggactgggagtcaggccctgagggccaccagctgcaggctgagagcccgcacgggagaggggaagtggccccaacccgagtcactttttgctgacgtggacccttttcctccatccgatctctgacactgagtcaggagagcagcagatgggccctcctgtccctggccaggcccgtgtgctgggactccaccccagagccctgaagcctgcaggtcggccaggcaggcctttccccggctctgttttgaccctgggttttgatttaagaagtggccaggtttagcccctcctcgttttaaaccaggagcgagtggctggtgtggacaccaggatcacctgggccaggctgtttcccaggcccttcacgtttgtgaagctggcagcagcctagcaggggcacgggtgcacgccctacacacggggacgcccaagcaagtagttaaggagctggcctggtgacacggtggtcagcggctgtgccttgggccccctacacactgcagagcctggctcccagggctccctcgagcacctggggccagcagagaggggtttccagcatcttgtggcttacctggagacggggccaaactaccgagacctccaaatgggggtaaagagttttcattccgaggcagctccaccccctacaacctttcatgttcagagccaagtcccaggcacccccaaagctgccctttcagacagagccaccccttttccttggccaggtgtgtcctgctgcagggtgggggcccctgctggtcctcccatgggctcgttctctaccccgtgtcttctgccctgtgtgaggtcatttgctgtcctaggaaacccccccaaccccctgacctcagtgcagggtagttgggtccctggggcccccttgctggcctaggagctgctcgaagtgggcagcctgggaccacccacagctgtagggctgggcgctgggaagacacaggaagggggctgaacatcctatgtcttgtcctgctaaacaagccttcacaggtgaaagaccagccgtgggggcctcccctgctgacccccagcagcctccgcccttgccccctggctgtggcacgaggagcctgcagcatgttctggccgcccggccgccgcaggccgtggacgcagctgcttgtatctcccaggtcagctcttccaagcagcaagccagggccttagggggccttacacccactcccaccctgcacctcctgcccctgcctccgtgttgcaggggtgacactggctgcctccacgttataagggtgacactggctgcctggggtcctggaaggaacccagcaaaggccataagtgtcttacctgctctctgtacccagaggagggtcagtcgggaggctgagagagtgcaggcggtggcacagcccttgtgacgggggacctgtgcagagccctctccagccaggctcccctgcgagagtccctcgtgaggtgactcctgctggcccgccctcctctgccgagaatggcactcctcctatgagggcaggccaggcctggagggcggcctcgagccccagcctgcccgtgcagcgcatgggtggaaagggctgctcaggcatccggcagcttgcccagggccatgcggagtggcccccaaggcatctgtgccctccgtgcccgcggggcctccccacgccacggtggtatgctccttacactcctgaccacactgcctccacagacatgtgtgtgcctccagggtcaggatgagggtctcagtgtccagccggtgtcacccctgtcatattggcccatgtccagggctgggtgctgtctgcatggcccagaggcgcagcttggctttgagagttccagcaacatccctgtgttgtgacgtctcctgcattcggccctcatctgccacgcactgccccatgggcctcggagcagagcatggatgggaggccagcctgccatggctggctcggtgggggggtctggctcggcagagggcaggtggccctgggaattggagccacccatgccctggggaccagcagccaccacctgtcttctgtgccttcgcgtgcctgggaggacacagatgtcacagatttccaaacactggtctgctcaacaaggatagtgggatgtcaaaggccacgtccaggcactcctgcctgacagctgtggacacagccagggtgctggggggccaggaggccgccctgaggcagaggtgggcctcaacacaggatttgcatcgctttatgttatttgaaatggacaagaagaggggaaagtttcaactcttctccttagaaatggaactaggcctggggcatctttaatgggatgggaggaatctgtaggtggtttcatccagaggcatttgccaggtcttctgcagagggtgggccaggagccgtccaggttggcgtctggggagggtgggtcttgccagccgccgtctcctcacactggcgctgcgaagacagggaaggcacctgctgggaccagccgcagaggctgcctcctgggagtgtgctctggaccggctgccgggcagaggctgttttacttgtgggcacactttgtggggagcactgggatcaagcctctgccctgcagggctcttgaggagatagcgctgctggtcctgggagctggtgctccaggcagacggctgggctgggcctgtggcatcctccgctgggcctgtttcctgcaagggattctctctgaatgaccctgtgctggacgacaacccaagggagggccggggccactgtgcgagcccatgttctgcacctggtgccgggctgtccctgagggccaccctgctggcctggccattctcgtcctgcccccggcgctccaggggcaacaggtgctcctctgcactgtgtgtgcacagtctccgcctgtaagacagccacttgccggcatcagactctgcagtttggggaaatgagacagaagaaacagctgagggagctgcccagagagaaggcaccagttgctgatgcggtctggctgaggaagctgggcggggaggcacctctgtccctacgtgcaggccacggggggccttgaggccaggggagaggaggaaagaggagagccagacccagcccaccactcaggataggccctgccctctggatctttcctggggcccagaaggagatgccctcacctcaccctagctgccggcggggcctcatgctgtgctggccccttgtcttgtgggagagctccctgggcccaagcccaggctgcagtgggcacagtcagcaggagcctgtgcgagctggaccacaggacagccctgcttgagctgcacacgtcggaggggaagacagacgggtcccctcagcggccccgcggctcctgtcctccacccttggcatcttcgtgtggacgggctgtgaccagacttccaggagaggctgctgttacctgccagatgttgtatggggccaagtccaggcaaaacctccactgcccgctgagtacatcagctcacgcggggcacggcctggggtgtgctgggcctgcctgcaggctgtgcgtggggtgttctggtagaacatggaggcccactgcagccaaagcctggcctcttatgtgggcatggacgttacccagatagtctggagaaaacttctgcaccctggctttggtgctgctgattaccagagagggcccaggctcttcctgggagtcccagggcactggcagctgccctaaccccagcagagcaggggtgcccagcttggtggggaagtggaaatgcaagccggacagggctgagctggctgtgtgggcgtcgggcacctaggatggcagagtgaatccctccgtggagctgtgccctctggcctgtcctcctgaccatgggtgcacagagacccctttgtccttccagcatgtcagcatgtcagaaggggcccaggcgttggtcctgggggccaggccagggctggcagtggttggagatgggtggggccgggacacacagggcagggctgtccggcagggccatccggcagggccgcggccccagggctgcgccaggttctcaggccaagagggagctgtgcccaccaggcggggctgtgccctgaggagagcttaactgtctgtttccttgctcttagccctgacgaagagtcctcccaaaagttcattccctttgtcggggtgagtactggccagctttatgtgatgggaaaccgcacacctgccaacttgtcgtttacagtcagaacgtttggggattgactcgatatattccagaaccttcccacagatacgagctggggatttgccttcccatctggcctgtctcaaagctcgcttccttccctgctggagtggggtgtggggccagaggttgttagttccccttagctctgccttgggggctgataaatggaagcagagacaggtcggtggggcgaggcctcagaacacccaggaggcttggccccacgtctcaggagaggagagactgcctgcccgggttggggagggcgcctctgtcctttaggagcccaaggccccgggagcttcccagtgctcacttgggctgcagcctgcagtgtgtgggtttcacttcctgccctgcccagggttagggctgcttctgccagccaggccatctccctgccagccctgggtctccacagcctgtttcctgccatcttttcgctctgttgtgtggcctccctcccgccaggtgtctgctgtgagacagacccacagggcctggcagacaggttgcccaggcagcggaagggtctctgggcctcggtttccccactggtggaacagaggcctttttgtgcaccgtgcagtggttgggtctgctgagggctctggggcgatggctggccctctgggagggtggaattcgtcttgaacagcggctgcccaaagagctttctccggtgacaagagtacactgtgctcgggcacacaggccttcccatgcaaccaaggccctgcggtgtcactgggattcacggtagatctacgtagccgcctgtggctcgtggctgccaggtccggggcctatccccgtcggcccgccaaggtccctctcaccagcgtcctgtttttactgcacacatagtttgcagctgccctgagggccgactttagagagagcagtccctcctgctgaggccacgcaccctgagcactgtctgtccccacatggctgctctgagctcagctctgctccacagatggggagagaagggcaggagggagctggcaccacctggccgctccagcatcatgggagtggtggccacggtggggaggcgggagccccactgggagggcgctgggctagctgaattgcacggctttcaccagccagtgcctgttgttttctaggttgtgaaggttggaattgtggagccatcctcggccacatcaggtaaccccgtcccaccctgaggccttgtgagtggcccgtgggtgggctgcaggagcacggtcattcgagtcctgcagaccagatcaacctttcagggcctgagagccgccacgtcccagtcttgctgtggtgcttctgtcctgcggggggttcatcctccaaggactgctgtcacaaagccccacatcaaggctggcagggttgtcttccaaaaaccgaggagaatccgagaccctcccgtctctcacaggccactggggactcccaccctgcccacccccaggagctgcctggcctggccacatcctggtccggagggcctggtggcacccgggcagagcagcaggtgggctcagcctgccctgtgactcctccccaaaggcgactcggacgacgcggccccctcgggctctggcacgctctcctccaccccgccgtccgcatctcctgcggccaaggaggcctcacccaccccgccctcctccccgtcggtgagcggaggcctgtcctcccccaggtaaaggtgcctcacggctcagcacgtttcacttacccgccccaccacatgctgcctgattcagtcatcctcccctatgtcacatccacctcccagggcacctggcctgtcagccacgaaggcggaggggctctgcaggacggctgggtcctctctggccacctcctgccacagatctggtgtttgggggcaggacctctgggggacagaaactcctgcacagtgaataaacatgggcgttgtgctgggctgtctctcagctctgtacacagttggggcttttaaaaaacaagctgagggcagaaggtgcaagagacgtgagtctctagacggtcctcatgggatgagcttcgatagctgtgctgaggccccgctagcccgcccgggtctctccggagcagacctcactcaagtggaactaagccatggggggttgtgggccctgaggccaggcgtggtgctggtgctgcgtgcagggctcacaccagcagatacccccccgacccccctgcctctgtgtttccagccgccggctccttccaggctgcgcctgagggagctggttcgcacgggccctcacgactccaaggggcagcttggagagcaggtggacaggcctcccaggccgaggctctcctgtcgccagggtccctgtaatttaagcaggacccttgtgggggtgactgggcatgtgaacagctccacagagcatgctccaagcacccggccctcctctgctggcaagttggcacaggtgctggctgtcacctcctggcctgtcacagggacagtgatgtccccatcactaggcccaaagatgcaggtgtgaatgcctccctctgcctttcccagccagggtgtcggcgccgagctgatggggctgcaggtggactactggacggcagcacagcctgcggacaggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaagggtgaggtggggcaggctataaggccacacggcgcagaagggcggctctgtgggagagggcggctcgcagtcaacagggatgacagcccccgggctggcctcgggcagcccacatgcgcaggcaggggcgggtggggtgagggagcctgaatcctgagggcagtgagggtcaggtgcttctgaccagagcctcaggcggaggccagctgggtgggcaggagagcagctgtcctcagtcaccgtggaaggcaggtttcctaggtgagcagtgccatgaccagctgagcccccagtgcctcccccacacgtacccctggccctggccccagccccgaaggagcagcaagatgacagcagggcctcttttctcctcccagtgatgtttctgcccaagaaagcgaaggacaaggacgtggagtctaagagccagtgcattgagggcatcagccggctcatctgcactgccaggcagcagcagaacatgctgcggggtgagcaccaccggccccggggtctgtagagtgggacgtaggtgagagcacagcaaggctgctttggagcccagcctaggagctgcgggtgtctcgctgtgacacgcacattccacgattcaaggtgcaagcacattcgatgaagccctcagtgaggctgacaaccttccaaatgctgagaaagaattttttttcaaccctttttgctttttaaaaataatgacttgtttcgtttttcttgtttgttttttgttttggtttttttttttttgagacagagttttgctcttgttacccaggctggagtgcaatggtgtgatctcagctcactgcaacttccatctctcaggttcaagcgattctcctgcctgagcctcccaagtagctgggattacaggcgcgtgccaccacgcccggctaattttttgtatttttagtagagatggggttttaccgtgttggccaggctggtctcaaactcctgacctcaggtgatctgcctgcctcggcctcccaaagtgctgggattatgggcgcgagccaccgcacctggcctaaaaataatggcttgtagtttaaaagtgttggctgagcgcagaggctgaggcaggagaatggcgtgaacccgggtggcggagcttgcagtgagccgagattgcgccactgcactccagcctgggtgacagagcaagactccgcctcaaaaaaaaaaaaaaaaaaaggggttttggagaagatactctgcaagtaactgtttcagaaacggagctctgggaggctttcctctttttgagcacgggtcagatgacctccaggtcgacgtggccctgtctccccacaggggtctctgttttaagggggctcccactgtcttcttcccacacctgtgcaggtggaagtggatgtggacgagcagcgcctggcggaaggtggtggggtctgctccttccacctgcaggcagccctgggggaaatgctgccctccccaccccccagggctctgagtgtggagggcaggggcaggaatggcgtccctcaggagccagcatggccctggagcccccgagtccctgaggaaagtgttgatgccctccagcatggggctccttctcatcctgtacgcccggctgccacccagcctggtgggccaggcaggcaggtggatagggtgggcaggccgggcaggggggcaggcggtcaggcagccctctcccacagtcctcatcgacggcgtggagtgcagcgacgtcaagttcttccagctggccgcgcagtggtcctcgcacgtgaagcacttccccatctgcatcttcggacactccaaggccaccttctagccccacccaccagggggcccacctcctgccccatgctgtgaggggcccagctgcatttctgttaacatttcagtttactacagagacagacgcttaaaacacaaagagaaacagtcttaagtatgaatgtgctcacaacgtggaaactaacgggggagctcctgccaggagccgaataactgctctgcttattaacccgaacgttcggcccggggctgggaagccagaaggacgatgctgagccatggatcgcggaaggcgtcctctggcctcaggagccacccagagcctcacaggctgagttcttgcctctgtgtcctgtccttcctggaagtcaggactctgcttcctcagggagcccggggaaggcggagctcagtggccacaggccgagggccatggggccgctcagtcccgttggggttgtcctgagttgagcctgggggggccgtcctgcccgcctaagagatgcccccagcaccgcacactcgtggttcccaataaactcctgcctgcggcggaggttttatagcagcagatatttttaatgcttttcaatacatgttctaatgtagctgccaaacatgttgctcttctgaagtccccctggggctgggcagagccagcagagcctgcccccacttccccagcccctgccccaccccgcctcacaccttccccactctcaggctgttcttgaaacaccatgaggcttctgcgtgtagtccctgccccaaacttagcaagcacaggggcctccacagcccaggtggccccagaaaatgttccagagcccagcttggtacatagtgagatgctgctggggttggcctgaggtgggggccacttcctccaccccagtgggtatgtctgaggtcagccatggggatatctgggttgagattcaggttttggtgaatatggggcaggcgtccagatgtgtttgtgtcacctgctgcaacgctgtagccaatgaagattccagcgggatggcctgaccagcggggccggcactttggagccgtgggtgcagccaggtaccccgtgcagggcctgggaggctctccaggccacagtcctcagagcgtgttgggtcccatgttgtgtgtgggttccatgccctccacacagcaggagagggcttccctgaccacacctgccccctcagtcctgcttctccccagtaagcctgcactgtggggtctccataggaggagctggggaagctggggccctcccaggggtcctgatcgaccctgggggctcttggcctggtttcgtaagatggagcactgcaaaaggccatgctcagaaagcaaacgcagggcagggtgggcctcgagccggggctggaggggtctccacccttgctggcctgagagatggcccacatttcttacttgtgaccgccctgctcttcctggccgccccccccaggtggctgaacagggtgattttgttgtggtgaggggccaggatgtggcctggtgtgcagcctcagctccctgggttcaggcctcagaggtagcctgtgtgcaggaggcagagccccagcccctcccagccagagcccctccacaccagggactcctccttcacctgggaccaggagcctggggcacaccccagggtgggggagagggtaggaaggtctcccattgaatcctggcttcaggctctgccccgagaagtgtctgcggtgagggtgtgagccccgggctgatggcctctgaccccggcaacaggtgggaccctgactgactcgttcagctgcccccaagctgggctgcagagcatctgtttttctgctctccagtttcttttctttttttttttttttttttttgagatggagtcttgctctgttgcccaggctggagtgcagtggcatgatctcagctcactgcagcctccgtctcccaggttcaagcagttctcctgcctcagcctcccgagtagctgggattacaggcgtgtgccaccacacctggctattttttttgtatttttagtagagatggggttttgccatgttggccaggctggtcttgaactcctgacctcaagtgatccacccgcctcggcctcccaaagtgctgggattacaggcgtgagtcaccgcgtcctgcctgctcttcctgtttctttcccaagggtcacactcagtagggagatgaaggtggaaacatccttgctgtggctttctggcctcagagcaggttttagaggaaggggccacaggctgcctagtgcatcctggctgtgggcagcccctttcctggagccctcctgcctaccccgtacctcccatctggctgcacagctccatccttagccacgcaaggggagaacatgggcagagtctccatccagcagctgggggttctggtggcactccctgtgcccctgctgctgctgggctgtgggtctgccctgcacccaggagccccacggtccatcccccacaccatgcccagcaccagggaggttgggcagacaagacctgggccatgccagccctctgtgcctcggttttcccactggttacacaggatggtcgcattttccctgcctacctcacagagctgttctgagggtgcatggaggagcactctgtcccaccaaggacaactagaaaccaaagccatctgacagccagtgcggtaagggcgggggatgtgtgtgtgaggtgtgcacaccccccgagaacctggccctggactggcctcacaggacaggaggcagccccttgtagagctagggctcagccccatcagtctcaaaggttaagccaccagtcaccaccgaggcacccctcaggcctggtggccactgtccactattacgtagacagaccccaccctcacccaggccagctgtgggccagtcccgccctgcaatctggtctgctgccttcctcttccatgttggtccccttggccactgtctctgggcatgcaagccagtgtcctggttcagtgcctcggccagagctggggcaggagaggggcctctgggtgagagctgggggtgtctctgcagggtactggcagccttgccacactgtcctcattcccagatggaaagacctgagtgcctctcgccttcctccgggaatgaattcctcatgaaaatgaccaggccacttcttccgagggccaggccgccccctccccgagacctgtcctgccgtccgcgggtgtgtggcctgtaggggactgagagctgggcttgctgggcacctctggaatctgaccctgtgggccaaagaagcaccactgtagtttctgcagacccccatgcggttcattgtgcattgtttggtttctaggatgtatgtgttgctagttttttttaatgaaaccctggattaatgtaaatagctttttggggaacggattctaatgtcacgtatgtgaccgtgtggactatttcaaggtgctgatgcaacactaataaacctggaggggccggcccccgcctgcagtgtgattctctcggccgtccaccccttgggagcacgcggcggagcagcgcctccctcccgcccgcgcgccccgtcctgggtcgccccgccccagccctgcggccccgcgcgcgcggaggtggcccggggctcagcggcatcgcgccgcttgaagggcgcagggccgaaaggggctctggccgacaaaccccaagttcaggtctgtgcttcgggagaccccggaggccgacgcccggaagggcccgtggggcggtagcggccatagacccggatatgcgccggggacccccagaccgcgcccatcccccacccgccgcaacggagcccagaacgcaggcgcggcgcagaccggaagcggaaccggtgggggcggggcttgccgtagcggacgttctggagcgaggcgccggccccttgggccccctcaagccgcggtgtactccagcggccccctgtggcctctccatccgcggcgggtctgtccctccttctgtctccgggtgcccacgtaccccccacctccgaccgccgttcccgtgtaccccgcccccccgccgaaccccagagtgcccacggcctccagcgtgtgtcctgagccttcttcccccgtccctccgcggaccccggccgcgcagaccccgcctccccaccggagagggcgggcacgtaagggctccgggctgggcctggggcgaggcctgggccgcgtggaggggaggtctcagggtcggaagcggggctgtggcaagagctctgggcctttccttcgccccgggcgtagcaaggccgggccctgagagcgtgcccgcagtgctggctgagggctgatgcccctggaacgtttgagaaggctggcagaggcgtggagtccgtgcagcaggctgccgaaggctttccaggctcccggggtggggtcggcaggggcagagaggacagttcgggaggctggtgtggagaagagctgcggcgggagctgggggatccactccacccagaggggtcagtgatgcctgacctttggctggaaggtgaccctagcagaccgcgatactgccaccatctgcccccagggactcaggtattggtgggcacgtgggtggccttgtgggccccgccccacctccccctgctcctacccccagatctcagaggtgtggacaagcagcctactagggctagagatggacagcaggaaactgtccccccgggggaagaagctggagtcgcacctctcccaagagcacaggcggcccccactgggcctgatagcagcctggggccagcccagtatccagagcagcgttcagcagggactgcagactcaggactgggtaagcggaaggaaaccctggccgaggctactctcctgtccccagcccgcctgaggccgctgtctctgaaaactccaggctggtcgtgatgagcagcctcaggggagggctgagtggggactgatgagaaacagatggctggactcaggaggctctcttccccatggccctggacgagcaccaaggtggacctgcacccttcttgcttccagaaccgtgggccgctgggctctgtagagaggtcttccaaggccaggaaggaggcaaggcaacacacttcccttagctctccccagtgcctcccaccccaggctgaaggtggcaagaagcgggagggaaagcaaggtccccagggggggtggtgtcctcccaaccaggtggggcagctgtcaggagaaggatttgtcactgaaagttgaccaaaacaaaatagtgggagaggctctgctgtgattccccaaactggaagcatctcctggtctctctactgctggacagtgagctacaggcttgtgtcaggcccagtagtgagaatggtgggatatagctgttcagccttaggacgttctctgagggcagaggaagccagaaccccactcgtgtggttccacttttggaaggttcaaagccaggctgagagatggctctaggctgtggcgagatgggtgcaggggctcctgggcactggcaatgctttggcagctggcgctggtcatgcggccagttcagtgtggggagctcattgagccatgcacacaggcgtgtctgcgtgtgttcccagggctgcccgctgaggcccctttgtaccctctcagtcatgtccttcaggcccaaatgctttcaaaacccctatgatggtgtcaggtgctggggagtggggtgaccaaaccagcagatgcagtggcttttgggaggcgaacatctcatgacaggcaatccggactataaatacacataggtcacctgtctagtgagggccgctcaggaggagggccagggggtgtgaggcttctgtcctgcacagggctggggacagggcactatgtctgaaggggtagggatgtggatgcaggaggagtgtgtattggacccatatccagcaaggacacagggacccagtggctcttgggcaggggcagccaggctgtatttgtagttccaagagatggactggtggctatgggtaatggtggttgaggacaaggctgggaggcagaagagtgggctgaaggcctccaagggcaggcgagcagtgggagaattaggttgttggccaagggtggaaagaggtatgggtgcatctctgctgacgggcaggtttttagtttggggacagggaatcttccctaaaaaatgtgggtgcccagatgactttataggtgggcactcccaaacaagaaattagtcatcctcattgatgaagcttcacctgcccagagccacttctgatatggacctggtatcacccaataccagtgccagaagagaacagagggagaaaaggaaaaagagaaaatgatgtgccagtctacctgtgggcatagattgaaaaatcctgagtaagtactagaccaaatccaggagcacctgaaatgcagaatttcatagccgtaaggatgggtcctgcacacttccgcctgccaggagagcaggcacatgtctcttcacagctctgtcccagtgcttaggacagtgtctggcacatagtaggtgctcaatgaatgtatatggaataaatgaagttgtatgtaaataaaagaagattgtaacccaaggacaaaggaattttgaaatctgtaaataaagttcagtaacaacaggtggaaaatcacatgattatctcaatagatgttgaaaagtaatactaataaattccagtatctttccttaagaacaaaagaagtcgcagccataaaaaaggatgagttcatgtcctttgtagggacatggatgaagctggaaaccatcattctcagcaaactatcgcaaggacaaaaaaccagatgctgcatgttctcactcataggtgggaattgaacaatgacaacacttggacacaggaaggggaacatcacacaccggggactcttgtggggtggggggaggggggagggatagcattaggagatacacctaatgctaaatgacgagttaatgggtgcagcacaccaacatggcacatggatacatatgtaacaaacctgcatgttgtgcacatgtaccctagaacttaaaagtataatttaaaaaaaaccgaagtatagaaacctgtaggttctggataagatgggaagagatggacatctccatagcctgacggaggggagctctcaagagcttgcagtggccaccaatggaagtatttcagatgcaagcagatggatgcatggtaccactatgacgtcagaaaaatcgccaggtgcggtggctcatgcctgtaatcccaacaattcaggaggccgaggcaggcggatcacctgaggtcgagagttggagaccatcctggcaaatgggatgaaaccccgtctctattaaaaatacaaaaactagctgggcatggtggtgggtgcctataatcccagctacttgggaggctgaggcaggagaattgcttgaacctgggagttggaggatgcagtgagccgagattccgccaccacactccagcctgggcgacagagggagactgtctcaaaaaagtaaataaacagtattctggaaaccgaagcccttatagtaaatcaagaaaatgagatgtgtaaatatctgaaaagatgacaatcactatttgcatctaatatgttacctacttggaaaatccaatttaagaaacatgagtacagataaaagagggagtttggatatgtgatcaccattcacaacttttcaacacagtaaaaagcagaaaatggaatggaagcaaaggatactattcaacttagcaacaggaactatgaagttcttagaaataaacctgttattggccgggtgtggtggctcacgcctgtaatcccagcactttgggaggctggggcgggcagatcacaaggtctggagatcaagaccatcctggctaacacggtgaaaccccgtctctactaaaaaatacaaaaaaattagccgggcgtggtggcgggcgcctgtagtcccagctactcgggaggctgaggcaggagaatggcgtgaacccgggaggcggagcttgcagtgagacgagattgcgctactgcactccagcctgggcgacagagcgagactccgtctcaaaaaaaaaaaaaaaaaaagagaaacctgttgttcaattccttcatgaagaacactttacaatgttactgaatagcatgtagagctcctgatggagatggttatcatattggatgggcagatttcatatgtgtgtttttgagacagggtcttgctctgtcaccaggctggagtacagtggtatgatcacagtgttactggaaaagggatctccatctggaccccaagagagggtttttggatctcatgcaggaaggagtttgaggcgagctgcagagtgcagtgagaagagatcatttattgaaagccgctccactgcagagcagggcatcctcaacaagcaagcagaggaacagacctactttgtttttagtttttcttatatcgaggtcttatctatgtaaagaccaagctgtgcctacgtgtgggtgggctgacagcataacaatttattattctattgattaaaaggaaactattttacattttagtgtgcaagtacattaaagcatcactataattatcttgaaagcatatattattgtgggtgttgggacatctgaacttccttttctatgagtttgtccttgtaggcattaccaagctgcttccttagctgtaaacatcttaggtccgtggttgtgacctgtaaggaatgtgctctattagtctcaaggtggagttgaacataaaatgatgttatcctggctctcctagactcctgcttctctaatcacagctcactacagcctggacctcctggactccagctatcctcccacctcagcctcccaagtagctgggaccacagtggcatgccaccatgcctagctaattttaaaaaaatttttgcagagatggggtcttactgtgttgcctggtgtggtcttgaactgggctcatgtgatcctccagctttggggtcccaaagtgttaggattataggcatgagccattgcgcccagccagatttaacgttttaaacatgccaagcttcccaaaaacaattcagtgttttttaaaaaaacagacttcatgaatcttgaaaatttcattttaaatgtacatagtgattctggaaatgtattactagtttactttttaaaaaaaattacagacagggtctcactatgttacctaggctggtctctaactcctggccttcctaagagctgggatcacaggcatgagccaccatacccagcctttggcaatgtattggttatccattgctgcatgacaaatttccccagagcttagcaacttaaaacagtaagtatttttatcttagtttccgtaggtcagaaatttgggagctgcttagctggtggctttggtttgagatctctcaggagcttatagttgagatagcagtcaacacttcagtcatctcaaagcttgaggaaggctggagactgcttccacggcagctcactcacatgactggcgagtccatgataggggctggcaggaggctcagctccttaccacgtggatctccccataggacagcttcagtatcctcagtatgggggctggcttcccccagagtgagtgagtggagagagtgagctgaaagctgcaatgacttccatgacttaaccttggaagtcacactcctctctttctacagtatccgttttggatacactggtcatcctatttagtgtgagaggggacgacacaggggcatggataccaggaggtgaggatcattggatgccatcttggaggacagctctcacaggcagtcatttagtctatacgctttaagaaattatgtactgagaagcataatagtgaaattgtagaatgccagcgacaaaaacctcagaagcaatttgagtgggaagacagaaccttcaaagcagccacgggagctcgtcacagtagagcagtagcatgcctgtgctcaggggaagccatgctcagcctggaatagcaggcccagcaaaaatggattatacaaagggctaagtaaagtttttaaatgataaaaaagagaatttgcccccagcacactctcacctcagttctgaagaaatgatctcaaagcatcatgaaagtgatgaaaggtctgaaatggataaagcatgagaggaagtaggaagtgtctgagtaaactgaaactgacagtcactggatgtcactcatgcacagaaaagcaaggatacaatcaatatatgtacctgcaatggcataaatgtcaagatggtgcctgtgagtggaactaaagtgttctcagttcctctgagaagaggaggggggtgggccatggtggctcacacctgtaatcccagcactttgggaggcctaggtgggaggattgcttgagctcagcctggcaacatggcaaaaccccatctctataaaaaaatcacaaaaagttagccaggcatggtggcatgtacctgtagtgccagctacgtggaggctgaggcaggaggatcacttgtgtctgtgaggcggaaactgcagtgagctgagattgcaccaccacactccagcctgggcaacagagccagaccttgactcaaaaaaaaaaaaagatcgagttgcttgtcatctttggagttagatgagtttgcctgccctcacatattacagcagaagaacagaaggagatacgatggcagatagaatcgccggtacgtcatttaattcagtcaatgaaaacggactaagtgttccagttaaaagacagacattgtcagagtgggttgaaaacaaccaaattcagcggtagggttgtgaacgtgtgcagcggtaagcacaggaatattccaaccgcagggtgaagatggacaccaaacggccgtgcatcagttcacattgcatttttctgtcaaacagcaaacttacctcggatttgggaatgtggttgtgtggacgcctgttgcgtgcagccgtgagcgtgagtctcatagacctgttcctgagtgaaagaggcaaaaaggtgacaaaattattcatgccatgtggctttgttcagagttcaaaagcatgcagaagtaaacaagatattgccaatattcattaaagtataatttgaaaaaataaagatgttttaaaatgtttacttggaaaaggaaccatacaacaattttggaaaataagagcaaggcctggcttgtccgcaccagctccaacaactaaaactgtgtggccctgtggcagaaggtggcaaagacaccactgcctggacaagtaacccggaaaccaacctgtgcataaatgtggggatttaatttatgttgagcatggcatttcagagtagtgagaaacagacctttcaataagtggtattggggtgattggctgtatagttagaagacggtagagtgcgggtccgtctctcaaaaaaatgcacacacaaaaaacattaaacccaaaccatgtgagcactgagagagtatatgagagaatatttgggatctggaagtgataagtgcctttcgtaggccaaacacaaaatccttgaaggaaaagcctgacaaatctaactacagagtttttaaacatttctgtgcaatcaaagacacaaaaatgttaaacgacagcctggaagaaaatacttgtaatatttataacattcaaatgtttaccaaccagaatctatgaagagatgcttgaaagcaatgaggaaactatttttaaaactggatagaaaagtgggccaggcacagtggttcactgctgtaaatcccagcacttcaggaggccaaggcaggaggatcacttaaggccaggagttcaagaccagtctggacagcatagtgaaaccctatctctgcaaaaaataaaaattagcccgggtggcgtgccactgtaggctcccagctgctcgggaggcagaacaagaccctgtatctttaaaaaaaaggaggaaaaaaatgaattaagtctacgtacttgcagttcctaaaaaaaaaaaaaaggaactaaatgaaacagtgaaaaagttggcaaaaattataaaggtggatctatgtggagttggtgaggatgtaaggaaagagtaagtctgttttattggtttttcaaagagcccattgtgatcattattcaccatttttaaattttaatttagtcattaatctttcctaatttcatctttaagctttcagaccatttcttttgctgttctttttgtatcttttcaaataatttgcacggtcatggtttggggacctttttctaaagatgtatttaaagctccagcttctcgcagcacagctttgaccatacctcacgttttggtgtgtcctgatttcatcgttcgtttctcagccaccatgtctggctaatttcttaattttttttttttttttttgagacagtctcactctgtcacccaggctggagtgcagtggcgtgatcttggctcactgcagcctccacctcttgggttcaagcaattctcctgtctcagcctcctgagtagctgggattacaggtgcacaccaccatgcctggctaatcttttatattttagtaggcatggggtttcatcatgttgctcaggctggtctcgaactcctgagctcaggccattcacccaccttggcttcccaaagtgctgggattacaggcatgagccaccatgcccggccagtttcttaaatttttttagagatgggatctcactttgttgtctaggctagagtgcagcgtgtggcaccatgacggctcactgcagccttgaactcctagcctcaagtgatcctcccatctcagcctcccgaatagctgggactgtaggtacacgtcaccatgcccagctaattattttttgtagagatgaggtctccctatgttgcccaggctggtctcgaacttctctgctgaggtcaagccatcctgcctaggcctcccaaagtgttgggattacagacgagagccactgcactctgccattgtttctttctaaataaattggtatttcagtctttattttctttttcactcaggacttaattagaagggtgttttggaatgtccatatcaacaggagtgttttgttatccttttgctattaatttctaattgtgtcactttgtagttgcagaaccctgtgttatgggggtctgtctgcatgggggtccatctgtgttatgggggtctgtctgcatgggggtccatctgtgttatgggggtctgtctgcatgggggtctgtctgtgttatggggctctatctgcattggggtctattttgtttgtggccaattcatgtgcatgttgagcttgtttgggaagaacatggattctctatgagttaaagagttctgtgcatgttctcctgtgtctgttggattactcattacttaaatcttattttttttaaattttaaattacttttgttaaaacatatatatttagaacagcagtccccaaagccactctcagcccttgcagacgtcccaccgcatgctgaggtgagaagtgcacttttgccggtgcgctgcctccttttctttctttctttcttccttttttttttttttgaaacggagtctcactctatcaccaggctggagtgcagtggcgtgatcttggctcactgcaacctccgcctccggggttcaagtggttctcctgcctcagcctcccaagtagctgggactacaggcacccaccaccacacccagctaatttttgtgttttgtttgtttgttttttgtttttgagacagagtctcgctccatcacccagactggagtgcaatggcatgatcttggctcactgcaacctctgcctcctgggttcaagcaattctcctgccttagcttcccaagtagttgggattacaggtgcgtgccaccatgctgggctaatttttgtatttttagtagaaacagggtttcgccatgctgaccaggctggtctcaaactcctgacctctggtgatctgcccgcctcggcctcccaaaatgctgggattacaggcgtgagccaccgtgcccggccgcactgcctccttttcattcctctgtcttgcattctgtccatgccccaccgcagagacgaagggtgtagcgccccttccccatcctcccaccagcattctgtctactcagcagaaacccaattccactgttagctttacagtgaccatgtggcatcgtgaccgtgggatggccgtgttgcctttgtgctgttttccctggaggaaatcattgtgttcccccctcctccccctccccctcctcctgctcctcctcctcctcctccctcttctacgaactgattattctttcctaaaccttccaacaaatctaggactctcctctcacagacccctgtacattgggtcgtctggagctgtgttttctccttggcagtggccttcctggagccctggactgccagcaaccagcccagctggcagggccactgagtagccttccccactccctctcccctccccctacaatccgcctgcctcctgtctacaggaccccttgtttcctgggccccagcttgttctccttggtttatcctttgttttggtggagtacatctagcagcttcctccaaaagggttcagaggatgtgaaagtttttgagactctaaagatatgaaaatatctttattctgcctgtatgcttgaatgacaccttggttgggtgagatactaggtgggaaataattttctttcaggattttaaggctttgtccatcaccttctagcttgcagcgctgctgtgtggtggtgccctagactattaagacttcttcttcttctttttttttttttttttgagacagagtcttgcactgtcacccaggctggagtgcagtggtgcaatcctagctcactgtggccttgaactcctggggagttcaaggggatggagcgatcctccctcctcagcctcctgaagtgcttggattatagctactgtgcccagccaggattttcttacattttctgtttctttctcccttcctttctttctttcattcattctttctttcgttctttttctctctttctccttccttccttctttttctttctctctctcttttttttttttccagagtcttactctgtcacccaggctggagtgcagtggcaaaatcacagttcactgcagcctcagcctcctgggctcaagcaatctctgcctcagcctccccagtagcaaggactacaggcatgtgccactgaacttggctaattttttaatttttcttttgtagagatggggtctcacaggctggtttagaattcctggcctcaagcgatcctcctgccttgggctcccaaactgctgggattgcagatgtgaaccatggcgcctagcctccttaccttttttgtttgtttgtttgagacggagttttgctcttgttgcccaggctgaagtacaatggtgtgatctcggctcagtgcaacctccacctcccggattcaagcgattctcctgcctcagcctcttgagtagctgggattacaggcatgtgccaccacgcctggctaattttgtatttttagtagagatggggtttttccacgttggtcaggctagtctcgaactcctgacctcaggtgatctactcgcctcggcctcccaaaatgctgggattacaggcatgagccaccacacccggccagcctttttactttttaaggcttaataatattccattttctggatctgccacattttctttatccattgatccattgtggaaacctggattccttccacattttcgctattgtgaataatgaccactgctgtgttggagtgcgcacatctgtttgccttcctgccttcaactcttttgggtacataccccaaagcggaattgctggatcccatgcaattctgattttaatgttttgaggaatgagaattcacttcgggtttgcatgaatcccactcttagcatggcactgccttctctcccctctccccttccccctggtgagggaggtggaggatggtgaacctcaggctgagcagagtctggaggaaccgtctcctgcagcccacgtgggaagttccttcttgggggatagaggtcgtgctggggacctcacctgcttctggcctttccctgtggccctcccacagcttctccagctggtggtccctgccctccagtctcctgtaccctgccaggggccctcctccactggcgctggtcttttgtctatggattcatgatctttattttctcccgaactctctttatgatcatttcagaggggtctggggagaagggcagtctggagctggccttagtcctgcctttcctgaggcacgcatcagtgctcgagctccgggggttctcctgccggtcaagccgggggccggccgtgaggactaagcggtccacaggcagccctgctgtacatgaagcggggcaggtactgggttgggcggtgtcctggcacagatgactgtgcaaagccacagagggccacactgcctgaggccccgcgccgggagctggcgctggagcagcgggaggctgagcagacggcgctttagaaagcgcccgggggcgagctctgagggtcggcgggtgctgggtgggagcggcgaaggggagctggcgccgaggccctcgccgacccgctgccctgtcccccaggtgtgcgagccgccggaacgcaggcgcccgggccgccgctggagcgtcagcatcgacgagcgccggcggctggccacgctgggcggccgggagaggccgggcgccgccgggacccagctgcactgcagggtgcgcggggggcgggtcctccccgccccgtccccgccccgccccgcccctccgcctcgcctccctcgactcagtcccactgggccctttaccccggcgctcccgggccccgccgttgtccccttcccgcccctcgaggctccctgaccaccctcgcccgcaggacgtcgtgcagatggtagcccagctggtgtcggaggacgtggacaaggacgtgctccttccccacccgctgaggtccaccgagtccaccaacgccttccaggccttcctggcgcgcagtgcgcctttctggcataatgcgactttcgaggcctcgaggtcacccccttcctaagagccccattcagcccattgtctgtcttccagtgcctttccttgggggcccacggtgggggcagcctctgcgccttctttgtgccccaccagggggtcaccacccacccatgttaggaaaacaggccaggcaggacctggctccggacagcctgcagctgctgaggccttggagaccgggctaggggctatgggaggccatctaggggaggggaacactgccccgggtcagtctgagagggccctggcaaggcctgggtagcaggagcttgccctcggggccgctgggaggaggcctggggtacctgggcctgcctgaggtgcactggtgtcctgggaagccccagtggcaggcgctgcctggagactcagctccttggctggcctggtctggggaactgggtatctgcctgcaccaggctgtgagatgggccaggcagagttctccagggggcggggtctcacattgggtcctgcctctgaagacccagaagggcacacgggaccccaggggtgctgtggtggggagcagcaagcccagggacccaatgcagtgcccagcacagagggaggctgtctggaggcagagatgcctcctggcctctggacagcgatgctggtggtggacgagggccaagagggtatcctgcgcagggggtctgagcaactgtgaggagctggctgccgcaggggcctgtgggacatggtccactgggtgactgcctcgtttccaggctgcagggccctcggaagggtgctgagccggggtaacgtgtcccagctgcattttggggacactaagttgcagggggactggattgggaggcggggcaggagagctgtgagcatgggttcccagcccggggtgggtgggggtggggaaagggccctgaactctgtgactgactgttaggggcctgactgggcttctgtggaggtggctaggtggaggaggctttggggcaagcggaggtgatcactcctgggctccaggtgagggcaggagctggacctgtgcggtggcctggaccaccagatacactacatgctggctgtgctgcccacctggcctgtaaccctccccttcccgctgctgagaagccacctgactgcactgccagccacctgctgccctgacacaggatccctggcccgagttgaatcctctgcacctgcctgtctccccttcttactgtaagactcagtgaagttccctcctccttcaggaagccttccaagattacacagccaggtgctccccttctctcccaagtcctctgaatgtcatttggtgcaccctagggatcctctgcatttctcaggagccctagggtaggtggatggagggcagatcctccaggggctagggcaggtgtccttaagggtgtggggagttttgggcagggcactgtccttaagggtgtggggagttttgggtcatgacccaccccctctgaggcccctgatgatgatgtggggaatgggatcctatgggcccagctgcatgccaggcaggcatccccaggtgtaaacagggcagagcggagctgacaggtaagcagttgccatgggggtgatgagctgggcagtcctctgttgctgagtggctttaaagaaccactcgttgttctgtgacttgggggttggctgggctcatcctgccagctctcctgctctcgtttgagtgtctcctgaggctgcagtcagagcgtggtggtccaggatgctggtgatgctgggatggttgccctctctgctccatgaggtctccctacagagcacctcccccatggtggcagcagagacaaaaccctggcctccttcaggctgaggcccagagccagtctcctggtgggtaaggtggccacagggccagctggcagcagggtattggcactgagaggcacaggcctctccaacagaggtggtgccgggacaggggcagtgcctggagaccgcttaggttgtcacaactgggatttgtgtactagttttctgtagctgccataaaaattgccacaaattcagtaggtttggtttctttttcttttttctttttttggtggttggggcggagcggggggcaggcttgctatgttgcccaggctggtcttgaactattggactcaagtgatcccccgactttggcctcctgggtagctgggactgcaggtgcatcccaccacacccggcctttatttttttttttgtaagtttttatagagaaacagtcttggtatgttgctcaggctggtcttgaactccttgacccaagcaatcctcttgcctcggcctcctgagtagctggggttacatgagtgttccactggtgcctggctttgagtgttttaaaacaacacaaatgtattagctaagttttgtagaagttcaaaatgggtatctttgggctcagaatgaggggttggcagagttctgttccttctggaggtgccaggggagaccctgtttccctttttctagcctcaagaagccacctgcattccttggctggtagttgtggcctccttcggagcggccgagcccctctctgccctgcccttctctgcccacctctccattgcctccctcctgcaccctgaaacacacttgtggctacgctgggcccacccggaagatccagggtcgcctgcctgctttcgggtgaactggttagcccccttcctaacctgccacttaacccagttaacccagcctgctccaaggttctggggatttgtacacaagtatctgtgagaggggcattctgccttccacaggggctgccggcacctggtgggcagaggcggcggcgctgtgctgctcaggatcccgcaatgcatgggcagccccaaaccatgagggcccggcaggaaacccgggggcagaggagggtgcgtgcggcgggagcgcatgtgaagcccaccttgcaaggggaggggcgcgctcttcgcgggacggcagagggagggtctctgaggcgcgtggaatcaaggggacagaagaagcagtctcgggagtgggaaggatcctgggaggggagtgggaaggatcctgggaggggagtgggaaggatcctgggaggggagtgggaaggatcctgggaggggagtgggaaggatcctgggaggggagtggggatcccccgaagtctcgcagcagtagtgtggtgcttaggccgtcgccccggccgccactgcgcctccccacccgcaggcctccgcagcgccacgggcggccgcgcggggtagcgtttgggggctcccggggacgcggtctccggcgcgcaggtccgcccagggttggccgcgtggtcccccgggcttcccacgcccgattcgaattgtgactccggctggctccggaccgagccgaggacgctccggcaccacagcaggagccgcgcgggcgggggcgcggggcgcggaacggggcgcggggcgcctgggagatgtagttcgcggccttccccggcgcaccagacaatgcccgacgcggccccgctggagaaacgccttccttggctttgcagaaacaccgcttgctattaatacagcaacgaatacagctttaaaaacgcgcccagtgtcctccctggaataacagctgttaacattacctaaaggttatcccagatatttctaaatgtatatggggagataaaaggatgtaatggaaatacagaaatacgtgtcgagttgctacttatagacttttaaatatttaaagaaaaaaattgctaaaagcagatgaatgcttcttcacctcaagtttaaaagtctccttacgatggccgggcgccgtggctcaggcctgtaatcccggcactttgggaagccaaggcaggcagatcgcttgagctcaggagttggagaacagcctgggcaacaaagggaagctccatccatactgaagatacaaaaatcagccgggcgtggtggtgctctcctgtagtcccagctacttgggaggctgaggtgggaggatcgcttgagctcaggaagtcgaggctgcagtgagccgagataggcccactgcacttgagcctgggtgacagagtgagaccctgtctccaaaaaaaaaaaaaaaaaagtcttctacgattatttttagaaattacaaaaacatcaagagatgagtgtgtttggtttacagcagcaaagcacggttcggctgaggcggcaccggctgacttctgcctgtgaatggtgaggaactggcactgacatttccatatcccctggcagggcatttcttaccagaagatcaaggctcaccgccagtatttgacccactgaaagtctttgttttgatttacatctttactggctggacttaagatcagtttttgttgttgttgttagacagggtcttgctctgccacccacgccgcagtgcagaggtgctatctcggctcactgcgaactatgcctctcaggcctaagctatcctcctgcctcagcctctcaagtagcagggactacaggcatgcaccaccacgccccgctaatttttatatttttcagtagagatgggttttcactatgttgcccaggctggtctcaaactcctgggttcaagtgacctgcccaaagtgctggaacttcagagccagagccctggttttatacactttattatgttcccctccctgctagattgcaaaccctctgagggcaaaggtgctgtttccttaccctccaaggcctagagtggcctgtagcttgaagtagatgtttaacaaataatcaatgagtaaattattgtgttaatcactttgtcttgctctgaaattatctcaagcctttcatctccaagtaacttgatattctgccctttgctgtttatgacttgatccagccacggtgcgattttggtgcttccggtttgcttggctcttaactcttcctcccatcctgctgttttgtcgtcaagcatttgaattcctgattgttgaattcatgctgctatgaagctctgaaagaagtcctgtggagtcctcttctgtttctttggttgcgttttcttatttatttatttatttatttatttattttttatttttgtttctttgagacggagtctcactgtgccgcccccaggctggagtgcagtggtgtggtctcggctcctgggttcatgcaattctcctgcctcagcctccggagtagctgggactacaggcacgcgctaccacacccagttaatttttttgtatttttagtagagatgaggtttcactatgttgaccaggctggtctcgaactcctgacctcaggtgatcctcctgccttggcctcccaaagtgctgggattacaggcgtgagccaccacgctcagcccagttgtgttttcttccatactgggtttctcaccggcccctcacaccctcgatgacttgtttttctgttgttgaatgacatggatgtggtcacgtgccacctctcagcaatgctcccacctcagcctccggggatatgccactacttctgtagtgctttctgacgtgaaagctctttcctgaatgtctattcgctctgctactaagtggatggagtggatggattttttttttttttttttttttggagacggagtctcgctctgtcgcccaggctggagtgcagtggcatgatctcggctcactgcaagctccgcttcctgggttcacgccattcttctgcctcagcctccggagtagctgggactacaggcgcccgccaccacgcccagctaattttttctatttttagtagagacggggtttcaccgtgttagccaggatggtctcgacctcctgctcgtgatcctcccgcctcagcctcccaaagtgctgggattacaggcgtgagccaccgcacccagctggattcttcttaattctttgtttttattgtttgactcacctgaggtctttggactttgcctctgagctggcttaagggcaatccaccttgttcactggtctggagtggggaggcagagtatgggtcggctggaggagtggggctctgtgctctcttttgagagtttactaaacgtcactctgcatggtgaggggtgtgtcctctccgctggggaggcctggcttgaatttcagattgcctccctgggacaccagaccctgtgctgtgctccctcagaaggacagccttgactgtctccactccagcagtcagttctctccactcccactgggagaaggagcaaaggctggtgtcttcaggaggctcctctccaggctggggccagggaagagtgtgcatgtcactgtcaggatgtgtcccagtggtgtggctgggttctcagggtgaagctcgtccatttctgggatggcagcggaagcaggcactacacacgcagcttcagggggctctccccatgcttcctagctgcctggcactttctggtgtttctggctaactttctggccatgccaggagttggtggaaggagatctcaggctgcagctttgctttcctgctgaggagacagaggtaggctggggctgtaggacaggggaggccagcagccccaccttccttctggagagacgctgcctgtctgtcattgcccctctcctgcacctggccgctggctggctgctcttccctcccaatcaccagcaagccagctcctgttccctgcagcccagcccgcaggatgtgtcctgggacccatagccctctctccccagagacagcaccgccctgcagctcgggttcctggccctgtgctaaccctggtggggctttccttactggtctgctctgcagccatgacattgtggccaccgctctccttgggacccccacctggctttcctcccagcacatgctgtttcctacccacctggatggtgtcctgtgtgctggattccccatgctgtgtccccagcatcctgaccatgtctgtcccgcctgcctagatcttgcaccgtggccacggggctccctcctgatagccctgaacgctccgctccatgtcctacagagagggatgtcccaagtagatgtcagctccctccagcatctgagcaggcaggacagagacccacggtgctgctcacatcagcagcctggaaccccgagacagctccttttgctcacctcccccaacactgatgttgcacctgtctccaagccactctgggaccatctgtttctctccatctgggaagcccccttcgcacctcatgctcttcctggctggggcgtctgggtcactcactggactctcctctccttagacctgtgcacaagcacacacgggaaggcatcctgacaggtggtgggaagagaaggcagctgcctcactgcggaaagagcacggccgctcctggactccagccctgttggggctggcggggtcagcaggcgctgggttccagcctcaggtggggtctttggaggtggcctctgggcacaggcacctcctctgcggccttctcaccaggtcacggttcagggaggctttgccggctacggagcctgcccacaccaaggcgcgcacgaccacctgtccagagatgccacgcgggctgggcggcgaaggccaaggacacgccctgcctggtgtcgggggcaaaggttaggcctggaagggaggtgtggggtggggaccccgaggccagggctgggccgctgagcttcagggcccttggggggctcagggaggaatgccggaggaccccagcatcaggaggaacccctggagagctacggcaggactcacctgtggggcacagggagggatcaccagggaaatggcccttgtggaggatctcccctctacccccagggcaccaggggaggatctaccagggggttctggtggaagggcccacccgggaagcggcgcgcggggaggactcgggggcgccgagaggaactgtccgggaaggggcgcgcgggccgcgggcggcgcggggtcggtaacggcccgtgcggtgggcggcggcgcccgaggcccctccccgccgcccgcggccgctcctcctcttcctctcccgcccgcgccgcggccctcccgtccctgcgcggcctcggcggcctcggcggcggcggcggcggcggcggcggcagcagcgcggcccctttaaacgcctgcggcgccccccgcccccgccatcgcgcctccattttcccggccgcccgcgccgagcgccgcgcccgccccgggcccctccgccgccgccggcccggacatggccgccaacatgtacagggtcggaggtaaggccgcaccgcctttatgcccggccccgacccgcccgcagcccccacccgccgccgctgccgcctcccccgcccctctgccccgcaggccccgcgccccccgcccgccctcgcggcccccggctccttcccgaaccgccccccgccgtgctcaccccaacccaaaatggccccgcgggtcggccccatcgggggcgggcggggctcggcggcccgggggtggggggcggcccacctgttggggccgagggggcggccgcgggggtggcgggggggcgcggggcctgcgggacatccgggggtccggggccgggagcccccagcgggagcacgtggccttgggaggcgccggctgccggtctgggagcaggagttttggggctgtggggtctcccccggcccgcggccctgtgctgggactccggtgcatcccctctggggatggggagccccggtgaggggccacgttcctccctagagccctcctgcagcctggccccggggcttcccccagcagggatccctcagggggtcttcagcagggagcgagcatcccgagcacgcctctaagtccccccaaacttttccctgcctctcgctcacctcagcccattcgggaggcgctttgcaagggttggggagaggccggagggcctcctgggcaggggcttcctccgtgggcccagcctcctgttgctcgggccccccgggcctgcagctttgagccttgccctccttcgtgtgcctgggactccgtggggtctttcacaggaaggtggggggtcgtgtgcattccatcattccatcagcgcctccctccccaggactctgagacccctccctgcctgtgaccctctcgggcaggtgctcattacctttcccacctgcagcctgcgctgctggagggagctggggtcactcccgctctggcttgatccccatgcccctgaccccgagtgcccagaacactctgtgtctctcgagcgtggcttctgctgccttggacgccgtgtggtctggccggccagtcctgtgaccttggggacggtgggagccccctacatcccgtctgtgagatgggcggtcagtccgcatcagcagctctgggcctcccctgtcctctcagaggggcggtgggcctgtaccccatccagcggcagcccctcccacagcctcatacagctttgccaggtccctgtgtggacccaggtgcgctgagcccaccccacgctcagggagcagcctgggtgcggggtccctcgagggaggggcctgttccttcctgttctttctccccacctggagaccccccttccagcctgacatgagggcccagtttctcaccctggcagagaggatgcctgctgcctgggctccagccgggcccactgcgcatggttttgggattggtcccaagaagagctctccctgcccccacccatgttgggggtggggagtggtggcagctttgggctctagggctggggacaccccgaccccaactcatgccttcctagtggctgcattgctcggccttcaggcctgcctgcctgtgatcttggcgccagcctggctgccccccctccaaccttcccatgcctcggtttccccatggtgtgggtgaggacctcgtctctcagccgtccttttgtgccctgtggcagctgtgctgtggctgatgaaagccaggaccctgccttgtcccatcccggaggtgcagctcccctgggccccacacaggcttgggaggagcccttcgtggggctgcgccgccctccccgaaccctctgtccccctgtgcccgcaggcccgtcccagggcctcactgacccacgcactccagtgctgtgagggtgggtggcctggactcctaggctgtggcggaggggccccaccatgcctggcagagatgctgctggtctcttttcctgtgatgaggagcatgggaggttgggtgctgtctgctggcagcacagccacgcgtgggatccagactgcttctgcgtgtgcagtccgtggtcactgtggccgggtgtgctcggagctgtcaggccccccacgtgcccgccccgaggacttcctctccctgcaggtgagactgtaggcctccccctctctactctgactgtccctataggagaagcggcatttatccctggcttctggaccggaaccctgggttccggcaggaccccggcagagccctgtggtcgcagtgggctgggcattgcaggttggcttcctgtcttggtgctcgctcggggaggtgggcgtctggattcttgagcccccagacaagaaagaggaaggtgtgcagtgtctcctgagcagcctttgtccgtctgtcgccggctgcctggcacgggctccatctgggtggccagtcctggcctgtgggagatgccggcagggacccagcctgggaaggggcttgctcctgtgcccccccaccccagggaccttgtgtgtagaggcaccaaatttagttaagaaaagtacaggacgcccaggcaaatttgagtttcagataaacagaaatttattagtgtaagtatgtcccaaatatggcatgggacatacttgtcccagaagattcttatctgacattcacagttatctgggcaacccgtattttagctggcaggctactccgaggccctgccaggttgggctaggcagggtgaaggtgtggtggcagtatttttgtgccagctgagctgggtgaagtggtgagcagggagggaacagggcctgtttcttccccatggagtgccctggccacggacagaggccttctgtctgtgcctgtgagggcagcggatggcctgggcaagggtggcggggtcagggttccctgacctctgcttctcaagggttgtccatcccgagggctggggaaggcttgaaacctgctgtgggatgagagggccccagggcaacggcgggatgtttcttctctgggttgaacatgaagatgttagatagcatccaaaacaggacagcaggaatcggtgcctgccagccgcctgcagcttgctcatgtggggcttctgcttttcagtggacaggccattaccattttgccttgggtgtttctgtttttcattgcaagaggttaacaccccatcttttggattttttttgtttaattttttttttttttttttttttgagatggagtcttgctctgtggcccaagctggagtgcagaggcgcgatttcggctcactgcaacctccgcctccccggcccaagcgatttcctgcctcagcctcccaagtagctgggactagccaggcgccaccaggcctggttaagttttacatttttagtagagacggcgtttctccatgttggtcaggctggtctggaactcctgacctcaagtgatccacccgcttcggcctccgaaagtgctgggattacaggcgtgagctcatgcccggcctttttgttttaattttaataaaagttgaggctgggtgacagagtgagactccgtatcaaaaaaaaaaaattttaatgtagtttgaaaggatgccagaaagcccctgcccctgcagggccgcgggctctgccccggtctctggcgcagcctgggcggaagcaccctgtccgtgctgctggtcttcactgggcttggcatgtgccatcatctgcgctctggcgcgctgttagaaatgttgcttttgtatttttattctagtgtttttttgaagtttaaactttattgctctatatacttgccagtggggaaaaaagtaaacttaaaaaaaatgtcagatttgtagagggctgcagccagcgccgccctaccctggagtgctgagtgcaccgtgtccctaggcacttgctgctccatgggccgacttttggggtcccacccatcttttccaagaaggcagggaagagccctggagacacggccgtcctgtgagcaccaggagcgggagtggtagaagtggcaggggcccaggtgtgatgtcctggaggggatggcatggggctgtcccacttggcctgtgaggatcggcctcagcactgcgccattggcagccctggctcactctccaggcaggatgggccactgagcttctcctgcctcagccactgagcactcctggcttgctccacctttgtttttttgagacggagtctcgctctgtcccccaggctggagtgcagtagcgcaatctgggctcactgcaagtccgcctcccgggttcacaccattctcctgcctcagcctcccaagtagctgggactacaggcgcccgccaccatgcctggctaatgttttgtaatttttttttttttgtagagacggggtttcactgtgttagccagtatggtctcgatctcctgaccttgtgacccacccgcctcagcctctcaaagtattgggattacaggcgtgagccactgcgtctggcttttttttttgtttttgagacagtctcactctgtcacccaggctggagtgcagtggcacaatcgcggctcactgcaacctccgcctcctgggttctagtgatttgcctgcctcagccccctgagtagctgggattacaggtgtgcaccaccacacctggctagtttttgtgtttttagtagagacagggtttcaccatctaggccaggctggtctcgaactcctgacctcaagtgatccacccgcctcggcctcccaaagtgctgggattacaggcgtgagccacggtgcctggccccatattgttctgagtggagaatttgatcgttaagctctcagaataataaaaaagtagctgtcagtgagagatgttggaatatatggtccaatgaagcacatccctcgcgcccgacccgccctggcagtgccgttcccgcccgtgtgtgtgggttctgggtgtcaaaactgctgcagtggccctgcaggcatcctacctagaggtgggtccccagctgcgcatctggacgctggtcagcaggtgaggctgggatgccagaggaggtgccgtgtgcctggccaggtacccgggaggcggcttgggggagcactggctgcagggcctccttcctcctcctgctgaacttggagtgctcttgccagattatgggctgagtcctgctagggagggtggccccccttccccaggaggagcccaccctgagacctggttggggggcagcttagaccctaccttagactccagcaggctgtcttgggagcatgtaattatgttttttttgagacagggtctcctgttgcccaggctggagtgcagtggcaccatcacagctactgcagcctccaccccacaggctcaggcgatcctcccatctcagcttcctgagtagctgagaccacaggtgcacaccaccatacccagctaattttaagattttttatagaggcggagtctcactatgttgcccaggctggtctcgaactcccgtcctcaagcgatcctcttgccttgggctcccaaagtgccgctgggtttgcaaggctgtgaactaccatgcccggcagagcatttaatattctccaaatgtctttcctcgtgtgctacctgggctcactgctttctggggctctcgtgttgctggtgtctccacccccacccccaccccagctggcctgctccattcctgtcccggtgggctcatgtctgagtgtgcggactgggggatcttggtggcgatggagccaagcccagggaggctggggccaccctcatagtgcaaggccacccagcacctcgcccctataccccacccgccccaccaatgtgcccccggcacccccgagcccaggccccaaggcttgcttctatgggctttgcaccaccctctaggctgctcccgcctgggccatgcagcgcacctgaggggtctgaggtgaccgctcctcagagccgcccggcagcctccctggggcgggcctcagcactgcagccccgtgatccggcctggcgtgggctttgctgctttctctgcccggtggcctgaggagctcgagtgcccgcctgcccccagagccctttcacggtcagggcctgagctctgtgggtgccattaggaggagggtctgcagatctgtgcggttgggggacccctggggcatggaggggaccacgcgtcccttcccgtccgtgccctgccaggctgtcctcacagcagcgtcgtcacaggggaggaaaccagggcagcggcagcggctcctggtaccaagcataccttaaaaatgagcccatggatgttgcagtgagccgagatcacgccactgcactccagcctgggtgacagagcgagacttcgtctcacaaaaaaaaaaaaaaaaaaaaagagcctcaaggcctgtgcagttggtcagcggtggagtcaggtatggggcacacctgattctgccctggctcatcccctgccttcagaggacagcaagggcgcagcgcacgtgggggctggccctgaggtgtggcgttctctgggctgggctagggcagttctgagggaggggcgtgttctgtcccattcctccaggagacacagtgcctgggccatctggccacttgcatgagggaacgtctgtctgcatcccctgggggccgctgtccccatcccttgactgccggatgcacctcggatgctggggctctggtctccgatccttcttggactttgtggggacagcaacggaggaggatgaccccaaggatgggccgggcgcgaggcttgcagcagtgcccaggttttgcagataaaaatacaggacacccctgcagcatttgggacgttgtcacatggagacccggctcctggagcaggggtgctgggggctttcctgaccactgttgctgtttctcttgactctgttcccaaaagggaaaagacaaagttcctctctgtgctccctggtctcctgtctctgaccatggcagacctggctgtgggtgagctcaggagagtgggctgtgccctggagggtcccggacaggcagggaccacgggcaccgccctgccgcacagctcttgttgctcaatgatcttgggggttgtgtctgttctcccccaattcttctgtggccccatcccctatttgttaaaacttacgtgtaaccccaaaattcacacttatgtcactttcccagtcatttgcgggcacgcacaggctgctaaaagcccaagttgcgtggtgcttgggtgcctgctggggtgagcgaggcaccctgccctctgccactgctcccatgttggaagcaaattgtcctttctccatctactgagggccatgcttcttgcatttgggggctcttggtgattttgctttttagatgcccctgggggaggtgccgcagtgctgttgagtgtccctggacacaggcaggctgggatgggtcccatggagagaacgtgtgttggacaggctctgccccacgtgagttcagtgtcggagaacaataataattataaagttctttgacagaaacgtaaaataaggctgttgcgtattgattggttgctgaaaatgttgtgaccagaggctcgtaggaacctgaccctgtatttcctgtaggaacagaggtacggtgttcagtattagtggtgactttatggaacgtaattactgcaaacaatgagaattgactctgggtgcgtgtatatttttttaacttaaagtaaggtttaggccgggcatggtggctcacacctgtaatcccaacactttgggaggctgaggtgggcagatcacttgagctcaggagtttgagaccaacctgaccacacagcaaaaccccatctctactaaaaatacaaaaaaagccaggcgtggtggtgcgtgcctgtaatcctagctacttgggaggccgaggcatgagaatcacttgcgtgcaggacgcagaggttgcagtgagtggagatcgcaccactgtaccccagcctgggcaacagagtgagactctctcaaaaaaaaaaaaaaaaaaagttaggtttattgagatacacgtttcacatggcaaacccacttatgtgtaggggcctgtggttttccactcatgcacagctgtgtggtcgctgcagctcttccacacctgacatgcttctcttgtgaccttctgtagtcagccccctcttctcccccagctcccagcaacactgacctattttctgttcctgccgttttgccttgtccagaatgtggtagaagtggaattgcacagcatgtgggcttttgagtctggcgtctttctttttttttgagataaggtctcagtctgtcacccaggttggagtgcagtggtacagccatgactcactgcagcctccacctcccaggctcaagtgatccttccacctcagcctcctgaacagccgggaccacaggtgtgcaccaccacacccagctaagtttttcgttatgttgtctaggctggtctcgaactcctgggctcaagcgatcctcccacttcggactcccatagtgctgaggtaacaggagtgagccaccatgcccagccttatagtaattcttgaaatcaagtagtaggaatccttgaactttgttcctcattttcaaaattgtttagcctgttctggttacttggctttcccttacagagtttagaattggcttgttaatttctacagaaaccaaaaagaagtgtttcttttttttttttctttttttgagacaacatcttgctctgttgcccaggctggagtgcagtggtatgatcttggctcactgtatgtagcctcagtctcttgggctcaagtgatcctccccacttcagcctcccgagtagctaggactacaggcatacgccaccatgcctggctagttttatttatttttgtagagatggggtctcactatgttgcccacactagtctcaaacccctggcctcaagtgatcctcctgccttgactcccaaaatgctgggattacaggcatgagccattgtgcccagcctcaccttgcacttttatgtggtagaaatggcttctttccttgaacttcatgggccaacttctgctagcttcagatttttcttctgcagcctcctcacctccctcagccttcgtagaactgaagggagttagggcctcgctcaggctggggctctggcttcggggaatgtgtccgctttgatttcccatcccggcacttcagctttctctctatcagtactaaggccgttcagctgtcttatcaggcttgtgttcactggagcagcactttttgttttttggagatgaagtcttgctctgtcgcccaggctggagtgcggtggcacgatctcggctcgctgcaacctccgcctcccgggttcaagcgattctcctgcctcagcctcccaagtggctgggactacaggcacccaccaccacacccggctaatttttttttttttttttgagacagagtctccctctgtcacccaggctggagtgcagtggcacgatctcggctcactgcaagctccgcctcccaggttcacgccattctcttgcctcagcctcccgagtagctgggactacaggtgcccgccactatgcccggctaattttttgtatttttttagtagagacggggtttcaccatgttagccaggatggcctcaatctcctgaccttgtgatccacctgcctcagcctcccgaagtgctgggattacagacgtgagccactgcgcccggcctttttttttttttttttttttggtgaccaagtctcgctctgtcattcaggctggagtgcagtggtgcgatcttggctcactgccacctccagctctcgggttcaagtgattctcccacctcagcctcccgagtagctgggattacaggcacacaccaccatgcctggctaatttttttatttttagtagagatggggtttcaccatgttggccaggctggtctcaaactcctgacctcaagtgatccacctgctttggcctcccaaagtgctgggaatacaggtgtgagccactgcgcccgacccacttttagtttctttcaggaacttttcctctgcattcacaactgggctacctgcttggcgctgaagaccaggctttccgttagggtatcttggctttcgacaggccttcctaactaagcttagtcatttatttccagcttttgttttaaagtgagagatgtgtgaccctcaactcttcccttcactggactacttagaggccatggcagggttgctagttggcccaatttcagtattgttgtgtctcagggaatagagaggccccaggagagggagagaaatggaggaatggccagttcctggggcagtcggaacacacacatttatcaattaagttcttagttggggtatggctcatgatgcccaaaacaattacaatagtagcatcgaggagcaatgaccacagatcgccatcacagatagaatcatggttaaaaagttggaaatgttgagagaattaccaaaacgtgacagcaacacgtagtgagcacctgctgttggaaaaatggcaccgatggacttgacttgatgcacgttgccacaaaccttcaatttgtaagaaacacaatacctgcaaagcatcatcaagctaagcatgatgcccgtgtagatgtttgggaaataattggcatctaaaccaatcttgggtcctctcgtacagggattggcaaactggcccgctgcctgtttttgatgactcacgagctaagaatgggttttacattttttaattgttgagaaaaaaatcaaaggcagaaaacttcatgacacatgaagattatatgaaattcacatttcagtgctcagaaataaagtgttatgggaacacggccgcactaatgggagggattccagttattatgtggctgctttgagctaccgtggtggggttgaatatttgtgatagggacaggaaaaacttaactttttcccagtctcacacgttcaacacagaacacttcacctctggtccctggaatgtgtgtggggtttctccctaccagcagccagtcggttatccagtgatttaacccaattttgacactgcttacctggagagaatattaggttctgcagctgaagggctgagtcccacaagactgtcctcacttctcctgcctcagcctcccgagtagctgggattacaggcgcccaccaccacgcacagttaatttttgtatttttagtagagaccaggtttcaccatattggccaggctggtctcaaactcctgacctcaggtgatccacccaccttggcctcccaaactgctgggatttacaggcatgagccactgtgcccagcctacaagctggttattaacaagaccaataaactgaaatctatagccagactgacaaagaaatagaagccacaagtaaccaacatcaggaacaacagatgggacatcactacagatcctactgacacgagaaatgtgtggcacagaaaagggcttggttggacaaatttacaagggttgttaaacatacaaagtgccaaaagcctatagttattcattctattacttgttggcaggtaaatattttgtggaaagtatttgtttatttttatttttactttttgaggtggagtctcgccctgttgcccaggcagcagtgcagtggcgcagtctcggctcactacaacctctgcctcccgggcccgagtgattctcctgcttcagcctcccaagtagctgggactaaaggcatgcaccaccacacctggctattttttgtatctttagtagagatggggtttcaccatgttgggcaggctggtctcaaactcctgacctcaggtgatccgcccacctcagcctcccaaagtgctgggattacaggcgtgaggcactacacccggcctgtggaaagtatttgagtctgtcatgccttattgaaccagtagtgtcaacagtgaacttcatttgaccttgtggacttgatgtcatcagttctgtgaattaaaaaaaaaccttttttaaagagatagagtcttgctttattgcccaggctagagagcagtggcacagtcctggcccactgcagcctcaatttcctgggctcaggtgtgagcccctgtgcctggcctaaagctgaacatcttgacttgctgtcctgtgcagcagcttgatgagttggcagtggtgaagttctattgcttttttatttttattttttatttatttatttatttttgagacggagtcttgctctgtcacccaggctggagtgcagtggcgtgatctcggctcaccgcaacctctgcctcctgggttcaagcaattatcctgcctcagcctcccaagtagctgggattacaggcacatgccaccatgcccggctaatttttgtatttttagtggagatgaggtttcaccatgttggccaggctggtctcaaactcctgacctcatgatccacctgcctcggcctcccaaagtgctgggattacaggcgtgagccaccgtgtctggcctgctttttgaaaaagcgccgaaattggaaaatttcagaatgagaagaaccactgttgactgccatcatcaatacaccagatgacttgggaaactagtttttgctgcatgatgttctctacgttctttatgaattcatcttaaagttacgaggcacaaccacatttatttgcaaaatttatactgtgatgaagtcactttggcaacagctcatgtttaaatcacaaactgctttgtacagttttcttattgtcaagaggtaaaatgagaggcaaagtctgcattgccacacagatttgcagtgagctgcttttctgggctcacactgtggttacagcagagtgtctgcgacttccatgcgagtgcaagggaaacgtcgacatttcaaaatccactcagctgtgtgttagggagctcccgcctgagcttcagtcgaaagcgattggactgtagcgtaaccccgtgctgtaatataggggccccaagaccaccctcgggttcagtaattcactaggactcatggaatacagcagagcatttctgccaggggtacggttgattacagcaaaaggacgcagactcaaatcagcaaagggaagcggcacaggggccgggctcaggagagaccaggggtgggcttccggcgtctctcccagcagagacgtgggcggtgtgtaggtctagcagtggtctgtgatgacaggcctggcgtatttccaagcagggacgctcccgtgagccttggtggtccaggtgtttttagaggttggtcaggtgggcctggctgagcaccggtgtggctgccctcggtccctccgtctcagcccctccagaggtcaggctgatgccacaaggcaccgcggtacgtcactgtcagggtagcctctctgaggtggcctgaggccctgggtgagcagacgctgttggcaggcaggatgctccaagagctccgaggtgacctcctaggagcaggtcaagggtcagacctctctggaaggaagaatgcgggcaatccaagcctgctgagctggccctttccaggaaagggagtagcgaggctgctcacttagagccacgcacctggggctgacagtgtgcctggcagtacctgtgtggaaagacagttacagaggaaacacatgaactcactataagccagcactaatggatgcacctttgttgttgattttggtgataaagaacattaaatttgaacccagtgaagcaatatgtcatctcccaaaacaagtcctctcatgagtgcatctgtattatagaaagctgcactcagctttttaaaaaaatttttttagatggggtcttgctctgtcaccaggctggagtgcagtggcacaatctcggctcactgcaagctccgcctcccaggttcaagcgattcccctgcctcagcctcccacgtagctgggactacaggtgcgtgccaccacacctggctaattttttgtatttcagtagagacaggctttcaccatgttggccaggatggtctcgatctcctgaagtgatctgcccgcctcctgaagtgctggcattacaggtgtgagccactgcgcctggcccagttattttgatttcatcagtatgaaatgtgtagaaattgttacattagtccctatgtaatatccttggtgtggcctcttggcctgcacagcctggagtattgactatctggacctttataggaagctcaccaacatgtattttaacccttgacaccttatctgttaccatttatttagatctttgctgatttttctcaccagtgttttgtacttttcagcatgtagatctttgcacagatcttttgatctttaaacatctatagatcttttgtaaaatttatattgtaagtatttaatttttcttggtgctcttgtgaatagtacttttacaattttgatttccatttgttagtagtacgtagaaagaggactttttttttttttttttttttgagacagagtttcactcttgttacccaggctggagtgcagtgaatggcgtgatctcagctcaccgcaacctccgcctcccgggttcaagcgattgtcctgcctcagcctcctgagtagctgggattacgggcatacaccaccacacccagctattttttttgtatttttagtggagatggggtagctccatattggtcaggctggtcttgaactcccaacctcaggtgatccgcccgcctcagcctcccaaagtgctgggattacaggcgtgagccaccatgcccagcccaaaagaggacttatttttatatattgacctgtgaccttgcaaaactcttactcagcagtttcaatagctttttttgtagactctggggatttctatatagaaagtcacatcatctgcgtatagaaagttttatttcttcatatccagtctgtgtgcctttcattgatttttcttcccattgtactggctgggacttcctcgatggtcagcagtagtggtgagagtagctatacccttggcacatccctgatctcagcagaagcagcccttttctcaccactgaggatgatgctagctgtaggttttttgtaaatgtattaccaggctgaggaagtaccctttagttccttgtttgctcagagtttaatagcgtatgtgttggattttttcagattatattcttgcatctacggagatggtcatagggcttttcttacttattctgtgaatatgatgagctacactggtttttgaatgtttttaaaaatttaagttatatttagagatggcatctcactctgtcacccaggcttgagtgcagtggtaccatcatggctcactgcagccccaaactcctgggcttaagcgatccttctgccttagcccccaagcagctgggactacaggcacatgctaccacacctgcataattaaaaataatttttttttagagatggggtcctgtgatgttgcctaagctggtctcaaactcctggactgaagcaatcctcctgatttcttgtgtgtctttggttttggtatcagggcaatggcgttctcactgtcagctggggagtgttccctccttttctgttttctggaagagttgtgtagaattggtgttaatttttccttaaatgtttgatagacttcaccaatgaagccatctgggcgcagagttcttgttgttgtatttccgtagtatggatagggttacctgtttcttcttgaatgagctttggtgtttatatctttcaagcaattggttcatttcatttaagttgtcaagttctgtggcataaagtcctccataatactccttacaccccttctcgtgtcagtaggatccgtagtgatgtcccatctgtcgttcctgatgttggttacttgtggcttctctctttgtttctttgtcagtctggctatagatttcagtttattgatcttgttaataaccagcttgtaggctgggcatggtggctcatgcctgtaatctcagcactttgggagactgaggcaggtggatcacctgaggtcaggagtttgagaccagcctggccaacatggtgaaaccccgtctctactaaaaatacaaaaattaactgggcgtggtggtaggctcctgtaatcccagctactcgggaggttgaggcagaagaatcacttgaacccgggaggcggaggttgcagtgagctgagatcgctccattgcactccatccagcctgggcaacaagagcgaaacttcatctcaaacaagcaaacactcagcttttggttcctctgatattttcccctctactatttttgtttcatgttatttttactctatcatttcctgccttcttgctttatttgtccgtttattaaggcataatttacattcagtacaattccttttacgtgtacagttccgtgaattttggaagtccatagtcatgttgttgtaccacagtcatgatacagaatagttcccaaattcccaaattctcacgtcttccacatcttggttttcctgcgccagcagcttgtaggtggccccactgcacgcagccgtcgtgcctgccacctcccccgagagggccttccggtgctgcagaccccgagctgccagggggcttcactcctggcccctgccgaggagtcttccatcaagtggatggaccccagcttgtttgtctttcctcacttaagggacatttttcccccattttttggcaagtttgatgcattgttttgaatttaatttatttggtttcttggagtaaaaagttagaccgttgatttgagaccttttttaaaaaaaagtttgagatatctacatgtgatgaaacccaccaattttgagtgtgtgattcagtgaattctagcgttttcacagcgttgcacaagcgtggacacatcctgcattcagaacactcctgtagccgtgacacagacccacaggccccctgtcacttctgcaggcttttctgcagggaacgctcactgctgtgcgtgtcccccgggcaccgtggctgtgtcccctctgggctctccatgctcctagcccgttgtcctgtggagctctatgtgggcgtagcctcatctgatcagctggtttgctcaggcagcacggggggctcaggagctgcatgcacaggtgtgactttgcacatgggtgcccaaacaggtgcgtcctcccaggtgtgcacccacagatgtgtcctcacgggcgtgtgcctgcaggtgtgtcctcacgggtgtgtcctcatgggcatgtgcctgcaggtgcgtcctcatgggcgtgtgcctgcaggtgcgtcctcatgggagtgtcctcatgggtgtgtggctgcaggtgcgtcctcaggggtgtgtcctcatgggagtgtcctcatgggcgtgtgactgcaggtgcatcctcaggggtgtgtcctcacgggcatgagcctgcaggtgcgtcctcatgggtgtgtcctcacgggcacgagcctgcaggtgcgtcctcactggcgtgtcctcaggggcatgagcctgcaggtgtgtgccagcagcaggagggagatgctctccaggcccctccacagggtcctcgcggcacgggtttggcctccgtgtggacagatgggctgggcttctttggtgctggtcttgctgtattttgctgaatcccaggcctgtgcgggcctctgggctgattccagctgagacaggcctcctgctcagtcccccctgcggagctgatgcagggtgggctggcgagggtgctcgtggtgctggttcgtgaggacatggcctcagtgcctcccaagctgagcccctgcggtggccccaggaggcctggagcatcggggtgtcagcaccaccagcctggacttccctgggccttccagggtaagcctctgggctccggaaggttccgtggctctctgtctgtggagctggtgagaaggctggagggccagatggtttcatcgctgagggaagcgctgtactcacctgatggccgatcttggggcactcccagtgcctgctgcctgttgctgtccctgagctctggtgagctctggtattcctgtcattcctggagcaactctgtcctgtttttgagcctgcctgggcccaggaagccccaactgtgttctctgtgtagtcactgctgttggttttggagggaaagatgggggccgctgtgggcagggctggtggctggtggtggccacgtggctctgggggtgtagcatccaggctggctgctgccagtgggaaggtgtcctggggctcccggcagggtctgggcagtgctggagctgggctttgcctgggaagctgccgcctggcccccacagcttccccaagaagggcctgagcccttgggggcagctggcgtctgtgaggatccgggatgggggctgtctgctcctgctgggaacggcccctccagatgcatctccctgtccctgacccagcctgtcagtccattttggttgcagccacccctccctgatggtgtgggggcttcgcttcctctgtttattcctcgcctgagggagcagaggtgaggggatgacactgccccgcctgagccccgagtccctgggccacgggaggtgggactgggtctggcctttggtgccacaggtggcactctctctgttgctgtttgcagactacgtctactttgagaactcctccagcaacccatacctgatccggagaatcgaggagctcaacaaggtactggggggccctggtgttgctgcaggggggtagtgggtgggggctacgccagctcctgccctgtgggtggccagtgtgggtggccccctttcggggctgatcttggactggccactgcacaggcccttcagtgactccgtccactgtcacctgcaccgtggctcctccttggagatactgagtgaggggcctggtggcctcatgcaggacccagcgcagctgccctgagctgcctgcccactctacacttggtctgtgggtgctgggtcccctgaagatgccagtgtcccctggggagcccgagcggaatggtgtgattctgaaaccaaccaaaggctgcagaaagccatactcggtgcccctgccctgcccgaaccctggcagccagccctgcagggctgtgagctctgcccccacccctgaggtgtctgcatggctggaagcaccctccctggtcactcaggcagccctgcagggctgtgagctctgcccccaaccctgaggtgtctgcgtggctggaagcgccctccctggtcactcaggcagcccttgctcccacctggtttgtgtctgccatgagtccttggcagttgcttgctgtttggtcgggggacgtggttgtgcccatgcattgagcctggcagcaccagatccttcctggggggtggtgacacatgggcccctcagccccagccactcctggcctccactgcctcggcacagcctccgtcccatcagctcgggagacagagccgtagatggccatggaggtgtagggcgcccgcacaccctgggagccttctcgctgtcctcaggggtggtgggtgggtcccccagcgtcccttctcctcctcctggttggagactttctaagggtgttgagggagggcaggttgtccccaccagtggacacatggttccagcagagagtggggtggggtgctgggtgcttcacagacctctctgtgcctgcctgcagggctcctgagcccccgatcccctggagccagtggcccgatggctgccttctcctaggagccctgcccactcggcaggcctggggcactcgggcccttggtgttccatctggatgctgcaggctcacctgggagaagctgccttcctggacctcaggcttggtggcagcggtgacgtggggttcttgggatcagagggggcagcggggggaaggttagcgcgccacctctgacgtagccatgctgggctccgggcttccctggctgcgcttgtcgagggccattccctgcggtatctgccaccacctggggccgaggagcatggggtgcgacatctgctcccccgcagcttcctgggaggtctgagggccaggcctgtttgttggaggcacaggcaatgacctgggtgtcttctgagtctgcctcactgcccctgctgggcagggcctgcccgcctgcagagcaaggccacttgggtactgccggaatggggcgccactcctgtggctgagcctcctgagtgcggggcagcactttacgcatcccagcatgtggactgtagggaaacaggtgcagagggaggttcctcagctgacgctgaaccatggctgggggaggtcctgtgtccctcctggtctgtgtagtggaggggcggccggcagatggcactgctggccccacacagccagctggcaggcaacccggggcgggaggctgcagtgcctccgtgggcgcctggccgagtgccactgctgggaggtgccactgtcaggaaggttccctcgtgctgcttccggcttccatgtgcagacagtagattgcaggcgtgtgcaggcagggggctggcttccagcccttgggcgatgttcagttacacatgtagcattgcacacgctcagaggcgtccccttcgtcctaggactccctcctcctcagggccagggccacatggcgtgggcacttgcctgtctctgggcgggacaccagcctgtgaggggcacgactactctcttggactgttcaggcagggcagccgagccagacgctcaccatgtggaaaagaacccgcaggcctgcgacagagtgcggccagtgccctccacgccaaggagctccaggcggggcttccaggtgggcgcagctggttgagtacagacctcccctctgttccctggactgaacgccccctcaaataacaagaaagtggtgctggggctctgcacccacagggcaaggaaggtgggagaggcggtgccactgggaggtatgggcacagcttggaaggcagccaggcagactgggcaacctgagaggccctggccctggcctgggtcaggatggggagaacaggaaccatggtgacatgtggctggcagcgcggaaggcctgtctggggggtcaggtggtcccacagagcccttccctgggctggagcagtggactcagaggacccagatttggggcaccagacccaggccagcacagttcgtgcgggggctggaagtggggatcgcctggctcatggcctgtcccctggtgggcccccccgcccctcttgcctccttggctcccaggaccctagcggccagacttctaaagcccacagacccagctgctggcatcggggacccagcagaatgcccgctaccccagcacccatgggtgcagcccatgcagcgagctgcccagcaccggggaggctcccagggatgaaaagccgcaaggcgtatggggcggggcgggggggcttttaacaggaaggtcagccagcacatgtaaaaattgaactcagaggctggacgcaggggctcacgcctggaatcccagcactttgagaggccgaggcgggcggatcacaagatcaggagatcgagaccatcctggctaatacggtgaaactccgtctctactaaaaatacaaaaaattagccgggcgtggtggcgggcgcctgtgatcccagctactcgggaggctgaggcaggagaatggcgtgaacccgggaggtggagcttgcagtgagccgagatcccgccactacactccagcctgggcgacagagcgagactctgtctcaaaaaaataaaaaagtaaaaaaggaactcagaggaagggccagtgcagggaacagaaggaaactaaagcaaaacaaagcccgtgaatgttctctgagaaatggatgggatccatcctgggatgtggtcagatgagaggaaagctcttgacacttgggttaggagaagtagcaaatgaaatgaaaggatcaggtgataaagttgaggataccgcacagaagatggggcaaaaacacaaagaaactaggagagaaaaaaatcagacatcagtccattggtccaacgtccagttaatagcagagaaggagcgagcaaagcaataaagaggggccccttcaaggtgtatttaaaattttagaacacgggagaagaaatgtgtttagagaaaaagtgggtcacacacgaagcaccggagtcaaaacccactttgcctttcggcagccgcgttcaggtgtggaggctccacgcccagccaagctccatctcccggaaggcagatgagtgaggtttcctgactgaggccttggagtgcactcctccgcgcctttccaacacgagggaggcgcaggttcctcccgcccaggaagatgcggcccctggtgcaggcagcaagcagggtggaccccagctctgggaggggcctcgcaggcgccctgatatgagccctttctctttgggagctctgctgccgagcactttagggaagaatctgtgatgattccatgaaaaactaggcaagtggagaaaaaagacgattgttaatctcaggaagcaaaggtgttcgaaggaagagaagaaagaatggcctagtgtggcctcaccgcctttacctgtgtgtgcaggagcgtctcagaacagaccccgagtgtgactgagtccgctgtgtgcaggaacacaacacaacagaacagaccccgagtgtgactgagtccgctgtgtgcaggaacacagcagaacacaacagaccccgagtgtgactgagtccgctgtgtgcaggaacacaacacaacagaacagaccccgagtgtgactgagtccactgtgtgcaggaacacagcagaacagaccttgagcgtcatggaatgcacacagtgatcctggagggtggggtgcatgtgtggcaatgggaggcctggcctgaggcgctgagctggtgggaacctgaatgcggaagagcctggccccacggtcccagctgcccgggtggggtggctgcggtcatgtgttcttgcagggttcatggctcgctgagacattggatggtctgtgtgtgtcactgtgatcagatgtggatgtaaccccactgcggtggagcctgtcagggacacaggagccaacaaagcgagaacccggcggccagggtagggacagctcgacctgcaggagggtcaggccacattggatcatgacttgaagcagagcatggtggtccctgggttcacaccaccatagtgagcagatacagatgcgaaggggagaggagatgcacgtcccaaacagaggaattccaccctcgagaacgcccggctcccggcaggctgtgcagagcaactgagcacttttctctttattctttcttttttgttgttgcttttttgaaacaaggtcttgctcttttgctcagaccagagtgcagtggcacgatctcaactcattgcagccttgacctcccaggcccaagtgatcctctcacctcagcctcccaagtagctgggactacaggcgcacaccactgcatctggttaatttttaaaacacattttatagagatgaggtttcaccatgttgcccaggctggtcttgaactcctgggagtgagccactgcccccaacccatttataacattaaaccaaattatctttaagaaaagtggccaggtgccttggcttactcctgtaatcctagcactctgggaggccaaggcgggcagattgctggagtccaggagttcaagattagcctgagcaatgtggtgaaaccccgtctctacaaaaaatttaaaaattagccaggttggctgggtgcggtggctcatgcctgtaatcccagcactttgggaggctgaggcgggtgggtcacgaggtcaggagatagagaccatcctggccaacatggtaaaaccccgtctctactaaaaatacaaaaatgagccggtgtggtggtgggtgcctatagttccagctactcaggaggctgaggcaggagaatcgcttgaacccgggaggtggaggttgcagtgagctgagatcgcaccactgccctccagcctgggcgacagagtgagactccatctaaaaaggccgggtgcggtggctcacgcctgtaaccccagcactttgagagaccaagacgggcggatcacgaggtcaggagatcgaggccatcctggctaacacggtgaaacccagtctctactaaaaaatacaaaaaaattagccgggcgtggtggtgggcgcctgtagtcccagctactcgggaggctgaggcaggagaatggcgtgaacccaggaggcggagcttgcagtgagccgagattgcaccactgcactccagcctgggcgacagagcaagactctgtctcaaaaaaaaagccaggcatggtgtaattggactgtggtcctgggagatggaggctgcagtgacctgacatcacactgctgcattctagtctgggcaacagagtgagaccctatctcaaaaaattaaaaagttaggtgaggctgggtgctgtttacacctgtaatcccagcactttgtggggctgaggcaggcagattgcttgaggtcaggggttccagaccagcctggccaacatggcaaaaccctgtctctactgaaaatacaaaaattagctggtcgtggtggctcacgcttgtaatctcagctacctgggaggctgaggcaggagaatcacttgaacccaggaggcagaggttgcagtgagccaagatcacaacactgcactccagcctgggcgacagagtgagaccccatcttaaaaaaaaaaaaaaaaagagttataaatagtattccattaggcacttgcactgtgattagaattacagcacaattcttgcagtagcaaagatgttataaaaactcgttcagaaaacatacgtgcttctctggtggcgttttacagccgtcttgacttggagacgtttgtcagccaggccaggtgggagggctggtcccatgcggggggtccaggctgcgtccgccgctagggccgtggctgctgtgcaggtcaccccagaggggctgggatagctgggcgtggcctcccaggagctgactgaggtcctacccagtgtggcgggggccttttcctccttgggaccctgctgttctcaggtggtacactggggtctggaagggagggagaatggagacacaggttgaggttgggtgcacacgcccgccttctcccctgggatagacgccacgggcgtccagagctgcaggatttgctccatttgtgaagtgccctcctggagtcccgaggggtggtgtggttacacctgcagtccctggacggcagggtccggccttggagcccctcctgggagctgtgcagcccgggtttggtcgcgtttctcagacgcccctgccttgctgttacagacggccaatgggaacgtggaggccaaagtggtgtgcttctaccggaggcgggacatctccagcaccctcatcgccctggccgacaagcacgcaagtgagtccggccttccctggggtgcccgcctggcgggagggtcggctggggagggctggcggggtccttcttccctagggcccatcggcatcctggcctcgtggggccaccctctgcccaactcactctggcgtctctttttctcccttccacagtgggcgggggtgtcctggctccgtttcctcgggggctgggtgaatgaagtcctcgcacgccccccggagtggtctgtctctcactggcatcctctgcaagcttgtcatggtgtggctgggtgtgggcatcattgatcgaggcttctttttcccttctatgatgacttctggagactttccaggctggtgggaccctgctgcctgcacttgccaatgtctctctctttttaattttgcggagaggcttctgttgggattctgagtagtgttttcaggaaagcagtcctctccttattctttacgattcaaacccaagtttagtaacctggctgggaggggctgctgtggccagcacagcgtgtgggaggaagccactggctgcatgggaatgccctcagccttggggacccagcttctcccccgggaacaggtgctcgcaggtggtggagtctcctgtgccgggggatgttgacttcagagccaggagccagaggcacccccacgccctccacatgctactgacacagggcctgccgagctgggccccacctgcaccagacacagtgtggtaccccactgaggcccttcatgtgtcggtgggggcaggcatgaggggcatttttggcttccactctgacacatcacctggggtgggatctgagcccaggctgaggctgtggtctgtagggtgacatttcccagtaggtgaggcatgtgactgcccgggtacccgtgtcgctggggtgggccaaggtcccacctgtaacctcccacgacccctaatggggtgaggtccagggactgtgggtttgcggtgggtcgggtgggaggaccctcgcatcttctgccccgtcccagcgctgtgggtgaggggcaggaagtcagcccaggcaacctccccctgctctgggaggggcttagggacaggacagaccatcctgccaccgatgccttgttcctgagcctttgctgggagtcggccagggcaggcgcttgtggaaggaaggtgtcccttaaccccactgccttgcccaccggacagctgggacctttcctcagcaaccagtggatgcggacgtgagctgccctgggtcagtgcagctgggccgggcccccgagcctgggtccactctggacactgggctgtggggcctgtggctggcccaaagggagctgccagttgaccatgggctttctctggctttgtgaggaactggacctcctagctctctgctcagaggaggggagcgttcaaggtggggcatggtgatccttgacctctgaccccaaagcctgtgtactccactgctgcactcggcgggctccaggcaccaaggaggagagctggggatgttgaaggtccacaggctacacattctggaggggtgtttggtgtggcccttggccctgcaggtgctgggtgccagtcagcagcacggctggcggttcttagtgttggaggctggcctatgtcgactctgcagggctggcccgctggagaagcagtggtggggagcggcctggctcgctggagaagcagtggtggggagcgggctggcccgctggagaagcagtgcccaggctgagcggccgcagtgtggccctgccagtctgtgtggcctggggagtcaggcgccaccgttgagttgggcatgtttatggctggcccagggtggatcctgtctctgtcctctggcacctgggggcacagtgtccctgctccagagagcctgtatcagtggtttagtggtttttgagggtactgtggcccccttggctgaggttctgctctcagacgccccagaggatggccttttgctggaagagccccagaaggggactccagacataacgtgattagaggtatcagagggcaggttttccagaagggcctcgttggggctgataggactgggtggagagcagtgtcccagctcgagcactggcccccccaggtacacagcacagcccctttggacggtgctccctggaaagctgcgtggcggcccctctgcagggcgttcctatgaactgagagcccagctgcagggagcaggcgtcatgggtgatgggtctgccgctggtccagggactcagagcgcggccccactcttgcctggcggctgggccttgcggtgattctgcagggcccacaccccccggggttgtgtcaatctccgtttctcctgcttctctgtgagctcatggcagccagggtgaggcccccagctgatcccagggacaggtgtgaggacactctgggaggcctctggctctcccacgtcactgcctccacccagcccctgctggggcgtccagcccacagtgcaggcctcagggtggagggtagacacccgccaggctgcactgtggcccctgtggcagagaagccctccccccggcagggctgtgagcatgaagcctttctcaggacagaatgacagggagaggggaacgtccctcctcagaggagggcgtgggggccctggagaccacagccaagagtgggagtgagggcacagcctgggcctcacgcttaggggtgtatccagggtctgagggagggttcagagtgtgaggggtgcagggtacactagccagccccacctcctgcctgggtgtttctgcctgttgagggtcttctgaggagctgtaggcccacctcgcccgcatctccgacaggctgcaccacagagccctgttctgctgaccgggacgctggtgaaatgggagtttcggagccgctgtgggctcctgtccaggctgggtcagtgctcggatggggcctggcatagggcgggcgtgaacaaaagccagcctctggtctggggctggtgtgtgggcctctgggccctggtgatgtctgagttcagggtgcagtttgctcgtgggtccccagaagtgggagcgagtgagatgtgttggcctgggatgagaggactggggctgtcctggtcggccctgccctgttctatggaccgggaggaggtgaggctcagccgccagacaccccaggcttttgaggcccagatagggccggcccagaacaggcccagcatggctgctcccagcctcagtcttagctgttggcgcctgggagggcccagaggagccaggacttcctgcaggcaccacaagggggccgcagagagcgagcagcccggctggctgtggtcccatctggggaccttgggctcagagagccggcagggcgctgagcgggatgagtggcccactggcggccggtgctgagcgtgcgaggggcggtggggagcaccactgcacgcccccattttgggtgttataagaaccctacttgggttcctagcacagggcaggaatccccatgctgctggccggtgcccggccccggtctcatctggacagcctgttctgggaagccccagtggagtgggggcaggggtggcctctggacaggggccctccacagccaggcttgtctgggctcttcccaaagaggcttggcactgggtggatgggcagccagagtggggggacgtcgaggcccagatgatcttcaaccgggtggtcttcacgccccaccgggaggcctgcggcccccgttctgccctgccccctggcggcacagccctcggtccgggccctgggcagggagcaggccgccaccctgtgctgaccgtgctgccgggtgctgtctgtctgttatatagccctgtcagtctgctataaggccggaccgggggcggacaacggcgaggaaggtaagagccggcctccgcaaggagggcgtcctcctgtctgtgtccctgggctgggggcggcagcgccgctgagggacagagtttgggcgggccgcctgcatgcctgtgccctgcgcccggccggcccggctgaggaggggccctcccttgtgtccggcccacggcccaggcttggtgcggccccggcctgagggtgacctgctggtgtgggaggtctgtggtgggctgtatggggctgtctggccacgagatggggacggacagagggcggctgcccctcgccctcctggcctgggctcttggcagccgccgactcccccgctcctcttgctcttgcctgctgcttctggggctggcccggaccttgttctccctcctccttccatcttcatgccctggggagtctgggcctttagggtgcctggacttaaagggcacgtgggcaccagagtgtctgcaggggtacctgccaaggagccgccgggccgccatagggtggggcagtgggacagtgtccggcagcaggaggaggcacgcctcccaggactgggcctcctgcgtgctggcgccaggtggggctggtggggtgggccttggtctggcagtgtgcgtctgccgcggtgctgacaggggctccttgtccttcaggggaaatagaagaggaaatggagaacccggaaatggtggacctgcccgagaaactaaagcaccagctgcggcatcgggagctgttcctctcccggcagctggagtctctgcccgccacgcacatcaggtagcccccagcagctcccgccctgggcccctcgggctgccctcgcctttccagcctgcccgtccttctcttccaggggcaagtgcagcgtcaccctgctcaacgagaccgagtcgctcaagtcctacctggagcgggaggtgaggcccagcccggcctggtctgccgcagccagtcccgggccactgtttcctctacctatgacctctgctggcctgggcggcggagacgattttccctcctccctctaggcccaggctgttctggggggaagcggggattgcgtcctgactgtcacttccaggtgtcctggtgtgtggccgcccccaccctacgcgtccagagttgtgggccaggagcttggagctctttcctcttgccactgccacccagacagccagcgaggggaggtccccctggggagggtgtggctgaggcaggtgggggcaggggccacctgagtcttcgcaggagtcttggctggtctctcctgggcggtgggcagagtcctggtaggcccaccttgggggtcactgtgattatacggtgttaccaggtgattcttatctgggggtcacctgtgattatacggtgttaacctgccgtatagcatcccccaaggcgtgacaaccaaaaaatgtgtcccgacaatgccatacatccctggggagcagtgtcgcctgacggagagcggtggcactgaggctgctgtgagatccagcgaacgggagggttgggttttctgaggccacgtgggggcaaaagcgtctggagtgtgttggttccctggagtgcctgtcacagttgcggggcacacctgccaaggggcaggcgcatctccaggcctagggcttggcctcccacgggctctgctgccacctggctggagtcttgtgacctgaacacccccagcgtgtccagtcagctcagatgcaggttgctggatgcggcccccaccctgcccatcccaggggggctcatctctgtcgtggccatcggcgctctggcatgggctctgaaggatccaggatggccacggtgtgtcccaagctcagccctgcactacctctgtggccccggtccccattcccaccacacagcctggaaacaggcgtgaagggcgacagtggctcagctagggctgtggtcgtgccttagctcagagtcatgagcaggcagagaagagcaggcagggcttggcctggggtcgtaacacatgcgtggagcatgggcagggctcgaaccctctcaggctgccagaccagcttcccagaaggctgagccacaacatgctgggcgggagcagaggctgtgggggtcgctgtgaaggcttccactcaggaatgaggagtgcccttattgacagagccacacagagagggtgagactgcagaaatgtatctgtgggcacagaaaatgtttgttagcaaaaaaggcccgtgaggaagcagcaggtgcagtgacaagcctgtctgcactgtgtccgcccagaaacggccgggtccatgcttgccggggacaaaacaggctgctcaggcaccctgaaaccctcctgctgcacgatgcagcccttcccccctttttctttttctttttttgttttttttttttttttttttttttgagacagagtttcgctcttgttgcccaggctggagtacagtggcgcgatctcagctcactgcaacctccgcctcccgggttcaagcgattctcctgtctcagcctcccgagtagctgggattacagacgtgtgtcaccatgtccggctaattttttgtatttttagtagaaatggggtttcaccatgttagccgggctggtctcaaactcctgacctcaggtgatcatcccgcctctgcctcccgaactgttgggattacaggcatgagccactgcgcccagccacttccctcttctttcttacctggggtttctgaacagccccaatatgggaatttaatgtaacaggctcagggtgagtacacttagcacctggcagaagcttgtgccactggcccctgggcgatcgtgcccctgcctcgcctcaaataaccctcactgatgaagtcctgataaacacaggctcatgtcacagataagcaagagtgcagaaacagcacacagcagtcacagacacacccaggccctgaccagtggcgcagtccggcaccaaatagaaaccacttgtgtttattaatttaaagaaacaggccgggtacagtggctcatgcctgtaatcccagcactttgggaggccaaggccgggggaatcacttgagctcaggagttcaagagcagcctgggcatcatagtgagacctcacctctacaaaagtaaaaaacattagccaggcgtggtggtgcacacttactgttgtcccagctactcaggaggctgaggtgggaggattgcttgagtcaagaggcggaggcttcactgaagcaagatcgcaccactgtactctatcttgggtgatagagcaagaccctatctccaaaaaaaataaaagatccaggcagagtaggagctgaggctgaggctggcagctggcctctggatagtcgtgtcagttcaagaggacgaaggccctgaagcatggctcgtggtcacacatggagcaggtgtcatgctggactttaaaggtagctcttgaaagaaaacacgcagagtagctttcagaataggagagacagggaaagcgggtaagggctggaaaagacgacccacaggaatcaggaggatgacctggaaacgggagggtgattggacgccaggcacacatgcagaagaaagtgcagccctggctgaggccaggtgctcaggctgggactccagggtcaggcccggacaggcctgcttcaaaaatcatcagaaccagcccagtgcaggacacacaatgccggacagcaaaaggttggcaaaggccatgtcctggaaatgccatcccagaggcagcctgggggccctggtgtgaggttgcctgagatggaatgctggcgggaagggccgcgcctgctgcgcgggtggcggccggcggtgctgagcctggaatgctccgtagcgctccagcggtggccgctcctccaaggttgtgcccagaactcctgatttctgttgctcttaaacaccttggataagttacatcttcacattgctgctgctgatagggatggctttgtagccgggcatagcacacgcctgtagtctcaactacttggaggctgaggtgggaggatcacttgaacccaggaggcggaggccacagtgagctgtgattgcactgctgcactccagcctgggcgacggagcgagaccatgtttcgaaaaaggaaaataagtctgctgggcgcagtggctgacgccagtaattccagcactttgggaggccgaggcgggtggatcacctgagctcaggagtttgagaacagcctggccaacatggtgaaactctgtctctactgaaaatacaaaatattagctaggtgtggtggtgggcacctgtaatcccagctacttggaaggctgaggcaggagaattgcttgaacccgggaaacggaggttgcagtgagccgagatcacgccattgcactccaacctgggcgacaagagcgaaactctgcctcaaaaaaataaaaaggcaaataagtcatggtttttgggctgtagccgtatccaccctgccttggtaaaggcttgtggagcctggccccacccctgcagctgctcattggccctgcctctgctgaccctcggcatgtctcctccgtgcagtgtcatggggcaggtgcatcccccagtgaccctcgaggccccgctgtaggctcctcccaggcatggccgggagctgtgggggctcctgcgccctccctccctcctgcgcccatgtcgccccacaagagctctgggcaagaccctcccagcagcccggccgtgctgacgcctctctgaccctcccagcagcctgactgtgctgacgcctctctgtctcctgtggtgttttccaggatttcttcttctattctctagtctacgacccacagcagaagaccctgctggcagataaaggagagattcgagtaggaaaccggtaccaggcagacatcaccgacttgttaaaagaaggtagggtgggccgccctgggcatggagccctctgtcctgtcctgtcctgccgggtgacacactgggtgagaggaggctgggacatggccgtgtcagtgattcatgtgtgactgggggcggcaggtgtaggcctgggctctgtccacatgggtgatgcgtgtaggctggtgtcccggagccttcccccacccactcctggtggtgttggggttctggggaagcctcagaccctcaggcaggacgtggtgatcagctgtccttgcacagtgacacctggtttccttctggcagttgtttttctttttcttttttttcagacggagtctcgctctgttgcccaggctggagtgcagtggggtgatctcggctcactgcaacctccgcctcccaggttcaagcgattctcctgcctcagcctcccgagtagctgggattacaggcgcccgccatcacgcccggctaatttttttatttttagtagagacggggtttcaccgtgttggccacgttggtcttgaactcttgacctcaggcctcccaaggtgctgggattacaggcgtgagccaccgagtctggccttggcagttatttttcattactttttcttttttttggacaaggtctggctctgtcgcccaggctggaatgcagtggtgcaatcacagctcactgcagcctcgacctcccaggctcagatgatcctcccacctcagcctcctcagtagctggaactacaggggcaccaccacacccccctagtttttttgtatttttattagagacagggtttcgccatgttgcccaggttggtctcaaacccctgaactcaagtgatctacctgcttcgacctcccaaactgctgggattacatgtgtgagccactgcacctggcctcattttttaaagttctttttgcctccagaaattttcttctgtgtgaatctgcccacgtttcttgtcttgcctgtgggtgccccacccttgaggcctgctggggccgtggagctccgacgcagtgctcaccccggatgctggcagcctcctccctccaccgggtgcttcggtagccctggtgggaggtcctggggctcactgtccccttctcagccctgtccctcatctccccgctgggcaaggccgcgaggctgccctcgagacgcagggctctgcccccgagggtgggcggggactcgcctccctgcttgcagttgtgatcaaggcgtttcgtgcttgtcctgttttggtttgttttgagagcgggtcttgctgtgtcgcccaggctggacttgaagtcctaggccccagcgatcctcaagcctcagcctcccgagtagctggtgctgtttcgtgttcttcttgattgtccgtaaggtgctggtgcgtctcacaggtggctgggtgtgccacctcctccaggcagctgtgggctccagcattgggctcgtgggcctgctacattgcaagcatctgtgctctgggaggtgcttggcagtgggggaagacccccacatctctccaggcagacagggcacattgagggctgggcctggggaggaggcctctgtgctgaggcctgtgggtcggagcctggggaggccgctgtgctggagcccggcctgtgggtctaagtgtggggaagtcactgtgctgaggcctgtgggtctgagtgtggagaggccgctgtgctgaggcctgtgggtctgagtgtggagaggccactgtgctggggcccggcctgtgggtctgagcatggggaggccgctgtgctgggtctgggcctgtggcctccagggtgccctgctatcatgccagggtctcccagcctggggctgtcttgcctttctggcctggccaaaggtgaaggcctggcagccgcacccaggtggaaaggcagagtccgtggctgggagacaggtgagaacacagatcacatgagggccagagagtgaggagctgtctcaggtcagaggccctcagctggcgcatctgtaccttcagcctggggccagtgggcctgtcaggagaatgggccttgaggtgcccccatcttaccatgcacacctggagagacctggcggagctctgcagggtctggggcgatgggactaagggtccacaaggccgagccagccgcaggagccggcctcctctccccacgctgccttccccgctgccctgccgttccttggcttttgggccgctggtgcaaggaccagggatcccaccagctggtgtggggccgggacgtggcgtccagagctttccccacctccgagaggctgtgtccctcttgagtgatggaaaattgcacactagttgtgcacctgcctttagtgagtttgaaatgtcaaagggagtgcgaccatcatgaccagcagtgcgcatacacggaggcaccatggcttgtgtgggtcacaccaaggctcagcttcttggccgtcagggagctaggccccagcttccccagggtacccctgagccaggtgaggagtccacaccaggctgaagaccccccagcccgccttgctggttcacacagccccagtccctggctgaccccgtcctctgagtctggccaggcattgtttcctagaggccgcatggcctgaccctccctggacacatggcccaggatgtccggcccttggggcagggtctgggagccagtgccccttagcgagggatagcattttcttggggactttctagtctcaagagctctctccatgctggacctgcagccgggcgccccagtggagggcagccccgcactccgtggtccttggtctggaacctcggtgctgcccagggctggaggggagctgcttgcagagtctgagcctggcaccctgcactgagctatggaggcggctgagaggtggacagaggacaattgtggagctctttctccaagtcctcccccaggagtcaggctcagccatgctcagacacacattctcctgagggtgtctcccaacaccacggtcttgttttttggcgagtaaaaggctgtttcgtcagaaaccctcctggccctggccgactgcaggcgtcaggtggcctcttcaccagccttgagttctccatcgtcccagctcccagaagacaggaaacaactggtgactccagaggcacgcccactccctggcccccggctctggctgtgccaggcttagccgcagctgccccagaaccccctggggtggaagaggggccaggagggagcctgtgcccccagaaggtccctggaggtggtctgcctgctgctgtgacgtggcagggccctcttgcaacagcatgtgaacccaagtatctcaaaataaaaagcttgggccgggcacggtggctcacgcctatgatcccaacactttgggaggctaaggcggatggatcacctgaggtcaagagttcgagaccagcctgggcaacatggtgaaaccccgtgtctactgaaaatacaaaaattagctgggcatggtgtcggtgcctgtggtcccagctactcaggaggctgaggcaggagaatcgcttgaacctgggaggcggaggttgtagtgagccaagatcgtaccactgtattccagcctgggcgacagagtgagactccgtctcaaaaaataataataataataataataatataaataaataaataaaaaggcttgatttaaatttacaaaccaaccttcccatctcttgtggccacagttcttggagccctgcattctgggtgggctgggaggccccttgcgtgtgcaccccagccccgggttgagaggccactgtgtgcctgtgtgtgcaacagcctccgtccagccttgcaccctggcctcacctatggggccctgcagcccttccccctccccgtcccagcagctccccgcacccggggaggagaggcgcggcccggcgcgccgtgggaccccgtctcagaaaggccacacttcctccctgtaggcgaggaggatggccgagaccagtccaggttggagacccaggtgtgggaggcgcacaacccactcacagacaagcagatcgaccagttcctggtggtggcccggtgagtcctgctcctgggcaaggccagcaggggtggtgcctggagcttctgttctcccttccctgtggtgggtgttggggacgtgacagtcttggatcccatatcccaacaagaagcccatgcgctgcagccctgagacccccggtagcagttcccagagaggctcgggagtgctgggtccaggcccttcattaaatagaagggcggcccttctggggggcaggcctgtgtgcctgcccatgtgtccctaatggggctttcccaggatgggccagaggtgctttcccactcctgggccactgggagcaagtgggctgggcctggtcatggagcagagcagctgcagcccgggcagacccctggggcagggcgaaggccgaggcccaggagaggaccatgcaccttccctgccagcagcctgggaggtggagaaaaccccaaaagaagccccaaggcggctgccaatctatcgggatgccctcagttagacgcacacgggttctggggtgggtgccgggccctactccgcagcctggggcccaggacacgaggagtcctcgccacctgcgggctgctccctgcgatgctcatgcagtctgtccctggtccctggcgcctggggagctgtgtgcctggggggagtccgcgctgcccgtggcccctggtccctggtccctggggagctgtgtgcctggggggagtccgtgctgcccatggcccctggtccctggcacctggggagctgtgtgcctggggggagtccgcgctgcccgtggcccctggtccctggtccctagggagctgtgtgcctggggggagtccgtgctgcccatggcccctggtccctggcgcctggggagctgtgtgcctgggggcagtccgtgctgcccatggcccctggtccctggtccctggggagctgtgtgcctggggggagtccgtgctgcccgtggcccctggtccctggtccctggggagctgtgtgcctggggggagtccgtgctgcccatggcccctggtccctggcgcctggggagctgtgtgcctggggggagtccgtgctgcccatggcccctggtccctggtccctggggagctgtgtgcctggggggagtccgtgctgcccgtggcccctggtccctggcgcctggggagctgtgtgcctgggggcagtccgtgctgcccatggcccctggtccctggcacctggggagctgtgtgcctggggggagtccgcgctgcccgtggcccctggtccctggtccctggggagctgtgtgcctggggggagtccgtgctgcccatggcccctggtccctggcgcctggggagctgtgtgcctgggggcagtccgtgctgcccatggcccctggtccctggtccctggggagctgtgtgcctggggggagtccgtgctgcccgtggcccctggtccctggtccctggggagctgtgtgcctggggggagtccgtgctgcccatggcccctggtccctggcgcctggggagctgtgtgcctggggggagtccgtgctgcccgtggcccctggtccctggcgcctggggagctgtgtgcctgggggaagtccgtgctgcccatggcccctggtccctggcacctggggagctgtgtgcctgggggaagtccgtgctgcccatggcccctggtccctggcacctggggagcggtgtgcgtgggggaagtccgtgctgcccatggcccctggtccctggcacctggggagctgtgtgcctgggggaagtccgtgctgcccatggcccctggtccctggcacctggggagtggtgtgcctgggggaagtccgtgctgcccatggcccctggtccctggcacctggggagtggtgtgccttgggggagtccgtgctgcccgtggccgctggtccctggcgcctggggagcggtgtgcctgtggggagtccctgcttggccgacactgtggtcagcgcatctcctttccccagctctgtgggcaccttcgcacgggccctggactgcagcagctccgtccgacagcccagcctgcacatgagcgccgcagctgcctcccgagacatcaccctggtaagtgggcccagggcgggacaggtgagacctggggtggcccatggcccagagtggctgcgcccttcttcctaccagggcccagcacctgccccaggtattcaggacccctgcagaggtgctgtcccacctggactggcctttcctatccaccccaaactcggccagactgtgctgagggtgcagggagggttgtgctgctgggcctgcagtaggggatccttgaggtactgagggagggggtaccgtgccacaggtgcaggaaaagccaccttggcccgggtgaccctgctgtctcctgccgcagttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttgtgagtaccgtgggtggcgatgggggagtggctggccatgcccatctccaggtaggctgcgggggtgtgggctccacatcccactctgccctgagggagcctgtcctgcaccctgattccctgtgcggagctgcatgagttctgtctcagctgcgctcggccgccatagtccttcctgtcacactggttcagcagacaggcatgggggcgctggtggggcctgggcatagagagccatgctcctgccaccattgcgtgatgaggataagggttggcccaggtgacggaggccagggtatcctcacggagactttcccttccttgctgccccctccagccccaggcttggttttgctttgtttttgactaagctgaacctcttgactcctcatgtccttgttttctgtctcacgtgagtttagcccagcagcaggcctagagagtcttcatggcgtggggtctcccttccctgtacctccacctcaggacccccaccctccaaccgtcagccctcctaaaatacttctaaattaatctgttagaagagcatccctatgtgggggtggtggggcccccaaccatcagccctggggaggtggagactgtggcagggcagggaggagccccaaaggggccgggacacagcggggtggctagtatctgatgaaagcaccatccgggcagcagcgcacaggccagcgcagcagaggctggagacgcatctggaattcggaagaaacaaacatggggttgggtagggtgcctagacctgaagaggaggagggacagcagccagctgtgaggctcctgaggacgcatctgctgggggcaggagtgcagctttgtgtgggggcctctggccaaggggagagcttggccgggcgggaggagtccctgactgtccctggggccagcggcctctccaaggcggatacggatctctccaggcttaaaaacaaaccaagatgagcagaacatgttcagacaagaggacgagggctagaaacaaaattcaccaactaggctcagaccagggcggaatttgagggagaccctgctgcacatggttccagcggaggagaccccagtgctgagcccacgtgatgcctagcgaggcagcgctcaggggactgcggctgcggggccatgcccaggcacggtctcggggggctgcggctgcggggccctgtccaggtgcggggatgggaggctgcagcttcggggctgtgtcgagggagcaggccccgctctccttcctgccagatgcagtggaccagactgaggaactatctgaacccttatttaataagacaggtttcttaaatccatgccacagcccgggcgcagtggctcatgcctgtaatcctagcactttgggaggccgaggcaggaggatcatgaggtcaggagatcaagaccatcctggccaacatggtgaaacgccatgtctactaaaaatacaaaaattagtcgggcatggtggcaggctcctgtagtcccagctactcgggagacagaggcaggagaatcacttgaacccccgggggtggaagttgctgtgagccgagatcgcaccactgcactccagcctgggcgacagtgcgagactctgtctcaaaaacaaaaatggctgagatggccgggcatggtggcttatgcctataatcccatttgggaggccgaagtgggtggaccacttgaggtcaggagttcgagaccggcctggccaacatggtgaaaccacgtctgtactaaaaatacaaaaattagccgggtgtgttgagaggtgcctgtagtcccagctactcaggagacagaggcaggagaattgcttgaacccgggaggcagaggttgcagcgagccgagattgtactactgcactccagcctgggtgacagagcgagactccgtctcaaaaacaaacaaaaaaaaggctgagatggaggctgggttgtcagtgccacctcggcaagatctcgaccttgaccttgtgccagctcctcttcccctggcgtcactgtgttttggcatctggcggggggacctgcttcatcagctgccctctgcacctgcctgccagcaggggcctggcctccgtgcaccaagcacacctcgccctctggcctcccgccccctctgtggccttctggccgcagccctgcccctgcctgcatggtgtgcctgcctcctgccccttcctgcttgtgtgacacgcctcctcccacccagctcccgtggaagtcgctgaccagcatcattgagtactactacatgtggaagaccaccgacagatacgtgcagcaggtgagcccgcccgccactcagtgcccggggtgtgccgcctccccgtcctgcgccccatcctctcccagcaggtgggcgtgcactgctgcagcaggaggggaaggaagactcctgagtccctggcccggctgtcctctccgtggtgctctcctctccgtagcctccagcctgtctgcactgcagccccaacctgggcctagcctgctgacctctgaccttctcttttgttttaagaaacgcttgaaagcagctgaagctgagagcaagttaaagcaagtttatattcccaactagtaagtgtgccctcacagccgtcgtcctcgtggccccgggggccagggagggtgggcacagggtgctggggccaggcgggtcccaaggaaactcaagctcagaggctgggaaagttggggcagcccccgggagggcggcccagggctggggggttctggctgcagacgcagtggccatgtctctgtcgtcctggcctcctggtcagtaagggggcattgggattccagcccacaccgccagggttcagtccctgagctgggctccatgctagggggagcacgggggcctggagaacggctcagacctcagcagtggctcccaggaactgaaaggggagaaaggaagatccctgccgaggccgaggggtgcgaggacgtggttctggacaaggggtggtcagccgcggtgcctgctgggcacatgggccctcgaggtttgtgctcctgcaactcctctcgtctctcctttccctctttaagtaacaagccaaatccgaaccaaatcagcgtcaacaacgtcaaggccggtgtggtgaacggcacgggggcgccgggccagagccctggggctggccgggcctgcgagagctgttacagtaagtgccctggatggccgggggcacaccgcacgcccgcctgtgggccgtggtgcctgcgttggccctgagggctccagcatggcccagcctgcaaggggcccactgacgatgggggctgcgtcccaggggtgtggttgggagagcctcggggaacgtgtgggggtgcctggcgggtgggggcggccggcgtgggggtggcggggaatactctgacatcgctggttctgcttaagaatccgtctatttccaactttgttgtccgtagccacacagtcttaccagtggtattcttggggtccccctaacatgcagtgtcgtctctgcgcatcttgttggacatattggaagaaatatggtggcttgaaaatgccaacccggttagatggagagaggccaggaccaaaccgcagtaacatggtaaggggggggacacccgccctgcctgccatgagcctgtcggccacgcgggtcctcggcccccggtcatggcgctgtgttggggcggttgcgcccccttccgcagagtccccacggcctcccagcccggagcagcgggagccccaagtttgccatgaagaccaggcaggctttctatctgcacacgacgaagctgacgcggatcgcccggcgcctgtgccgtgagatcctgcgcccgtggcacgctgcgcggcacccctacctgcccatcaacagcgcggccatcaaggccgagtgtgagtcaccccaacgccccgcttactctgttcctgcgggtggtggggagagagcagcaaccttggggcccagcctgtagccccactgggagttctgatctcagggagccccacgtcctcctcggtgctgacatggccgagcccagtgagggctcccaggtcaaggcgcaggcagggtcccgtgctcccctgggggtgccccacccctcacaccgtgtggtaccccgcaggcacggcgcggctgcccgaagcctcccagagcccgctggtgctgaagcaggcggtacgcaagccgctggaagccgtgcttcggtatcttggtgagcagccaggcgtgctggggggctcccaatgctgcctgcaggcagcttctcacccaagctcatgcactggtgctcccagccttctctagctgggagctcctggacagccccccagggcctggaactgtccttttggggtactctgcaccgtgccaggctcaggcagacccactgggacccaggctgctccctgctcctggggtcgtgatggggcccagtgcggagtagcggccgccctgtcttctgcggggccagcctcctcaaggcacacccgggggcttccctgccagtctcgctaccctgttccctgtgttctgatcgtccctggggcctgagggtctggggtttaggtggtgcacacccctgcctgtaataccattaaggcagcgtcgtacctgctgcctgcagggagtatacttcctgagccacgcccactccacaggggcagcactcaggcctctgcacgccctcggcagggggaggagcagcctcaggcggcagggggttcctttgcctttgagcatctgaggacacccgagaacctcagccggctaccctggcccagctggaagcagcttggtggctgggccagacatttgtggtggcggtggggggcctcctccatttgctgggctcgagtgggcttgtgcatctgccctcccgacacagggtgactgtcctgagaaggacattccagagtcatgagccaagtgtgctctgagattcaagtggctttggcattgctccctgtttggggttgtggcccctgtcctgtgggaagaggtggctggtgtcagggctggtcctcagcagctgtgtccctggccaggctggctggatggttggttcgctgtctgacgagcagccagccctccaccagcagctccgggggcctggacgtgggggctgtttaataggcgtgctgtgctcacgggcctgtgtatggatcctgttgtcccggggctgaggggcctggcccccgccaggtggtctccctgctctctggaagccctggggtgcgggactggcccgggcacacgccttgccgagggcttctgggcttctggttctgtggtgacctccccacttccagcccagtcaggatggggcctcgggtgggggccgcatggggcttagttcctgggggtatcccggaaccatgagggctggagcctgggcctgcctgcccctcccctgctgggcagaggcaactcgttctgcctgtgtcattcccggcagagacccacccccgcccccccaagcctgaccccgtgaaaagcgtgtccagcgtgctcagcagcctgacgcccgccaaggtggcccccgtcatcaacaacggctcccccaccatcctgggcaagcgcagctacgagcagcacaacggggtggacggtgagtggcccccccgcccggtgagtgtggccctccccgcccggtgagtccggcccgtccccgcccgggcacccgccgtgcgtgctgacgctgtcttctctccctctctcccaccccggcgctgccaggcaacatgaagaagcgcctcttgatgcccagtaggggtaaggcctggagccgcgggcgggcgctgcgccggccccgcccgtgatgcctgtgctgtgctgctctgtgtccccgcggcgggcggcccagggcccatgcttggggcagtccacgtgagccaggccacagcccagttccccacattcctcccgacatcactggtcccttggtgaagaccccccgagcccaggcatctggccctcggccccctggccccgcctcctgtcagtggactgtcctggcacgtgtggccctggcgcccctgcctgcgctgtctgccatcgcgctgtgactgcccgcatgctgccagcctcagctcgtggggccgcccgtgctgtgcctgcaatccttccgtgcgcctgccaggcgggacagtggggagggtggtcgggggtgtctgtgtgggccgtgggcaactgagcttgtacacatgggtgccttctgtcggaggactggctcaggtgctctgtgccggttgcttggagcaggggctgcgggaccccaggccccttggggaagagcagataggaccaagcctagcatgaggaggccaggtgtgtggggcccgggtgtgcaagtgctgggcctgccagtgtggatgtgcctggagccccttcgccaggcggctttcactgacggtgctggccagggcagcagggccggtttggcgacctggaggtggatatgggtagtggctgcccagcccagccaaccctgtccccttggggcattctctcgaggctgctgggtgtcctggcaggcacgtcctgtggggtcagcacgccggctgcagcgcagggtgggcctgagatcgggtgccgggccccccatctccacctgtctggacacgcacccctggcctgtccttgcagcttcctcccgacatcccttggcggtgtctgtgtctcggccccagccccagccctcctttcctggggcaccctcccagccatctggtattggggctgcccccattgcctagtcctgggcccagggccagcccactctgggctggctttacttgtctgttcctaatggcagggcgtcccaggaacagccccataagagctggtagaaacaggagggagtccttgtcagcaggcatcttcgagctttttgttttgttttgtaaaaagcggttaaccagcaagttacataaaagcttatttgttcccactgaattttccacacctcacacgtgagtcccagccatgcagtgcttgtgagggagcatcaccccttgccgcctggctgggcggggccctgggctcagaggggtcagccacagaggaagcgcctgtcctgacgtgtagcggccaggacctgggcgctggagaggggccagctgggtgaagacggctcccgggggcactggcgcacacgaggtggggtctctgtccagcctgggtaggcatgagctgagctcgagtgagggccctgcctgcccacagcacggggccccagcgctctaacccggccatttgcccgtgcagcctgttgcgctgtccccacctgcggggcctgcagatggctgcgtgtggctcactaacctaaagcatgtgtttcttccctctgctgtccaccgctctggtaggcacttacctgggtaagtagtttttgtgctactggccagccctgggcgctgggccttggcttgtggcaggtgccctgaggtatggctgttcctgcttgggagcgccgcagatcaggcacctgggcccccacctgaccctgcccggcagagctaagcaaactggcagggaaaggctgacccagggctccagggccccagttggcccccaggggagtgccccaagttaggaggcaactgcaggtggggaggggctggacaggctgcttctgttccttaagggatgggcctcagctaagcagcgtttctggagctggcaggttgctccgatgcccctgggccctggcacctgactgagttgagtatgacatcctgtcctctctgagctggtcctgctgggagccgagccatcctgggaccagctcccacatgcacacgcccacacctacacacagggcagtggggaagggcagtgagtgggggagggcagcggcggtcctgggcccagctgggggtgaccaggagcatggaccccgcttcttggcccaactcccgcagtgccccttgggctcctcaccctgcactgtgggaagtcagaggcctctggcaccccatccccaagcacatgccagggtggctggggcccagccagggcagtgggtggtgacctgtttctggccggggctggcggctctctcagagccttaggaaaaagcccggcctcctggtggggcagtgccggccacagcgtggctgccctgcagaggggcttgtgccgctgctggactgacagccttgcgaggctttgcttgtctcggcacggcaggcaagtgggtggacagccccggcccctgtgcagggaggtgactgtcgggtccaaggctcctggcctcctgcctggagcccaagccaatgtgtctcttgctggccagagagctgtggggccaccaggcggcccaggacccggggatgcgaggccccacgtcccccaggcccatcctgggtgtgggctgtggcttggttggcagatggccccggcccattgtcccaaggtggctgaggccgtggtgggcggtgggagtgcaggacgcgctctctcggggcctcatttctctcctccatttctcatcaggtctggcaaaccacggacaggccaggcacatggtaagaggaacaacccatgatggggtacggtgcgctcacccatgagctctctggggtgttgggaagaggcctggccagccctgccaggtgccacgtggaagcttccaggaggcctggcaagaccagaggggctgcagcatgtgggggccatggcccctgtgccaggcccagcggtgtgcggccgaccagccctcagggctgccctgggccaggctgggggtccgtgtaactcactggggtggtggggggttggccaggcacagcacctcccagcgggagccctgcaggttgaggtggagctggcccttggctggctgcccaggaagtgcaccccctctgcagggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggtggggccttcccagggcaggcgggagggctccgcacagcgtcccggccctcaccaccacctctgcccacaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgcggccgcggccggccgagctgcctggcggggttggcccttgtcttttcaagtaattttcatattaaacaaaaacaaagaaaaaaaatcttataaaaaggaaaaaaaccaaccggtccttccctgtgtcttttgttcccagtccctctccctgactcaggccctgggccccccacccccatcgggcggccctaggctgtggctctgccgtggagctggaggcccctggaggccacctcagccaggacagccaccccagcctctgggctctgttgctctcccacctgcccacagaccttcccctgctggggcctggcgcggtgccctctgccctccccagggggcagcaagcggttgcagggcccaacccccttccccagcagagctgtgctgaaaccgtctgtgcgtctgtgtctgcggcagcggtgggccggggactgcctcccggcaggcagagctggccctgccgaagaccctgtggcttcccaccagggcagccagtgcagctgggccagcgaggccttggagtgctccagccagaggcccaacctcctggccatgtagagcctggccccagccgcctgagggtttctgcccagagctctggcccccaagcaggtgtgcagtctccacagtgagaatctgcttagatttctgcaagcacattctcagaaatcctgcttggcccatcctccggccggggacaggacttgcaggccgggggacaggtacaggccgggccaccagaaggaggggtccggtggatagcctggctccagaccacccccctggccgtgctacctcagccggccaggaggggtccgcccaggcctcgctcagggagagtagctcctctgtctctccccagagctgtgcctttgctcccccagcccacccaggcgccctgtcatgtggaaatctcagccacggaattaaaatagaaaccacttctgctgtctcccaggagacaaagataagggggcgtcctggcctccgtgggagcctgtgctggggcccagcagtgacaggactaggtgtcagggactcggctgcagtgcacgtcccacccaccctccctgggctgtggcgcccccccacccaaccccagcccccaccagccaactctaatctgcagccagcatccgagtgaccccacagcctgaggacttgcctgtagtgcgtcatcagacggctgggaaatcaggcccctgacctcatgaaggacacagctccctctgaggccttttccaaccctgggggtctggagctcagtgaagaccccagctcccttgtctcccttccccaggcctcgggcttgcctcccagtgctggctgcagggttctggcctcagcagctcttccaccccccagggcctgtccttttctggagtcaacatgtgggctgtgaggtgtcctaggtcctgggctctatcccaagggcagggaggccctgaggagatgtggggccctttcccaccccagacaccctccccggccagacacccaggctgcagtgccctcacagggccaagctctggccaccggtgctgggtggggcctgggctgcttgtgggtctaaacctgggcttagaagtgagtgggtaccggctggggggagcattggccttggtgcccaggccatgaaggggtctcccagctttgctatgtcctcgttaggcccttccctgctgatgagacagcagcctgctttctgcaccagcaaccccacaggggccgcggctccccagggccaggggcatctcagggtggcaaggccatcatgctgtcatgcctggagacctgtcctgccagctccgctccaccctgctagggtcctctgtccaccactcagcccagcctggcttccctgcagtggagctgagtagcaggggcctgctatctgccagtgtcacaggatggcggaagggaccagaccactgcagcccaggggtgtgacccagccccatgcccagccatcagccctgccagctcccttcacacccgccgtgtcctgtgcccccctctccactcgggcccgtcccactgtgtcactgcccctgcctgtgacccaccgcagcctcagaggtggagaccaaggccactgctctgcacccattgatcctgacccctgcctgccaggcccagaatagccccgtcgcattagggagcttctggccgctgcccagggactgcggctggggtgagggcagtgcagcagctggcacactccttgtcccaccccaccctccgtgtgtctccagggcacctggccagtgccgaatgccattcctttgctgccaccctgggaggggcctgcctctacccccatccactcttctggcagggctggggaccttggggcaggtggtctccctccagaagagccctgtgttcagccagccctgtcctccagagcaagccccacaggtagcaagccccacaggtagcaaagtcagggagggtaatggcttagccccaggctcccaagctgggcagaacagggcagggagctggagagggtttggcagtgggcccatgaatccagcctgggcaaggccctgctgtgagggacccctagggacccctgggcctgccagggaggaagggctgcccagaaaaggtactgactgatgcctcctcaccatcttctgccttggctggcacaggtcccaagtgcagagggggagctggtcaggctggtcagtcgggcgggggggcggggggcatgtttctggcctgctgtcaccatggaaatggcagtggctgcagggtgtgtgtgcaagggaggagggtgctgccacagagagcccagccaggaccaccatgaaagccaggagcaccgagggcctctggttggctcacaaacatgcctggtgcaccaggcagagggaacaggtaggtctccgtgtccagcccacagcctccaagacacagggggaagggtgtccagagtcagctgcccccatagggcctgatcactgggcttctgggatctgcctgtctcccaggccgacgctcagctggggccagaaggctcagagaagggcccatggggacagagcaccaggaagcccgtgggtgcggaggttccccacctggggccaggctctacggggctctagggcggaggcactgtggtgaggcgtggtcaggcacgccctggttgggaggaggccagagtgggggtgtgggggtgcggtgactggcatgacccctcaatctcccgcctgacccctcgaggtcaggccctgggcccccaggcacgcagctggtcctgggcggtgcgggagaagggactggagtgtcagccccagcccggggcacagagggcacgcccactccttcccctccttcccttcctaactcctcaccgcctccccggccgccccctgggtggaagtgcttggggtggacgccttaagcgcggatccctcggcgctggtgcccgccgccccttccctgcctgggaggcagacgcagacctccccacaccccctaccagcagcttctcgagctgtttctggaggtggcggcgccttccttcctgagccctgccctccacccaaggagccttcagcaccacagacagtgttggggcggggcgcgggcgggggcggagcgggacatggagacccggacagggctgggggccgtgcccgccgggaatctgactccgctcccgcggcgcggctgttgctatggaaaccgagcaacaaagggaagcgggacaggcgccgcgcgcggcggggtgggggtggggttctcccggagcctgcgaccccttcccgcggcggagcgcagcctgggcgcccagggccgggagtgttggacccctaggcccaagtcactagggctccccgagagccgagggccaggctccccgcaccctgcccgccgccccggggacggcccggccaggcggccccgacgtcgccatggaaacagccggggcgcgggcggcgccgcggtcgcccgggcgggcccctgtagacgccacctccggcgcgaggggcccgggggcgccaggcctggcccggctgccccgcacccgccacccccggcaggtgcgccccgcccccgcggcgcccccaggcggcccccagcccgggggacgggttatcgaggccccgccccggccgcggagccaatgggcgcgcggacagccgggcaggcggggctgggcgcgggcggcggcggcccggaggagaacgggcggagggcgcgggccgaccgggcgcaccgaccatggcctccaaatgccccaagtgcgacaagaccgtgtacttcggtgagtgcgtgcccgctcccggcccgctcggtgcatcccgccgcccttcgcggccagtcccgcgccgcagagccgcggcgtaactcggggtgcgcccggccccggccccggaccgaggatgcgcgtcccggaggctggctggccgcgctgcccaagcggctaaagccaaagggtggggctgcgcgaaagcgggggcggtcacgcccgaaccccgaagcggcttgtgggggcggggcagggaccacccgggcggggcttgtggtgccccgggatgaggccagtgtttgggggagcgctcggggatccgcggacgcatcccggttcctcggacggcgccgggcggggcggggcagggcgtggctgtacgccccgggtgcgtcccgcgcgctcccgtgggcctgggccctttctcctggaccccctacacccgcttcccccgggaacaagtggccgggaacagtgacccccagctcccactccgggctccgctgagctgggctgggccaggtttggactctgtcgggattcagtccaagcgggggcgaccttggcctctgcctcctgcttgtcccgacgcattcccttggcgccagttcccccaggagtttcacacgggggtagggtgggggcgggtgtgacacgcgagttcccgcgaacgtgagagggaccttgtgctcaagcagcccaggtgtccaggatccctgcctcctcaaggtcagaacagccctggacaggatgcaggtggtggcgggaagagggatgtctcgcaaggcggccctcggtctagcccctccggcaggcgcgctccccccgtctgggcttactcactctctgggcctgggtgcgcccttcctacccccttcctcctggctgattcgctgcccagctttctccagggtggtaaggtccctgcccacctacccaccagctgctgcacgaaggggggcagacttagtgaagcagagaggagggccgggaccaacagggcgcctgccctggtcgccccatacccagaatgcggccaggctgcagggaaggccgccactgggcttccccggctcacaggctggagggggttgaggggaggttgtattttgcccgtcccagaggggagggaccggatttggcctggagtgcttctggcgtggctgggagccgaggggcttccggctgcctctcctggagcccgctcagccctcagtctctgtcccagcgagggctgtctctgtaaggcttagggtgggagacggtccccagggcccttctgcagtccaactgcccatgactttaccccaggccgggccaggccagcctggggctctccagggtctcggccaacagtcctgtggacagcccggaaaggcctgcctgcctggcccgcccagcctctcagcggaaaacaaaggcgcttcagacccggctggcttctgtcctgcctgggaggcactgtgagggcgagggtccagaatcctgcccaccctcacaccaggctgcccccgcagctcatacctgagtagaacccaggctgggatgtcggagcacattgaggaggccaccccagagcccatgcagccagggtgggcagctggttttcttctgagccattagacccaatcgattctgtgttcccaactcggacccgtaatgtgtggccattgacccacccagtgggtctgagggccagttccctgcccccacttggcccacgtcccagagctggccagagcacagtgctggcagccctgggctgcagctgccacggccgatagccaccgagacttccttgctgctgctgggacacgcctgcccaccgtgcagccagcccctgcctgccctggtgtgtcccagcttccttgagtggagtggttctggtcagagggctctaagctggtgcagccttgtggttgggctggtgtcctggaggctggccctggccatgcccagagggttgtaccagggccacggagagccagtattcacagccctctacctagtaggccacctgggggatcccatctcactgccaggagcagcacccttgggcctctcagagtgggcttcgccctagccagatgcccctccccgatatctgccagacaaagggggctgggccacttgctgagaaagggagctgggagagccactggtcctcggccacctgaggggcttggccagattctgccgggcagggtgggcccagcctgcatgctccctccccccagggcctgcagcttgtccccttcccttcagaattccggctctgctgggcccttcctgcccctccccacctcttcctgcctggctccctagggaggcccctgcttccatccactgggaagcagtccagtagccccagtgtgggggtgggaggcagtggcagagggtcccggaccctcagcagctgccctcagatcttccatgccagtggcagccaggggcattacggcggggggagagctcagggtttaggacgaggaatccacagacagatgagggtcccgcctggaggacccacggggacggggcctggccttcccatgagggagctggaggttctggggctgcacctttgactcagcagcggggtgctgccagccccatcagggcccagttggtggggatcaggggcgtgtcagtgcgaggcaggtgtgagagggagagcagcatgtgttgaagcaggtgcactgcagaggcaggtgtgtgagtgtaagagaagtgtttgagggaatgacaggtgggggagatgcatatgtgtggggggaggcaggtgtgtggggggaagcgggtgtgtgtctgaggaagcgggtgtgtgtggggggaagcgggtgtgtggaggcgggcgtgtgggggaggcgggtgtgtgtgtgagaggaaggtgtgtgggaggaggcagatttgtggggggaggcgggcgtgtgggggaggcgggtgtgaggcgggtgtccgggaggcaggtgttggagcgcgggcaggtgttggagcgcgggcaggtgttggagcgcgggcaggtgttggagcgcgggcaggtgttggagcgcgggcaggctcgagcacaggccccttcaccgcaggcactgaggggactaacagggcagccccgggccccttctcaaaggcggctctagcggggttccagggctgggggcgctgagacccagagggagaacagggcctgggggcgacgggctcctccgggtctcagaaggaggggcagggcccgccaggtggaaggaaggcgcctgggagacctcctgaaagtggggacccccggagcgcgtgggggtggtggctgccaggtgggggcggagggggtgcggggcgcgccccggccctgacccccctgccgcccctcccgctcagccgagaaggtgagctccctggggaaggactggcacaagttctgcctcaagtgcgagcgctgcagcaagacgctgacgcccgggggccacgccgaggtgagccccactgcgcggcgcgggcgggggcgggggtcgcgactcccgccaccctcaggcagggtcctgacccgcgcccctctgcgcagcatgacgggaagccgttctgccacaagccgtgctacgccaccctgttcggacccaaaggtgagctccggctgccctcggcctgccctgggacctgctgggaggggcgtggcgctggcgctggggagggctgggggtcccggccgccgtggatccccgcccagagtccctgccaccctggaaagcctagtgccccccagtccccagcgggccgttttctgagatgcccggtggccgcggcccccaccccacgtacccccgccccacgtacccccacccgcaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagaggtgggctgggcgcgggctggggctgggggttgtgggcacgcgcgggctggggctgggggttgtgggcacccccggccccgccccgccctgactcgtgcgccccacagcctccagtgtcaccactttcaccggggagcccaacacgtgcccgcgctgcagcaagaaggtgtacttcggtgagtgcgcgcccgggccccggacccccgcccccgcccccgccccggggctcggcctcactcctccccctttccagctgagaaggtgacgtctctgggcaaggattggcaccggccctgcctgcgctgcgagcgctgcgggaagacactgacccccggcgggcacgcggaggtgaggggagtgcaacggggcttgggggccgggcaggggcgcggggtcggggggatgagggtgagaggcgcgcctagaggggatggggggtggtgcttctgggagctgcgctgccctctcccccacggcgagccggcctgcacgttctggaagcctccaggtgatgggtcgggggagtctgtggactcctccctcagcacccaccttctgccccagcacgacggccagccctactgccacaagccctgctatggaatcctcttcggacccaagggtgagtgtagccagggtggtccacgatgtcttccctgccctccccttccctccactgttcccccgacccaccccagcggcctccctccacaggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttccctccgggatcccctgcctggtgcccacactgcctcgcaagcgctcgccaccctcacgtggctcacctgctgttgagccttgtgctgtcaataaacggtttgaggattgcaggattgtctctgcttgtgggatggatgcaaatcccagaccagggtccctttctccggtccatgcgtgctcccagccaacacccctgggcctggctgctagtgggggtgggctcttctcctgggggtcatagtgggaggtggggccctgggatgtttctgagcaggagggagggatgggggcggggagcgtggtctccggtttgggtggtggtgcccacccagatggggaggcagtaagaacgccaggctgtggggaggtaaggaaggtgggaggcattccggggccagggtcctggccagggtcaggtgagggtggggtccatggaggacagagccttggagaaaagttgaacctagaaccctgaaaataccaacagcaggcctgagaacccggagctgcctgggtgtgtggaccctggcaagcgcaggaggggtccgccctgagagcagagtgtggctgaggagggaagggggccggggaccagaggaggggtcctgggcagagaatggggaagccggcgaaggtcgggtgggacagaggtctctggcagccccagactggactgggatgcgcaggagggtttgggggctctggtcagagcaaggactggagaggctcagcgtggctgtttccagcttttgtccatagggtgatggacaggcttttgtggacaggcctgccttgggtgtggcccagggacagaatccctgcccaagtgttctggtgaaggttttagtgatgaccgactcgcccctggcgtcttcatggtccaggctctgccctttcagccaggggcgctggcggctccaaggagctctcccctcccccgcgccccgcctttgctgtgcgccactcctcgggtgcccactagagggcgcactgtcccattctggcagcacagagcagaaacgtggagaccttccccagtggctgagccctgtcctggcgccatctggacttcccaccttggtttatgctcctctgctcctggcaccacaccgaagttgccttggcccttccttcagtgaggggcactcagacctggccacctccaggcccctgtccccagtgctacagggtggccggggctttacgcctcttccctgctcccagccgttggcacagctccctgcctggccaccctccagcccatgggctcagacggagctgagcctggatgctgagcccattgtcccgagagcagccatccatgtcctggcggggcctgggctggctccggggtccagccgtaccacagctgccctccagccaggcacccagtgcggtctcctcccacctggaattcagccaaaacccccggggcctgacgttgcggaagggacggccagtccccaaccccaggcagaggggaggatcaggcaggttccagacccctgctcacaggagaggctgggatggttccccttctcatcccctcctgccaggcccaggcttccttgtgtgtgttggggggttgtttcgggagaactgagaatttccggagtgcccgtctccgcccttgctgcgggctcccagggttgcatgggaaattcctgctttcagcttggcggggcggggggcgggggggggactggagggctcagctggacccccctcccttgggagcctccagtggaaactatgtcgtgaggagagtggtgggtggtgtgcccttctctaaaacctgggcggcggtgggggatttgtgtgccagaagaccttccagggtcggttgcggggatgatgtgggtaaggggtctcctccagagatcagcccctgaccccgccagggacagcagcacccccgaccccaggtctggctggggcaggaccatttcctgcggggccggtttgaggatgacgcctgcctgccgtgtttgtttccaagtcattgtcatggaaaccggggcggttgttgctactgtttgtctggactgcgtcgctaggcggtgttgctggggttggctgggtgcccacggcactaacagggctcgcttggtgtctccagctccaggaagctatgccctcccagccgcctgccagccaggtgctcccttgggtgcccacagacccagatatcccctaaaagggaggggaatctggaatgggctcttctgcctttgggcgtgcctgcttctctgtccctgccttgggggctgctctgccctcaaccttcactctcttctacttggacctatgcctggccagtgaggcggctctgaaatgctatctgctccatccctccccttcagaacccctgggaaccaagtccagggatccacaaggccctggtgccccatggggctaagctcacaccccggcgctctgttgaaccgagctgtgccgctccccgtctgtacccccactgtccagtcttcccgtgtctcctggccaggtccctccaaggtatcccccactccaacctgggctggtggggccctcactggtgcccccagccaggcatctttgtggggccagctcagcctgcagctacccctgtctccacttcttctggcccctgcccgggacccccagcacccttcctccaggccctgcccagccagtgaccgcagcatcggccctgggtacccctgctcccagggtcttccctaattcctggaccccttcggactccacacagctgggactagcgcccctgaccctgaccctccacaggacttggtggggcacacctccctcccggccctgggtccagcttattgggggccggcggtagcctgagaggtggatgtgaggaaatcacccagtgccgtgggcccctagctctggaccgtggagggctgggcacaggcaagggcaggctggaggaccaggacggccaggtatgggcagcacttttcccagcgcctgatgggcttccggtggggatgtggggtccagctgccaggcggggaggctggaattccagcctctggaattcctgggctatggctgtaggatgctgggtactaggcccagcctcaagagaggggagggaggtcaggggcaccccatctggccagtctgtggaagccaggcaggggtgcagccccgctgggggcagggctggctgagggagcccccttcttccctctttccacaccttgccacgtctgctctgggagaggaggaactgcgcagccttcccacctgctcggggctggaggtgaggcctggaggacaggaggtgcctgtctggtaagcctgtcccatgccagccccatgccaggtctgcccagggcaggaatggccactgagcccagcacggccaaccggggccagaccacaggccagacagggggtcccgggagacaagcagctgaaaatagaccctgggaacttgggagtgtctgagactcagctgggccgagagggaggggcagggaggtgggccctggggaggcctgagctgggcgtggccggctccgcgctgtcctggcatgcatgttggcagtgcagggcacctggttgcagagcatccaggacaggcctggctggcctgcagccccgggagggcacctcacacctgcccacactctcagcctgggcatggggcaaggggaggtggtggggagggctccaaggacaaggaggggcatctcaaggcaagtccccaagctgagtctgcagaggaaggggctgtgggcccagaggagcaaaatgttcctagaggggtggacggtgggattcctcagggacagtggggcccagccctgcctcctgggttaccctggttcctggagcccaggcctggctgcaggctgccgcaccccagcccctgtgggcttcagccagagggccagcaggagcaggccagggcgcagggatgtgtgcagagggcgggctgagcagacagaggcggcctccaagatgcacccggaacactgcagcagcccccgccacccccgggtctagggccctcttgctgtccaggtgcagggtggaatgttctgggcatagaggcagcctggggcgagcagctgcggagctccgagtccctgccccgaccactctgtcctctgtttgttcctgaaacaaatgccaccagcaccctgcagagtgggctgagaggtacaggggctggggtttccagccagcccagtgggcctgagtcaggctggccccatggacgaggtcagtgccctgtcctaggtgcatccccggccaggtgagagctgacaaagcctgaggcctagtgactgggctggggctggtcgggggcagtgtgtcccggaagccggcaggaccctgacctgctcagatggaggtgggcgttgggggtgggatggcctgaacacggagtgtgggtggagaaaggagctggaagctggggtcctgcagctgatgaggggtccccacccccagagcacagggtagatggggagcacaggagaaagggggtctgaggggcatgtcagtctgtggctgaagtttaggaagggttccagggatcgtgtgtatgtgactgtgtgtgtgtctctgtgttatgtctgtgtcagtgagggtgtgcgtgtgtatctgtgcatgtgtctgtgtgtatctgtgagtgtgggtgtctgagttgagtggaaaaactgctgtgagccaacacagaaggcgtggccccacggcgagggcatcctgccccccaccccacccgtgaccatggtgacaggaagcaacagcagggaaggccaggaatggactcatcaccctggttttcaaggaggggctcctccatgggcagggtgggttggagtccagagtgtgggggaagggaccatccctgggggcgggtagaggggaggacaaggactgggtcattgtccctatctgccctggctaatgtccgtacatgagctgcaaggtaccgggccaggagctgggatgggctggggaggaggcttgacagaaatatgggcggacaactgcgagagggaccacacacatgctcgcggggaccccagagacccctgatggacacacccatacgggtatgtccacgggcaccaggcacacacgtgtgcatcaggcacttgccctgcacctctgcacccggagcacgtcatcctggtgggggtgtggacagcggtgctgggcaccctggggcttgggggcagcgcacgccccagggaaagtgcagtgacagagcccccggcctccccaatactgtccgggctcccctggcctctcccccttcttggtgcctctgcctctccctctgcttgtctgcaggtttgtcccacgatgccccacactcagtggagatggcaggtgggcccagacctcagagtgggtttcaaggctcatgggctggagagtgggggttccaagtttgcaggacaggagcgcacccctactctggaaaccttatctctgaggtctcagaatgggggatgaggagggctccaatgggcccctgtggaatgtcctatcagaccccaggacttagccccagtcgggggacagaactgtggccttagaggggcgccaggaggagggcaagcaggatgtggccttgggctgggtgtgctggtgtggggctctctggagtgtggcctctgtgccagacgcctgtgccttggccgtcctacagccctgctgcccctgccctctccccaagctggggactggtggcagacagggcagggcaggcggcttctcttcctctaagtgcaggcctcgaggtgccgacaggggtgcggtaggattcagggaaagtgaggttgggatcacaggtgcagttagggctcagggcccgacagcggtaggccagcggctcctggggcccaggaggatggtctccagcgcccccagcggggacagggccagcacaggcccagtggagatcgaggggagataaggacgctggttaacatggctgacaggagggatggtgggtggggaggaagggcagcaccgcccttgtgctgtgggagctcccagggagctccatgcagcatggaggtgaagggcctgcagagagagggctcccctgctcagtgacaggagagggggctgacagtgacctgggctcccttcctgaggctggccagtcagctagagggctgaccccaaagcccgaggccagcgcagcccccttggccctcctgaatctggggggcgggtgaggcgggacagactccgcctggcaccgggaccatcctccgcctcaactttgcagcgtacttggaccgctctggccgccctgggcgctacccgcagagataagggcccctccctgcgcccggtccgggcatctccgagccggcctgggggtggctgaactctcttttgccggccgaaaccccagcccccgcagcccccgcagccgatcggtcctcaagctacagctcccctctctgggagtccccgcttttgaattccccggggatgttcccgctgcggtccgatggacctcccagagcagcggaggtcaggggagctagcagaggcggggacgtcccttgggagtgaggggactgacaggggcggcctcgtaaccctgcgtgggatggaaggtcagagtgggttcctcggtggggggcaacagcgggggctctccggcaattgtccccgaccctccgtcctggggagggcaggatcagcgcgcgggctgctttgcatctctttgcattttagtgatgtttggtccagtcctggcccgggcagatctggggttcgggcgggtgccggtggggtagggctgggggtgggagcggcgtttcctgctgcgggtgagccttttgcctcggaactggacccgggagacatcacagcgctgggctaggggcgcggcttgaactcgcctaaagagctgcgccctctcagtaagtccccatggccccctgcccccccgcgctccgtcctcagtcaggcccgggtcctgcctgaaggcgggggtggaccagatgatctttcttgggccctgggcctagattcgaggtccccagggtccaagtcctgggttcagagggcggggcgcgaggggcggggtctccaaggggcggggtcccggggtccctgaaaggcgcggaccaggccggatccacccagtctcgcgcctgcagcccgtgccgccccagccgctgccgcctgcaccggacccggagccgtcatgcccaagtgtcccaagtgcaacaaggaggtgtacttcggtgagcgcgcccacaccggccccgcgaggaggcgccgccgacggggcgacgaggctggggaccgctcaggaggaccgggggcgctgggtccctggggcggcgccccagcctgaaaacgcctcagcctggcccgccgcctgccccgggatgagggtggaggcccctgcgtccgagggccctggcgatctctgcctgctagtggtcttgctgtgctcggcgggctacctctggctctgagcctccccgtctctgggtcctacggtctctgccgtttcctctcaggcgcgccctgagtgggggacccgcagggctggaaggaacgcggggctggggccgcgccccccagcgctaagtggaaacagacgcggaaaccgacgcccggggcgcgatcccgggcgcccgcctccctgccccgcgcccgcgcgccccgaggggagggaggaagtgggaagtcacccctgtccccgccgagaagggctgtcgcaggctccacccttgccaccgcagaggcccggggctgaaagcaggcagccaggcccaggccctgctgacctaagccgcgacccctgaccctcggcctcgccctctagccccacccagccttcaggagcaagattcccggccgcacccgaaagtgccccggggaccagcgaccccgcgctttgtttagttgtattggctctggggattggagatgttcccctcatggagggtgctgagaccttagggtgggctgccaggctgggcggatgcgggctaagtgcacagggccttgggcagagctggctgcaagaggcgggtacgccagtggtgggtaggcgccgcgtcctgcagcgtctcaccggggcctgtctgtgcctctgcagccgagagggtgacctctctgggcaaggactggcatcggccctgcctgaagtgcgagaaatgtgggaagacgctgacctctgggggccacgctgaggtaggtgggacccaccctggtggcaggggccaggggtgatggcaccccctcacggcccttctctttgcagcacgaaggcaaaccctactgcaaccacccctgctacgcagccatgtttgggcctaaaggtatgctcccgtcatccccaccccaccccaccccacagcctcctccaccccagcctgttgactttttccaccttctctgcaggctttgggcggggcggagccgagagccacactttcaagtaaaccaggtaggtaggaccccaccccctatcctgcctcctggttccaccctcgggatggggatgccccctcccagggaggcctgaccactcgtgggccccaaaggaggccgtggacgctgcactcacgtctgtgcctgtctctctctgcacaggtggtggagaccccatccttggctgcttgcagggccactgtccaggcaaatgccaggccttgtccccagatgcccagggctcccttgttgcccctaatgctctcagtaaacctgaacacttggaaaacctgtgtgtgtacatgcgcgtgtgtgctggggagtgccaagggagctgcagtggggtcctggcagcaggctctgccaccggcgcctgctcttctgctgcccattgccctccccagggggccgttccagggtctcataggcgagggctccctgtgcagggtgagtccaggccaccctagacagcccgcacccagccctggcactctgagtccgcctcgacaactcccagatcctcagaagtgcctctgagccctcctggccttctgggagtggggaaggggggctttgcaggccaccagccaaaggctcagcaggccgagaggcctgggggcgggcgaggctggcctcgggtcagagggtgaatcagctcatgctggctccctttctgagaggctctgggggagttatgggaactcctggccttcctcctttccaccccccaaccctgtcctcattccccacccctccaggccaggcccagcttctgcaagggcctgatgaggctgctctgcccctgacccaggcaccactgccccatgtgcgtcctcatctgccatctaccctgtgcccagggacttacccagtggcccggcgtccagtggggaacttgagtaccggccgtgcacaggggctggggggccttctggaaactcccttgtcaactcagccagccgctgctgactggccaccttcagagaccctcttccccacactggctacttagataccggccttggcagaaggccacccctccggacacccactggtttaaaagagcccaggggtctggccctgccttagggctgtggtgggtgtgctgcaggctcagctcgacaggtgctgtgggggcagtctagggtggcccgcagggtggggtgtgtgggggtgattgggggattcctggaattccaagagctgggagccacagcacttttgatgggatgggggcagggggtgctgaggtgaggctggtttctggctggacggtggtgggtggagctgagggaactgagatctttgagacagcgacacctggtgcagagaaaaatccgcaagctcgggggttgggagagcgctgaacaaggccgcagagctgctccgccatctcccccacgcctcctgccaagttctgtggcgccgcggttccccacctcctgctcccatccccctggctcccgccgccctgtagctcggcaggtgcagtaggcgctccgaggaggaggccccttagcttcaagaaacccgcgtgggcggggtgaggagcgcagtcctcctactggcgccgtgaaggagatcgcgatgcgccggagggaaggaggctgcgggcggggaaggacggagggcgtgcggggagggagaggaggggcttgctggggggggggccccgaggcggggccgggagggccgcctggaagaggaggtcgggggcgaaggaggccgagaagaaaggtggggccgggacccctcgggctgcgcctctcgtgggcgtgtccagccagggctgggggtccagggaggactgagtttccctctcccgccgtcctcgcagccccgggaggtgcaggggcatcgcgggaacagccccggtgacacgctgcccggggtcttcacgaatgcccggaggcgccgctggccagaagccagcccgaccttccatccccgcagacagccccacgttcctcccggcccgcgtctttcggggccgcccgtgcaggcgggcccggctcagcggcgcccgggcagcagctgcttccatgcgccggcttcctccggggctgctccgtggcggcggcagagggaagcgctgccgcgggcgggcgaggatcgggagcgcctgaggaggctgccgcgggctccggctgcgcgttcggggcgggggagctgcccgggacttcgcgccaggggccaggggccggccgcgctggggtctgcgctgtgcggcgcggcgggctctgggcgcctcctggcggcccagcctggaaggcggcgcgatggggcgaggctcgtccgctccgactgcgtaagcggccccacagggcgccttccggagtctgcgcgctcccgcccggcggttgctaggttgccaaggggcgtgaggcgctgatgggtggggtctgagcgaggcggggtgtcgggtgtcgtgacgattgagcctgcaagggcggactctgcggtgttctccatatcaacagccctgccaggagcccggaagtgggtccgcacgagacagaatagactacactcaaactccaggggaaccgttcattgggcttggacacgaaggcgggaccctgccgacgcagtgattggatgcatgtccggccagcgcggtgattgggtacaggtctcgggagcgcggtgattgggtacaggtctcggccagcgcggtgattgggcgcaggtcccagccggcgcggtgattgggcgctggacccggcccgtgccatgattgggctcaggttccagccggagcggtaactgggcgcaggtcccagccgccgcactaaacccggcccgtgcggtgattggacgcaggccccgggccgcggcggaggcgggcgatccgaaagaggctggtgctggctgcatggggaggcggcggcagcgggtggaccccgcggctggggcccgggccggggccctgcctgaggccatcgccgcgttgagtcggtcgctgccctcgggacccagccccgagatcttccgccgcgccaagttcgaccgtccggaggcggtgacgctctcgcggagggcaggcgggccgggtggggtcccgggccctcgcagggagttgggccggctccgctgaccgcccgctttttattttccgcagacctccgcgctctggcagctcctcttccgtgtgctctcgccactccctgcgggcaacgccttggcatcgctcgccctgggtaagccccgctcctggccccgcccacccggtagcactggccccgcctactcctgtaaagccccgccttccccagtaagccccgccccggcaggctctagcccccacccaacactgaccccgcttgctcctcaaaactccgccttccccggtaagccacgccccctgatgggccctagctccacccccttgggtagcactggcttctgctcctacaaagccctggggacgtccctgttggcccctggtctcctcatcctggtctgagttctagctctcccactatcatctcttctgaactaggccttgagcttctgctcaagtgacctgtgggggtctctggagggatccaggtggtgtcacctccaggtgggtggtccccctaaggtggtggtcttctgtcctagaggtccaagcccgcttggtgaagtcagcactatgctcccagggctacccgaggctggcactggcacaactacctgaggatggctcgcagggcagtcgggagctgctgctggctctgtcctggctcttggcccgaggacctgtgcccgagcagatgctggcccaggcccgagtgcctctgggtgacgagatgactgtgtgccaggtgcgtgtgggtgagggtgagctgagccagccctggtctcaactcctggggccagagcaagggcaggcctgggtcagccccctctgtctgctttgctcctcagggcagtcccatgaagggttacccagctgcccagctgaaagcacggaggctccctgtgcagggagcacccgttgtttttggctgtgcctccactaccgtctccatcctggccttttctggggggcagggtggggtgggagcagggcctgacccttgcccctctccagtgtgaggccctggccagccctggcccacctgcaccccacatggaagcagagggtcctgtggatgtccgccatgtgcagtggctgatgggaaagctgcggttccggtggcgccagctggtgtccagtcagcaggagcagtgcgccctcctgagcaaggtagagctggcacagggcttccactcaggggctgtgtcccgtgctgcaggccgccagctgccagtccctgcagcccgtcccgtgaggcctggcacaggcttttggctggatgtgggccttcctgccctggcttacccaaagcctgagcccgtggttcccggtggtccttgtagggggcagggctgggcagggagcccagtggggtgggcaatggtgggcagaaacgggtgtcagagagctcacagaatttgcctttctgttcccaaaagttaccagtggacttccagctctgtgaacagtgggatggggtctgtgccatgaaagccactccctcctgggcactggagggggaggaagacagctcctgttgccaccacatcctggtgggggctgacttgcggggtggacagctcctgtggggtcctgaaggtggcaggggctggctcaggggcacaggtacccagtggtgtgtccactgtgaggccagcgctgacaggtgggtctgtggcagcggcgggctcccaccagcgcgggactccttggagacccccccatcccacccttgcagagggtctgttgctcagctggcctttccagggacctctcaccccgtcgggcctggccttggcaccagctgctccgcttacttatgtgcctacctgtgaccctctgtgccaccttccagcctcccttttttggggagccttccccatttccctagatccaagcagtcgttcatgtccccactgtgagcctggctgaactgctgtgcctgtccagaggctgttcctcccccgatgctgctggggaagccagggcaccccactccaatcttgctgctgcttggaagctgggcggggtggggaggccatcagtgaaattgcctggcgcccccttgcaggagaccccagcggtgctgatggttgttctgcacccagcccagccccgccaacctcaggcaaggagtggctttctctgagccctctttcctcatctgggaggtgggctctgatggccgacctccctggactcatggagactcagcgttgggggaggtgcttgactgccactcagcctggggtctgcactacctgttttagatccacctgtacacacgcggctgccacagcgaccagagccttagccatctgtctgtcactgaagcagagatgctcagggacccagagggaggccagcaggtgagggcgggcaagctgctgcgggggggtgggggtgggctggggggcacagcagggggactgcccagggtgggaggggcctgggggcggggcagctcttgggcctccagcggtgggtgtctctgcatgtctgccactgatcattgccagcctgggtgacagacagcttctctgggcctctcctagcctcatgggccactcacccttcccttccacaaatcaagacgtggcacgggtgggggcccaggacgcaggagcctgggctgggcaggcagctggctaagggcaggctgttggaataaaggaacacagatctcaggtgtgagctggtggtgttggcatctcaagcaggtctcacttggtgtgtcagggggcacctaggggtgtggggggccagcccacactgggtgaagggttgggcacagggctgactgtgggaggggacaactgcccttcagaacccaaggccaggcccacatggggtgtgctggaccgagcctcccaagctggagccagctccataggccctggagacttgcagtcccgttctgcttgctacacccggaccacccgggggcacggcgctttctaggcaggcctgcccccggcgaccggggctctgtggtcccaggcagatcctgagccctggatagcatagacctggaggaaaacctgcctctgagccccaggtggctgtgtgaccttggggagacagcatcctcctctgactggggctgctggagcactgacccaagtgttagggttgacctagccccaggcatcttccccagggatggccgcttcctcgcaccctgctgctggccttccatcctcatccttctttctgggggtctgcccgcccgtcatcactggcttcttcctcttggctggcttggtttcaggggatagggcagggctggctgccactcttttaatttattttatttatttatttgagacagagtctcgctgtgtcgcccaggctggcatgcagtggcacagtcttggctcactgcaacctccgtctcctgggttcaagcgattttcctatctcaacctcctgagtagctgggactacaggcacctgtcaccacgtccggctaatttttttgtatttttagtagagacggggttttgccacgttggccaggctggtctcgaactcctgacctctggtgatccacctgcctcgacctcccagagtgctgggattacaggcgtgagccaaccacttgggctgggctctgtactgtcctgagtgacgggctggcactgtcctgctccaggtgcatatggccgggcaggagggcagaggctcagggctggtgtgacctcttcttccagacccagtcccccttctctgcctcttccctctccaatcccagagacttggcccctgtacctcatcccaggcctgcccagggggacctaggggtcagaggcggatggcctggctcctggcccctagtcttgtgtctgctggggcttcctgctcgtagcaagggcctgtgggttccagctctgcagcccaagcctgggggattgcatgcctcactcatgggcttacagggcccaacccctgacgcctgcctggcccctggtgccagctggacctgtgtccctggctgaagccgggctggcgcccacccagtcagcctgcactggcgttggcagtgctgaggcagcatccgggcgtcctggtctgcccttgtccctacctgccttgtagaggcggctcagcgaagcccaggcttctggcccctgggacccctgggttggggcagaggagaggctgccctggccccaggctgctcctgcccagtgcctctgtgggaccaccctctgtggtgggctgggggggcctggaagtgaggccccgccctctccccgaagctgtgtgcggcactggccaggtggactggggccatggctggcttccttccaaggtttctggagcgggagctgcccaaaacctggacctggcctacccaaagtgcctgcactccttctgcactcctgggatgggtcccagaaccttctggaatgatctgtggctggtatgtgagcagccaggtctgctgccgggtgactgggcagcacccttggatcctggtggggcctcagcctgcagcctgctctccccttttagggcggtaagtcggggaggctggcagggaagtggagaccgcaggacttgggggtgggtgggagggggtggcgagggggtgtgtttgctcctcctctcctgcctgctcccacccctggcccttaccttcttgggaactgtggtgattgccttctgtcaggtgtgttgaagcggccgtacccatggtggaggcctttgctcttcttgtggcgtgctggggtgggcaggtgggctgcagccccggcaccagcctgctccagctcccacaccgcccacagacctccctgtcctcatattctctgaccgcaggcctgcctgcctctgctctgctccgccccagaggggctgggttggacctggtgttcaaggccattcctatctgccccccagcccactgctggagccccaggcccctgcagcctgctccacactctgggttcccgggggaagcaggggtagagtggggcaggattcaggtgtagagggcctgtccccagcaggggtccccttgccccgggcccagggtcactggtacagatagcccatgagcgaacctgggaggccttccgtgtgtgggcagagcagctgctgtgtcctggccattctccagccgcctgtctgtgggcactgtgggcaggtacctttgtgcagggccatggggcaggcagggcggggtctcctggccctgcctgacccttcacttgggaatgtcaagtgtggctcagctctgccttctctgccacctgggtcactaggcagactcctcactgccttagggggtccctgaagttacaggggatgggttttccctcccccagagcctggcttgctccttcgtttggggcctccccgtccgcctgcagtccccggatacagcccgcattcagtgagggctgtggggcagaggtctaggcttgagaggcacctggacctgtccctgaccttgttggactggcagtggggctggtgtgggggacagcggatgtcctcagagccggggggcagctcttgcctggcaggcagggcctggccgtgcactggttgggggctgccctgcactgcagaaaggacaggtgggctgtggcgtccgcaccacaccagggtgccctgctcatcgctctggccagagaacctgggcgcaggcaggggagggctgcaggggcggggcgtgagctaggcgttgggccgggtgtcggcgctgggtccagctgtccatccgactgtctgtccatggggtcccgtgtgaggttctaggccagctgccgtttgccttccagctgctgcggactctggagcgtgagaaccagcgcctggaggctgtcctggcgtggcggcgctctgagctggtcttctggcggtggatggtgaggaagcccgcgcatccctctcccggcatcccttcccacagcagcccccaggtggggcattcgggatcttcctgttttccagacaggaagaggggcttttagggaggccacagacctagtgtaggctctttctaggacttccactcgccttctggggaggctcactgctgcccccgccctcagctccatggccttctagagtgtggcctttgtgcctccctggacgtcacagttgctgagatggtggcatccagcccgctgtgggacctgggggactaccactgccctctttgccctctgtccctctgtccccttggcttggtgcacgctgtctcacttgggtctctgtaggacacggtcctgggcacctgtgccccggaggtgcctgctgcagcctcacagcccaccttcctgccctgggtccccgagcgcgggggtggcgagttggacctggtagtgcgggagctgcaggcactggaggaggagctgcgggaggctgcggagcgcaggcgggcggcctgggaggccaaggtgagtgccagcctcgctctgggcaccagcccagccccaccttcgggggatggctgacctgagggcactttggacttgctgaatcctacagttgcatttgtcaagcatggcaggggacacacttagaggcacgtaccctgagggagcgggagggcacctggtgaggagccgcagctgctgcgagacagcccccgcccctcctgcgggaggtctgttgtctgattctttgcatgagggagggaagcccgtgctgtgtgggccctgctgctcccatgcgtccgccacacatgcatcacacggtagtagtcactcctccacacctgcctgggacccgtctaacctcctggtggccacctgggcctccaccctagactcagagctgcccgcttaacctgcgcaggttcatggctgtgaacacggggctgtgttggctccatctattttctttttctgaagagttttaacttaaattgcaggcatgattttccccttaaaattttcagtaagcctctctgaagagcatgggcgtttcccgcatgcctgcagcgcctgcacctgagtctgggctcagggaatgctcagggagcctgaggccagtgtcctggggggacagagccattgccattgtgtcccacgcaggctggaggctgtggacgggggccagagtggagtgccgcgcggcgggcctctcgggaggctgtggaaaaggagctgggagctctacagcagtgctgggagcgagacggtggcccggcccagccccatgggccacaccggctggtgagacgagaggatggggcagcaggggaccgggacctgcgggcagctgtggtgatcaggacgctgaggagccaggaggcctgcctggaggcggtgctacgtcgactacagggacagtgtcggcaggaactggccaggctggtgggagcccgccctggtctcatctggatcccgccacctggacgctgagggcctgtcgacgggccctcgtgtgggaagcctgccctggcccagcctggctgggtcttggaggagcagattccaaggccaggtggccgcagggacgatgcagatgcagagcccacgtcacatgctcgctccaggggtggggctgggctgactctggccggatcccaggcctgtggctagcagcactggggacaggaatggctggtcccttgaggaggtcgtgacaggctcagcctggtggtctggaggggactcggaaataaattgtagcagctttcctgccgctggccctccccctgccaccctgtcgggtttccctgtttgggggtgggagcgtggaggagcccctgggcagtggtggccagtgtagggctggccaggtgctggaggacatgcataccccagcactggtgagtggcaggaccacggggaggtggcacaggcctccctggagcgggattatctcggccccgccccccttcatttgggctcccgctgtgggcctggccctgggctgtgagcacagctgcccccacctccggccaaggctgtgcctggtgggtgcgccggatgggagcccggggctctgctccttcccgggaggtggtgctccgggtggggaggcacagcatggacagaggggctttgttccagaggctgctcagcaagctcagctcatccctgacaaagagccatctgtgtccgggggacgtgcctcagcctggcggaaggagggtcggcctcatggcaccccccccgccccccaccagcagacacaggtggccctgaggcctccagccctgcctgccttgccgggctcccctctcttctggggctgtcggactctgacctgaggtgggcagacgatggggcttgtggggccacctccaggctcctgccggccctgccccgaggccacgtccattccccctgccagaacatgctctcactggggcatgtgcctgagtgacagcacacacctggggctccagctccagtctcagcctgtctgggcctccttggtcccaggggtggacacgcctagaccgcctgccttcccattccggtgcatgggacccaggagcaccggcaagacctggccgtggccagcaaggcctccctttcaggagcacctctctgaccctctcatgcagctgggcctcctgtgggccaccaggatttgtgcaaatgctccctggcctgcgccaccctccggcccctccgccagctcctcctaagggctcctgccacctccacctgctggttccagctctgttccaggccctcagacctcaaccctcctccacctgcagcctctgaaagtcccccgtgctctcagcaaccctcgactgccggacagggctcttcttgggctgggagcaagtccacttgaagccctgctttttataaactgccacagaaccaggactctcacgggcctgggggacttgatttttacgagcacaaaagcaggcttattgtcatggagttgtcacctctcgatgtgatgcgtgaattcagggcagtccaagtcctgggtgcgcgtgtgcccccatgatgctggcggtggagagggcctgagaggccagggcctgcgggagggaagccggcagggtgccctagtgctgcccgtcatgatggagcagggatgggaccctggccttcagctctagttgttatcacacatgcagtggctcgagtcgcctgaagtcacgccctcttgttctgtgggtcgggggttgccagtccacagggttaaagctggatgggcaggcagggctgtgtggcccccagctcagagcaggcatggaggtcctcacaacactgcctctctgacactctcctgcctccctcccctgccttcaggagcccgagtcatcctcaagacccccatcccctctgtccccatagacttcctgtcttaaggccagctgcagcttttcccttctgtcttgcgacctgccccagacccacggaacagcctggaggcccacggtgtcggcctggctggggcagtagggccctgcaccctggacgagccagcatctgtgtaaggacagtgcagtttgcttcccaggaagacagaggcgaagatggcctcacaggaaacagcagaggtcacctggcgcgtgagaccaagtgcgcttactggaaggtgcaataaacttcaacaaaactagaaatttttttttttttaagacagagtcttgctcttgtcacccaggctggagtacagtggcgcagtttcggctcactgcaacctccgcctcccgggttcaagcgattctcctgcctcagccttctgagtagctgggattacagcagtgcgccaccatgcccggccaatttttgtatttttagtagagatggggtttcatcgtattggtcaggctggtcttgaactcctgacctcaggtgatccacccgcctcggcctcccaaagtgctgggattacaggcatgaaccactgtgcccggccaaaactaatgtttattaagaggtggtgcagctggatgcagtggctcatgcctgtaatcccagcgctttgggaggcctggatgggaggattgcatgagcctgggagatcaagaccagcctgggcaacatagggaggccccaccactacaaaaaataaaaaaagcagctgggtgtagtggcatgtgcctgtagtcccagctacatagaagggaggccgagacaggaggatcgcttgagcctggagaccaaggctatgaggccaagtgagctatgatcttgttactgcactccagcctgggcaacagagtgagaccctatatgaaaaagaaaaaacgattaatgagatggaagtgcagtgtctcatacgcttgcctattctgttccggctggctcagccttcctggcctctgcttccctttctgcactacttcagggctccttcacctggtcctggctgaccctgccttgagggatgaggctggttgggactccggccaggtcaggatcacaacctctggggcctgtggtggtcgcacctccccctggagcccagggaatgtgtcctacggcctctgaagtcccgccttggttggacaggagggtttctcttttttttttttttttttttgagacaagatgttgctctgtcactcagtggcacagtcagctcactgcagcctccatcttccaggatcaagtcatcctcccacctcagcctcctgagtggctgggactgcagccttgatcttccgggatcaagtcatcctcccacctcagcctcctgagtggctgggactgcagcctcgatcttccgggatcaactaatcctcccatctcagcctcctgagtggctgagactacaggcgcgtgccaccatgcccagctaatttttgtattttcatttttagtagacgcagggtttcaccatgccgcccaggctggtcccaaactcctgggctcaagtgatctgcctgcctctacctcccaaagtgccgggattacaggcgtaggccaccgctcctggcaggagagaagtgtttctgagtggttcctgtttatctcatggggaccctgaccgctcagtccacactgcccttgtctaccccatggccttgggtgtggttgtggctggtggctctgaagtcctgcgcctgggctcagcctccagctgtctgtccctgcgtgtgagcctgcattggctctgcagccatccctgtcctcagagtggtcggagggtgtcctgcccggcctctcgctgccctgcctggctgtgctgggctggtccctcagtcattctacctgaagtcacgtggtgcccaatatgtgccattctgaggggccccatggccatgtcccagagggaagagcaaacaccatagaggaaagtgctcacagctggaggacatgggtgcccgccggggctcagccccaaggggggcacaagctgagagtaggcagggcccaggcttctgcccccatccgctggtggggaggttctgtggctcagaggaggtgggtttggaggacagctggactaggtgggttctggcccactggggcacaggattggccgctgtcttggttgcgggtgtgatgtagggagctgtggtggctgggcccatggtggtttgagaactgggcaggctggggtgggcactgctgcttggtagcccggctctgacctgctcacaatcttggcatcttagtgggtgtcaggtgggcagttggctgcgtgaacctggaatttggggctggagaatggaatgtgagaatgcagggtgtgggtgggctcagccggggtgggaggcagggcagggcagggcagggccccagggtgcggtgggcccggggctggtgaggggcccggggctggtgaggggcctggggctggtgaggggcctgggtctgaggcctgagcctgggcctgcacagtggtaggaagcacaggcagggcagaggggatggctggcaagtgggggtgcggtcaagttgggggtcttggtggccaagtaaagacagtgcttccggacggaggggcttatcacctgtgctgctgagggacagggccgggggctgaagatcacgcttggagtgggggctacacacctgacagagggggatgaggggggccacggaggaggacaccagggctgtgctctcaccaggtctccagggtcttgccataaactgcagcgaagacataggatgctggctgcagaggtttgggctgcagcctcctaaatgtggggcctgtatctttttaaaatgagcctaggatttgttgtaatcagggagggtaacacacagacgcaggaatgaccgtcttgtaggaagaaagttcttttatccacagagagtgggggctgctccacgcagctgggtggtcggggcacaggaatgggcaagacgtcagcatcaaaactacagaaaaagacgcgcttagtgaggtggtacaacagctaccacgacctcagctaataaaaaaatgtgggccttgaagtgggggacccatggcttgtcacgctggtgggaggcaccgggcttggggaggcactgggctggagggggcgccgggctggtgggggcgccaggctggagaggacacccagctggcgggggtgccgggctggtgggggatgttgggcgggcagagccctgggctggtgggggcgctgggccggttggggtatcggaggggaccgccaggctggaggggggggcgccaggctggagggggcactgggctggtggggtgctggggtggaggagctctgggctggtgggggcgcctggctagaggggacgctgggctggtgatgccccgggctggtggagccctgggaggtgggggtgcctggctggaggggatgccaggctggtggggccctggcatgaagctggcattgtgatcagagtgtgctccagtgacttggaaagcagacacaccactgccagccctgtagtttcagggaagagggaggaaaaggcctggatgttactggcgagggccgtgtgcacctggccccacgtcgcccctaggagatgggctggggcgaggccttgccggcatgagagcagaaccaaagggcagtagagagggagggagttcggggccttgcctgtgggaaaaacctgctgctcctgagcccagagtacaggaagttcaagagccgtttagccacgaagtcctattaatttaacatccctccgttaactgaagggccaggaccttgctgtgaacgtcctcctagggcgtggctgtcgacagtgagggacagaactgctagatgagcagctaggtgggaggctgcggggcactggcgagatgcctacttttttttttgtttttttttgagacagagtctcgctctgtcgcccaggctggagtgcagtggcgtgatctcggctcactgcaacctccacctcctgggttcaaaggattctcctgcctcagcctcttgagtagctgggactacagatgcgtgccaccatgcccggctgctttttgtatttttaacagagacgggatttcaccgtgttagccaggctggtctcaatctcctgacctcgtgatccgcccgcctcgacctcccaaagtgctgggattacgggcgtgagccactgtgcctggccccactgctggtttttgatagaatcaagttgctaaagagacgtgagcctggctgcagaaggcctgggccccaggactgcaccagcaggaagagactttgggaaaagccagcccaggagggcggacaccctaacgcttatcccgaaggagagggaccagcaggcccatcccgggaagtaaagccagcaccctgggcccgtggacgaggggtcttagctgagagcgcaacgcgtgtgggccagggtctcctccgaggacggcctcactggtgccctttatggatggggccttctactgagcggccctgccaggcgtcacccttgtacccgggggccaggtgggcaggcggctcttgtccggcatgtaatggagaaactgcagcccttgcagatcctggagtgtgcaggaactagtggaatgtggcagccactgccagcccctccctccagtcacttcttggggtctgtttgtgacagcagctggcattgtcctaactcagggattcctgcactttctcagttcatggcactcttagtgtcccagtgattctttacagcaccccttgggcgaaagaaaaacccaacagttctgtttgttagggccaaatgccttagtatttatgtcctaacaacttagtagcagttttggggaaaaaaaagtcatataaattgaaaaaaaaacccttaacttaaatattaaaagaattgtaattacttacttatagcatgtctgggtctgttaaggtctgcatgtttttgcaaaccttaattagattggacatcatcatctggatttctgatccacattaatttttgcctggtatttgcttttgctcacagcaactgctgtgaaaccagctttgcaaagagacaccaacgcaaggaaggtgcaacccactgctgaaactctgggctcttttttttgagacggagtctttttttgagacagagtcttgctcagtcgcccaggctggactgcagtggcgcaatcttggctcactgcaagctctgcctcccgggttcacaccattctcctgcctcagcctcccgagtagctgggactacaggcgcccgccaccacgcccggctaattttttttttgtatttttagtaaagtcagggtttcaccatgttagccagggtggtctcgatctcgtgacctcatgatccgcccgcctcggcctcctaaagtgctgggattacaggcatgagccactgcgcctggctgagacggagtccttgctcttgtcccccaagctggagtgcagtggcgcgatctcagctcactgcaacctctacctcccgggttcaaaggattctcttgcctcagcctcccaagtagctgggactacaggcgtgggccaccatgcccggctaatttttgtgtgtgtgtgattttagtagagacggggtttcaccatgttggccaggctggtgtcgaactcctgaccttaggtgatctgcctgcctcggcctctcaaagtgctgggattacaggcgtgagccactgcgcccggcctgggctctcttgaatttttcatgaggtaacggatgtgttgtgtatccctgcatttccctcagaaccttaaaatactttgtagtggccccgaaaacttttgatggcaccctggggtgactcagtttgggaactctcgtcctaactttcctgtgatttcttttttttgagacagagtctcactctgttgcccaggctgaactgcaatggcacgatcttggctcactgcaacctccgacttctgggttcaagtgattctcctgcctcagcctccccagtagctgggattacaggcacccgccatcatgcctggctaatttttgtatttttgtagagatggggtttcaccatgttggccaggctgacctcaagtgatccacccgcctctgcctcccaaaatgttgggattacaagcatgagccaccgcacctggcttcataatttctttccacttagtgttgttgtgttttttgtttgtttgtttgtttttttgagacggagtctcgctctgtcacccaggctggagtgcagtgtcgcgatctcggctcactgtgagctccaactgccggggtcacgccattctcctgcctcaggctcccgagtagctgggactacaggcgcccaccaccacgcccggctaattttttgtatttttagtagagacggggtttcaccgtgttagccaggatggaatgttgttgtgttttaagctccatcctctaaggtgcgcctgcagcgactcactgcttccaactcccgcacacgtccagtggggagcatttaggcaactacccacccactctccacagacaggtacctggctgccccccgctccctgccacacaaaagacgcagctctcaggtgggcccaagggatcaggccacagaaaaggagggcttgtggtccttcccttggtcggggacgtgccgtgactccccgagtggcctttctggcccgtactcctgtctggctcctacctcctgggtcccggccctccctccctcagcgttttctagcgtttgcgggtttgccagcagagcgtcaggtggtctctgcgtctaatttccatctctctgagtattgaccgtgagcatctttcacacacttgcttcgtttctgggtttcctcttctgtgagctgcctggtcataccctttgatcgtttttcttttgggacctgctgtcttttacaaattgagtggcaggaactccttgaaaattcaagatagggatctctcagtggttttacacactataaatagcttctcccattctgtcgtctggttaaagatttgcctatggttacccagaaaattttaactttgctataatcaaattcgtctttttttttttttgactcttggtttcaccttagcattttgtgaaaacgagcttccctctcccagtcctccttctcccagtttccttctgtcacttctccctgtagcacttaggtcttccgttcgtccacagcccacctccgcaggtgctctcatgtcgaaaccagtttttctccatagggtgagccgcttcccaagaccatctcctgggagctctgccctcctcacagtccacgctgtcgctgtcatccacatcggctcctgtccgtgcaggggtcttgccccgacctcccttctgatccagcaggctgttcctcaccaataccacatggcgtgattaccctgcatgtcatcagggttcaagcagagtagccgagccggtgggggctgtgatacataggaagggtggggtgcgtgtgaggctggcatgggggaggctgcgattgtcggggtttacctttgccgtcttgctgacgcacactcagcagccctggtgacagtgggcgtccttgttctcagtctcagagggcaggtgtctaaagtttgtccatgaagtatgacacttgctgggtgctttggccacataacttttttttttattttattttgagataaggtctcctgttgcctaggctggagtgcagtggcccaatcacagcccactgcagcctctgcctcccaggctcaagggatcttcccaactcagcctcctgagtagctgggactacaggtgtgcaccacctcacccagctaatttttgtatttttttgtagagactggggaggcgggtctcaccacgttgcccaggctggtctcgaactcctgggctcaactggtcctcttgcctcggcgtcccaaagtgctgggattgtaggcatgagccactgtgcccagccaatgagttttgactctcttttttttccacgtgaaaagggtccgagtaccacttgtggaaaagaccctgctctcctgccaccctgtgtgccgcttggtaccgccctggtgtccatcttcgtcttgggtcttccttctttccctttgggaagcccacatggtgttcatgactccagccgtctctcgggctccatgtagggcagggagggtgtgttgtccactctcgcctatgtcgggagccctgggactcttctcgacgcctcatatttcatagacattgtagaatccgtttgtcgaatattaggcaaagaactattgggattttacttgggatgacgtggaatccatagatcagtttgagaactgatgtctttagaatgttaatgctggctcttctgccttacaaacacacttctccgtgggttaggtgttcattaatgttttatagtttcctggatataggtattatacttcttttgttagatttgtttctcagtatttggtctttttgaaatattgtaagatatatatatatatcttatatatagatatctcatatatatacacacacacacacccacacccatttcatatttacatttcattttctaactctgttgaaaattgtagaaacccgaaactgatttctgcattttgacctggtttagcgagtcttgctaaactcacttattaatactaaaaaatttatctctggatttttttttttttttatgagacagggtctcactccgtcacccaggctggagtgcagtggtgtgatctcagctgactgtaacctctgcctccgcttcccaggttcaagcgattctcatgcctcagcctcctgagaagctgggactataggcacccaccaccacgcccagctaatttttgtaaattttgtattttttgctagagatggggtttcaccatgttgtccaggttggtctcaaactcttgacctcaagtgatctgcccgcctcggcctcccaaagagccaccgtgcccagcctagattttaaaagacttttctaagtacacaattatatcacttgcaaaaactaatcgtaggttaggctgggcatagtggctcatgcctgtaatcccagcactttgggaagccaaggtgggaggatcacttgaggccaggagtttgagaccagcccagacaacactgttacacaccgtatctacaaaaaatttaaaaattaacaggatgtggtggtgtgcacctgtattcccagctactctggaggctgaggcaggaggattgtcagagcctgtaaggttgagactgcagtgagccatgatcatgccactgcactccaccttgcacagagcaagaccctctctttaaaaacaaacaaaaaagaccagtcacgatggctcacacctgtaatcccagcactttgcgaggctgaggcaggtggctcacgtgaggtcaggagtttgagaccagcctggccaacatggtgaaactccatctctactaaaaatacaaaaaaaaaaaaaaattagctgggtgtggtggcgggtgcctgtaatctcacctactagggaggctgaggcaggagaatcactggaacccgggaggcagaggttgcagtgagccaagatcgcgccactgtactccagtctgggcaacagtgcgagactctgtctcaaaaaaccaaaccaaaccaaaacaaaacaaaacagacaaacaaactaatgatagtttcattttaaacatctccaaatctttttttttttttttttttttgagacagagtcttgctctgttgcccaggctggagtgcagtggcgtgatctcggcttactgcaacctccgcctcccaggttcaaaccattctcctgcctcagcctcctgagcagctgggactacaggcacgctccaccacacccacctaatttttgtatttttaaaagacacggggtttctctgtgttagccaggatggtctcgatctcctgacctcgtgatctgcccgcctcgacctcccaaagtgttgggattacaggcgtgagccaccatgcccagcttaaaatcccccattcttatttctttttcttgcttcctgaaagaagcaccctgttttcctggtgtttctagtaggggctgagcagcccaggcggctgcagcgtctctgtctgcttctggctggaagagagtgttctagttctgcactacgaagattgctgtttgcaaagcagattcctgtagatgtacttaattagattaaggagagctcccttccattctccgtctactgagagctgttttaggaagtcatgaacagctattgaatctactaaatgccttttttgcacctactgatatggtcatttttttctttaatctgttaatgtgaagacttacatttattgattttagaaaaccttttattaaaaaatcatttcaaataaaaaaattacagtagtggctgggcgccgtggctcacgcctgtaatctcagcagtttgggaggccgaggcaggtggatcatctgaggtcaggagttcgagaccagcctgaccaacatggtgaaaccctgcctcttctaaaaatacaaaaattagctgaacatggtgaatccctgcctcttctaaaaatacaaaaattagctggacatggtggtgggtgcctgtaatcccatttactcgggagctggaggctgaggcaagagaattgcttcaacctgggaggcgaagattgcagtgagccaagattgcaccactgcactctgggtctgggcgacagagtgacaccctgtcacaaaaacaaacaaacaaaacaaaaagaaaaaacaaacaacaaaaatactacagtggtaccatagctcctatatgtcttcacacagattcctcaattgttaacatttcacctgaccattctctacacacacacacacacacacacacacacacacacacgcgtgtgatggacgtatgggaatggagctgtgtcagcctcagggcattcgctcaggagggtgtggctctctgggccctgctgcgggtgccacccacctctctcccttagtcagagtggcaaccgctcgctcctccaccgtgaggttaatgtgaaatgtgttgctaactacggcataattcctgagtattgtatgagggtgatgctccaatgcgatgtcagtgtcctggtccaattcccacgggcgccctccgcggggcgccccgagactcccacccgaccgggtgtcctggtcctaatcccatgctcaccctctgaggggcaccctgagactctggcccaactaggtgaggactgtgatgtggctgaagggcggagtccacttcccttctggatgcctcagtgagcctgctgccagctgcagctttccctccctctgcttattcacatcagcttggacttgtgtgtgcctattttactcagagggttatgatgcattattctcattatttatgtgatgctcacatagtcccggaggcagccagtgcagccctacagctgggtctggtgactttgtagtgtgtcctgccattctatctttaaagattttttggagacagggtctcactctgtcacccaggctggagtgaagtggtgcaatcatggctcactgcagcctcgacctccctgggctcaagcgatcctcccacctcagcctctcgagtagctgagactacaggtgtgtgccaccatgcccagctaatttttttctattttttttggagatgggggggaggtctcgttatgttgcccaggctgggctccagtaatcccaaaatgttgggattacaggcatgagccaccacacctggccatgtctctgtcttataaggacagttgtcattggatatagggtccactcgataatgcaggatgatctcctgctctcgagatccttaatcacatctgccaagactcttattccaaataagggtgcattcccgggctctgggggttaggatgtggacgcgtatttaggggtcaccttcagccaagggccagcagtctgtctgctgtgtccaaggcacagctttccagctggctttttcctcgtgttgcccaagccctccccttttcctttctttggggctgagctttcaatagcacacctagcatgggcagaggaggcattcggaatggaacaataaatagggagattgaggatgagggagcgagactctgactgtaagtggtggttacacatcaggaaagtggggatttaggaataagccctgtggactggcatgaacttgtggttaaatcattgacggcctgggagagggatgggtgtggaaacacaggtgtgcgcatgcctgcaaagacagcctgagcggcggcagccgggcagcagtgagcacgtccagcacccagggtcagctggtctcaaactcctgacctcaagtgttccccctgcctcggcctcccaaagtgctgggattacaggcgtgagccaccgtgcctggcctgttctcttattttcaacctttctgtatatgtattgtaaatgtaagttgcagaaacagaatatatttgtcttatgatggactcttctaattgatttataatcactaatctatttgggtttaaatctaccatcttactaggaacctccacataacccataacctcacacaactatcaactcctagccatctaataggtgtgcacgggaacctcatcactgtttaaatctgcatggaactcctcatgtgccgatttgcatccatgtatcctgtttggtgaaatgtctgttcaagtcctttgccgatttttagattattgtatttactgcagattttttttttattttttatttttagagacagggttttgttctgtctcccagggtggaatgcagtggcatcaacatagctcactgcagcctcgaactcctggcctcaagtgatcctcctgactcggccttccaaagcactgagattacaggcatgagccactgtgcttggccttattgccgatgttaagagttaaaaaaatatgtaggctgggcatggtggttcacaccgtaatcccagcacttcggaaggctaaggcgggcagatcacgaggtcaggagtttgagaccagcttggccaacatggagaaatcccatctctacaaaagatacaaaaaattagccaggcgtggtggcgtgcttctgtaatcccagctactcgtgaagcagaggcaggagaattgcttgaactggggaggtggaggttgctgtgagccaagattgcgccgttgcactctctcctgggtgacagggtgagactctgtctctaaaaaaaaaaaaaaaaaaaagtaaaaaactaacaggtgctggtgaagttgtggagaaaaaggaacacttatatactgttggtgggagtgtaaattagttcaaccattgtggaaaacaatgtggtgattcctccaagacctaaaaacagaactcccattctatccagaaaatcccgttactagatatatacccaaaggaatataaattgtaatatcataaagacacatgcaccgctattcacgatagcaaactcatagaatcaacctgaatgcccatcaatgatagactggatggaaaatgtgatacatatacactatggaatactatgaagccataaaaaagaatgagatcatgtcctttgcaggaacgtggatggagctgagggccattatccttagcaagctaatgcaggaacagaaacccaaattcatgttctcacctgtaagtgggagctaaatgatgagaacatatggacacatagaggggaacaactgacactggcctattggagggtggagagttggaggagggagaggatcaggtaaaataactaatgagtacaaaggcttagtacctgggtgatgaaataatctgtacaacaaccccctatgacacaagttaacctatataacaaacctgcacatgtactcctgaacataaaataaaagttaaatatataaatatgtacattagatgttaatatacattacacattatatatatatatattctgcaaacaagtcttttgtttgatacatgatttataagttgatatggtttggcagtgtccccacccaaatctcatcttgaattgtagttcccataatccccacctgttgtgggagggacccagtgtgaggtaactgaatcatgggggtggttacccccatgctactcttctcttggtagtgagtgagttctcacgagatctgatggttttacaaagggcttttcaccctttgttcagcacttttttctcctgatgccatgtgaagaaggacgtgttgcttccccttccgccatgattctaagtctcctgacgcctccccaggcatgtggaactgtgagtcaattaaacctttttcttttataaattacccagtcttggttacttctttttttttttttttgagatggagtttcgctcttattgcccaggctggagtgcaatggcatgatcttggctcaccgcaatctctgcctccctggttcaagtgattcctctgcctcagtctcctgagtagctgggattacaggcccctgccaccatgcccagcttatttttgtattttttagtagagacagggtctcaccatgttggccaggctggtcttgaactcctgacctcgggtgattcacccacttcagcctcccaaagtcctggggattacaggcgtgagccactgcacctgggctcagtcttgggtatttcttcatagcagcatgagtacggactaatacacaaatactttctcccagtatataatttgtcttttcatcctcttaacagtgacttttacatagaaaaaaaggtttaaattttgatgaaatccaatttatcaatttatcttttatggattgagcttttgttgttgtgtctaagaatatttttagccttggcccaggttgtgaaaattttttctgtttttttcttctaaaggttttgtagctttacacttgacatttagacctgtgatcatcttgagttaatttttgcataaggaatgaaggtctaggttgaggatcctttcttttttcccacacacgtgtctaatttggtgaaaatactatctttccaatgtcgaatcacttttgcactttagttaaaaattaattaccactttcgaaaagctaggaatagaagggaacttccttaatctgatgaaagagatctgctaggccccacagctaacattctccttaatggtaaaaggcaggatgctcttcccctgggatcaaaaacaagacaaggatatctactgtcaccacttttattcaacattgtactggaggctctagtcaaggcaatttggcaagataaagaaataaaagacatctagatcagaaaggaagaagtaaaacttctctgtctggggatgatataatactatatataggaaatcctcagaaatgaactaaaaatattagcactaataaagaaattcagcaaggttgcagaatcttgtgatcgatgtgcagaaaatccacttatttctatgcactagccacaagcaactgaaataaagtaaaaaaatccatttatagcagagtcgaaaagaattaaacgcttagaaataaattttacaaaagaagtgtaaaacgttggcaacgcgtggtgtatttttctatgcaaaaaaaaaaaaaaacaaacaaaaaaccagactgtaaaacacgtgttttgaagacgacaaaacattgttgaaagaaattaaagaagaccgaactaaagtaaatgtaaagacatcctatgttaatcacaaactgacctgcagactcagtgcaatccctagtatcaaaaccgcacacggcttctttgtttgttgttgcagaaattgacaagctgattctgaaattcatagggaaatgcaagggatccagggcggactaaacagtcttttgttttgttttgttttgagatggagtctggctctgtcacccaggctggagtgcagtggcgagatctcagctcacctcaacctctgcctcctgggttcaagctattctcatgcctcagcctcccaagtagctgggattacaggacccaccaccacactcaactcatttttctatttttagtagagatggggtttcaccatgttggccaggctggtctcgaactcctggcctcaagtgatccacccgcctcggcctcccaaagtgctgagattacaggcgtgagctaccacgcctggccccaaaacagtcttgaagaaaacagttggagtatccacacttcccaatgtcaacacttattacaaagccgcagaaatcaagataatgaggggctcacagaaggacagacttacagattactggaacagagtggagaatccagaaataaacctttacgtttttatggccagtcaatttttgaaaaggatgtcaagaccattaaatgggaaagaatcgtctttttaacaaatggtgctgggagcactggatatgcctaagcaggaagctagaccctgtgtctgtgccccagggctgccctaacaaagcactgcaaacgggacagcgtcaaccacaggaattccttctcccacgctctggaagctagaagcccaagatcaaggtgtctgcaggactggtgttgctgaaactgacccaatagtcctacagactgttctttttgaaaacacagaaatggacccttctggtcttaaagcttgaaacttttgttttatctgaatttcttcctcagcaaaggaccttcaggcctctcagaaaagtatcaaagaactgaaactacccagaccaaggcacagatgctggacccctcattcatcatgattgcttccttgcctgacatggtttggctgtgtcctcacccaaatctcaacttgaattgtatctcccagaattcccacgtgttgtgggagggaaccagggggagataattgaatcatgggggccagtctttcccgtgctattctcttgatagtgaataagtctcatgagatctgatggtttattaggggtttctgcttttgcttctctctcattttctcttgccgctgccatgtaagaagtgcctctcacctcctgccatgattctgagaactccccagccatgtggaactgtaagtccaatgaaatctttttttgttcccagtttggggtagatctttatcagcagcatgaaaacgagtaatacattgcacctctctagttcttgttttcttacacgttgttacatttcttcccctgctatataaacccctggttttagtgagtcaggagatggatttgggactgagctcccatctcctctgctcagcacccaattaaagccttcttccttggccatacttggcatctcagtgattggctttctttgcagcaagcagcaggacctggaatgaaaccctggtgtttcagtaaccttgccagcaactctcagcttgcagctgcctccctccaacctctgtccctgtcctcatacagtcttctttcctctctccttataaggacacagacattggatgtaggcccaccctaatccagtgtgatctcaacttaactagatgatacctacaaagatcctatttccaaataaggtcacgttggcaggtatcagggtaggactgaaacatatctttctgggagccatgatttagcccatagcagatcccttccttaaaacagacataaaatgtaactaaaaatgcatcatacacctaaatgtaaaacctaaaactataacacttctagaagaaaacagaggagaaaatctttgtgaccttggattatgcaaaagcttcttaggacacagaaaagcacaagcaacaaaataaaagatagataaatcgggtttaattaaaattagaggtttctggccgggcacagtggctcgtgcctgtaatcccagcactttgggagactgaggtgggcagatcacgaagtcaggagttcgagaccagactcgccaacatggtgaagccatatctctactaaaaataggaaaagttagccgagtgtggtggtgtgcacctgtaatcccagctattcgggaagctgaggcaggataattgcttgaacttgggaagtggaggttgcagtgagctgagatcacaccactgtactccagcctgggcaataaagcgagactgtctcaaaaaaaaaaaaaagtttctgtgctttgggactccataaaaaacgttgggtgggtaaggatcacgcctgtaataccagcactttgcgaggtcaaggtgggaggatcaattgagcccacgcgttcaaggccagcctgggaaacgagagtagcaagaccatgtctctacaaaaaattaaaaaattagccagccatggtggtgcgcacctgtagttccagctactcaggaggttgaggtgggaaggtcacttgagcctgggagatcaaggccctggtgagctgtcattgtgccactgcactccagcctgagcgacagagagagaccctgtctcaaaaaaaaagttgaggctgggcgtggtggctcacgcctgtaatcccagcactttcgggggctttggcacatggatcactttggggggcttaggcacatggatcgtctgaggtcaggagtttgagaccagcctggccaacatggtgaaactccgtctctactaaaattacaaaaattagctgggcgtggtggcacgtgactgtaattccagctactcaggaggccgaggcaggagaatcacttgaatacaggaggcggaggttgcagtaagccgagatctcaccactgcactccagcctgggtgacagagcaagactctgtctcaaaaaaaaaaaaaaaaaagaaaagaaaacaaaatggccaagcacagtggctcatgcctgtaatcctagcactttgggaggctgaggtgggcagattgcttgagctcaggcgttcaagaccagcctgggcaacatggtgaaaccccatctctactaaaaacacaaaaaattagctgggtgtggtggcgtgtgactgtattcccagctacttgggaggctgaggcacgagaattgcttgaacctcggaagcagaggttgtagtgagctgagattgtgctacagcactccagcctgggtgacagagcacgactctgtctcaaaaaaaaaaaaaaaaaaaaaaagttgaaaagacaactcagaaaatgggagaaagtatttgcaaatcacatatctgataagagaattgtatccagaatatataaggaactcttagagtggaacagtaaaaggataaataacccaatggaaaaacgtgcgaaggatttgaacagacatttctccaaaggagatatgcaaatggccactaaacacacgaccagtgcctggtgtccttagccatcagggacatgcaaatcagaggcacagtgaggcaacatttcacacctgccacgatggctatgattaaacatgttgataataacaagtgctggcaagggtgtgaagaaattggaatcctcacatattgctgatggaaacgtaaaatgatctgaaaaagagtcgacgcttccccaaaatgttaaacacagagttaccgtatgacccggccattccacccctcgacggacacctaagagaaataaacacaggtccacataagagtttgtactgaagtgttcatagccacatccataatggccaaaaggtggaaacaaagccaaaagatgtccatcaactgataaagagataataagagcatggaatattatttggcaataaaaaggaaggaagtagtgatgcatgctgcaacatgaatgcgccttgaacacatttagcaaaataagccagtcacagatgaccgcatatggtatggtcccatttatatgaaacgtccagaaaaggcaaatctgtggagacagaaagtagattattggttgccaggggctgggaaaactggggagaaattgggtgtgaaaggggggcgaatgctactggctctgggtgggtgtgaaaggggggcgaatgctactggctctgggtgggtgtgaaaggggggcgaatgctactggctctgggtgggtgtgaaagggggcgaatgctactggctctgggtgggtgtgaaaggggggcgaatgctactggctctgggtgggtgtgaaagggggcgaatgctactggctctgggtgggtgtgaaaggggggcgaatgctactggctctgggtgggtgtgaaagggggcgaatgctactggctctgggtgggtgtgaaagggggcgaatgctactggctctgggtgggtgtgaaaggggggcgaatgctactggctctgggtgggtgtgaaaggggggcgaatgctactgggtctgggtgggtgtgaaagggggcgaatgctactgggtctgggtgggtgtgaaaggggggcgaatgctactgggtctgggtgggtgtgaaaggggggcgaatgctactgggtctgggtgggtgtgaaagggggcgaatgctactggctctgggtgggtgtgaaagggggcgaatgctactgggtctgggtgggtgtgaaagggggcgaatgctactggctctgggtgggtgtgaaaggggggcgaatgctactggctctgggtgggtgtgaaaggggggcgaatgctactggctctgggtgggtgtgaaaggggggcgaatgctactggctctgggtgggtgtgaaaggggggcgaatgctactggctctggggatgatgaaaatcttttaaaattgattatgacatgtgtaaaattttccttccttccttcctcccttcctctctctttcctttccttcctctttctttctttctttctttctttctttctttctttctttctttctttctttctttctttctctctctccctctctctccctccctccctccctctccctctccctctctctccctccctccctccctgcctccctctctctctctctctctgtctctctccttcttatcttgctctgtcacccaggctggagtgcagtggtgccatctcggctcactacaacctccgcctcctgggttcaagctaggctccttctgcctcagcctcccaagcagctgggattacaagtgtgcgccaccacgcccagctaatttttgtattttagtagagacgaggtttcaccatgctggccaggctgatctcgaactcctgacctcaagtcatctgccctccttggactcccaaagtgctgggatcacaggcgtgagccactgtgcccagactgtacacttttgcttttggagacagagtctcactctgttgccccagctcccacggctcactgtagcctcaacctcccaggttcaagcgatcctcccacctcagccccccaaatagctgtgactacaggcatgcgccaccatgcccacctaccctttgtgttttttgtagagacgaggtattgctatgttacctaggttggcatcgaactcttgggatcaagcagttctcctgcctggcctcccaaagcgctgggattacaggagtgagccactgtgcctggctgaattgtacactttatttatttatttatttattttgagacagagtcttgctctgttgcccaggctggcgtgcagtggcatgatctcggctcactgcaacctccgtctcctgggttcaagcgattctcttgccttagcctcccaagtagctgggactacaggcgtgggtcatcacgcctggctaatttttgtgtgtgtgtgtgtgtgtgtttttagtagaggtgaggtttcaccgtgttggccaggctggtcttgaactcctgacctcaggtgatcacctgcctcggcctcccaaggtgctgggattacaagtgtgagccactgcgcctggcctgaattgtaccctttaaatggatgaattttatggtatttgaattatatttcaataaatctgttaaagaatcaatggccatgcttgtgtgggtgcacttgttccattgatctgtcggctgaccctctgccaattcagcctgtctcaattgctttagctttatggtgagttaacatccattagtgatggctgggcacggtggctcacacctgtaatcccagcactttgggaggctgaggtgggtggatcacgaggtcaggagatcgagatcatcttggctaacacagtgaaactccgtctctactaaaaatacaaaaaattagccgggcgtggtggcggccgcctgtagtcccagctactcgggaggctgaggcaggagaatggcatgaacccaggaggcagagcttccagtgagccaagatcatgccactgcactccagcctgggctacagagcgagactcagtctcaaaaaaaaaaaaaacccaaaaaaacaaaaacaacaacaacaaaaacatccattcgtgagaaccctccaactttttcccttctttttcagaattattttggcaactagttgcttttcatttctatatacatttcagaacaaggttttctatacctataaaatttccgacaggaattttaattgaaattgcattaaatccgtagtcgttttggagagaattggtatcttaactatatttgttctaattcaggaacacagcatgcctctcacatatttaggccttctttgatttcttttatcagcatttggtagttttcagtatacaaatcctgtaccagtcttgttagattaataccaaacgaataaatttactgggggaccattttaaatagcattgcttttaaaaattttggttttcaattgttcattgctaatatatagaaacaggactgagttctgtgttttcatcctgcaaccttgcaaaactcacttattagtattctgacttttttgttggtaaaattcttgggattttcgacatagacttttatgttatttatggatagggacatctttatttcttcctttctaatctgtatgccttttatttttctggttttattgcatgggttaggactgccagtacactgtggaacaggagtgaatagagtggacatctttaccttgttcctgatcttagggctcagcatttagtccttcattattaagtatcacattagatgcagaggttttttttttttttttttttcttttttggacagggtcttcctctgttgcccacactggagtgcagtggtgcgatcttagttcactgcaacctctgcctcccaagttcaagcgattctcatgcctcagcctcctgagtagctgggattacaggtgtgtgtcactgtaccctgctaatgtgtgtgtgtgtgtgtgtgtgttttaagtagagatggtgtttcgccatgttgcccaggctggcatagaactcctgagctcaggtgatctgcctgccttggcctcccaaagtgctgggattacaggcgtgagccaccacatccggccagattgttttgtattttttgtagagacagggtttcaccatgtttcccaggctggtcttgaactcaagctcaagcaatccgcccactttggcctcccaaaatgctggtattagaggcatgagccacagtgcctggcctaattttttttttaattaaaaataacagatatggaatctctccatgttgcccgggctggtcttgaactcctggcctcccaaaatgttgagattgcaggggtgagccaccatgcctggcctgttgtttttgttgttgctttttgtagattccttttatgagattaagcatgttccctttgctttctagtttgctgagagtgtttatcagggatgagtgttgaattccgtcaaatactttctttgaattgattgagatgatcacatggttttcttcttgagactaatatggtggatcacatcgatttattttcacatgttgaaccagccttgcctttctgggatagcctccatttggttggggtatttgtgtgtgtgtgtttttaatgctgcttgattctatttgctgataattagttgagggtttttgtgtcatgttggcattggcggctgttgattgtcttttctcttgcaggttggatttcctgattcttcacatgcagagtaattttagattgtctcctgcacatttagacattatgttatgagactggtcttatttaaatcccattgagaatgttggcattttgttttatcatgcaatcaacctagttggtttcaggccacaagttcaaataggctcctgtgggtcctgccttccatgtcggttttgttttcaaagcctttgcagtgggactcagatctgtccttcgtatgcactgcccagtggccagtgtgggacgtgggcagtgggctgtccttttgttcagttctcagcctttgggatgtgaatgagggtttagacttgtacatcatgtatggcttgcacaacttcctggggttgctttttttttttttttttttttgagacagagtctcactctgttgcccaggctggagtgcagtggcaagatctcggctcactgcaacctccatctcccggactcaagcaattctcctgcttcagcctcccgagtagctgggattacaggtgtgtgccaccacgcccggctaatttttatatttttagtagagatgggggtttcaccatgttggccaggctggtctcgaactcccgacctcaggtaatccgcccacatcggcctcccaaagtgctggaattacaggtgtgagccaccacgcccagcccatggattgctttctactgcttctccctgcccaccatctctccagcgacaggggaccacatctcctggggctggaaaggaaggctcttctgcctcagcgttttaggtgcttgtaaaccctatgccttggtcatggctttggtgggatacctaggggctggggcatcagagaatggagaagagtaaaaaaacaaccactaccaaaaaaccccatcctcccaaaccctaacatccccccgggcattctcctgcaccctgggagcattaggcgacctttttctttcctccccttgtgccaggactagagaacttctggagctctctgtcctcttctggctttcaggccgtgttgagtccaggcccggggatacgggaagagaatctggaagttcactaccagttgggtggtgcctcaaattctggtctttccaccaaatctggtgtccctttacctctctgaccctcagtctcctcctatgtcagagggaagtcacagcagttctgggaaggagggcaggcaggcagaaggtgccctcgggttcttctctggctcacacgggatggacaggatgtggggggaggggcttagtgccacctcagtgacaaaatgaagcccaagtccccaaaccctagcttgcctcctggacgggctggagaagaaggtgggggccgctcatcattcctttcctctgccctgagaagaaacctgggaaggctgggtttctccccaaagaggacagagggtggcgcggagggccccggcggccaggccagccccgcgcctacatccctgtcagctcctgggccggtgggcgcctgtccggctgagtggggtcgctctagggggcggcagcggagtttcagggcgcggggggcactgggcgggaccctgggattctgggcggtgggtgaggagggtggagacgggactccgcgcctgggggtgcgcgagggcgccccgctccccagagccaccagtcctgcgcgccgccgcgcggtgctgtcgccgtggcaaccggcgctgcggagggggcggggcaccggcacccccgcgctcccaggtccccaggtccggcggggctcgcgggccgaggggcgcggggcggggcctctgggtcgggggcggtgccgcgcgggcgggggaggggcgcggcgggaggagccggcgcggccccggcagtggcggcagaggctgggcgggcgggcccgggagcggcgcagcatctgcgggcggcggggtaggcgcgggcgcgggcgggactggctgggtgcgcggctgcgtccgcggagggggcggcgggcctgggcgaccctgcacctctgggccgtggggactgtggggtggggcgggggccgatgcggcaggggtgaggcctggggccggcggggtgacggggacccggccctgcgtggggaagcctcggggggacaagcagagacgcagcctgctgggagcggcccaagctctgcaccggcccgcggcgggagcacagcagccccctcccgcccctcctcccgggggctccgaggggtggttatggggcgagggtccttgcggggcccgggcagtgaagggcctggaggccccagagtctgtgccaggtctgagccgcggggcgtggggggaggaggggcctcggccggggcccaggagacccaggacaggtgggcctggggccaggtccctacggagaggtggccgggccgggctctggcttgccggggtaggggctccgctaggggctggagtccgtcccttcgccagcgcagagcccctcggcccgcatctgccaagtgactgaggatcgagcgacagcgtagtggggcggaggggctggaggcacggccggaaagggtgagcggcgccgtggctcccccgctatttatttggccccgccacgcgcggagagggaggaaattctcaggctgcggctgcagctaggggaggcccaggtgggcctggaatgggcccagagagggcttcctgggtcagacgtgtagatccagtggacgtgaaaaccgggtgagtgtcccggtgggacccagagcgcggggaggcttggaggcaggggcatgggctgaggaccctcaaggcaccctcctcgcgacctgtcagagctccgaggggtgggggtgtcctgtgtgtggctgtggggatcctgggcggcgggtgctgggtgggggcaggggtgggagtgcagagttcaacgctttcccggatcggtggggcctgcggtgtcaccagggcagtccgagcgcccgactgtcacggggacattaaattttatgcctttgtctagacacggcagtaaacggagccccaggcctggggctgtggagggggtgaggggctggctgggagtaagcctgtcagtgactttggggtgggtgcgggtgtgcgggcctccattgtcacccaggtgtgcacaggcccaggtgcggggactccgacagcacggccatgaggaccagtgccaggtgtgtgacagaggtgcaggggcctgtggaagcccgacgggccttggtggacgggcttcccgagattcgagggcagccacaggcatcgccctggcgcagaggagcaaagcagggtggctctgccggggcagagggtgggggacaacacctcgccaaggcaatgcggagccatggggagcagggcaggcagtggccacgcgcccaggatggtggacaggaggggagaccgagcctgcccgtgcagggaggaggggcgtgggggctgccgggcaggggcggggaggctcggagaggcttgtgggacggatgcatcgggacctgggtggctctcggtccgggatcagaaagcctgggagggccgaggcctccttgggtactccaagagcggaggggcaggcccgcctccctgcccagtgcggcggcggggagagggtattcccggaactccgcggaaacggcctgaggccagcagcgcgggcgtggggtccgggccgccggagccaggagggagggcggcgcgggcccagcagtgacaaacccccccgggctccgggaacgagctcggcgggcagaaaacgcgtccgttccgtttccttcctggcggcgggaacgaggcccgggtgctctggcgaggcagcagcgccctctggaggcctcgctgtggttcgcggccgccggttcgcgcatgggcgcaggcgtgcgcgatgcctcggggccccggcgcggagaccgcgcctggtgggaagcacgcggggtgcggggggcggggggtgttgggggaggccgctccagcccgcaccctgatcttgtctcctccggtctccccaggtttcgagctcgccgggccgtgtcgcgccatgcccgctggctgagcgccgcagggcctcgtcccgccaggcgtgggggccgcgcgcgcccaggccggggcccggcggccgaccatggtgctgccgcccccggaccggcgccacgtgtgcctgaccacgctggtgatcatgggcagcatggccgtcatggacgcgtacctggtggagcagaaccagggcccgcgcaagatcggcgtgtgcatcatcgtgctggtgggcgacgtgtgcttcctgctggtgctgcgctacgtggccgtgtgggtgggcgccgaggtgcgcacggccaagcgcggctacgccatgatcctgtggttcctttacatcttcgtgctggagatcaagctctacttcatcttccagaactacaaggcggcgcggcgcggcgcggcggaccccgtggcgcgcaaggcgctgacgctgctgctgtctgtgtgtgtgcccggcctgttcctgctgctcgtggcgctggaccgcatggagtacgtgcgcaccttccgcaagcgcgaggacctgcgcggccgcctgttttgggtggcgctggacctgctggacctgctggacatgcaggccagcctgtgggagccgccgcgctccgggctgccgctgtgggccgagggcctcaccttcttctactgctacatgctgctgctggtgctgccgtgcgtggcgctcagcgaggtcagcatgcagggcgagcacatagcgccgcagaagatgatgctgtacccggtgctcagcctcgccaccgtcaatgtggtggccgtgctggcgcgcgccgccaacatggcgctgttccgggacagccgtgtctcggccatcttcgtcggcaaaaacgtggtggcgctcgccaccaaggcctgcaccttcctggagtaccgccgccaggtgcgcgacttcccgccgcctgcgctatcactggagctgcagccgccacccccgcagcgcaactcggtgccgccgccgccgccgccgctgcacggcccgcctgggcgcccccacatgtcctcgcccacgcgtgaccccctggacacgtgacagggcccgcgcggcccccgacacgcccctggggcgcagagacaccgggttggcttggggcgcgcggtttgcatgggatggggtgggggcgggctcccctagggacaggtgcctcgagtgcccgtgcctggggtcccgcggccgcttcttcatctcaggaatctctcggaccgcggatcctcagcccccgctccaccagcccgccccagcgcgtgggtctgtttgggaggcctgggccggagcagagcagaggtgatccggcccctgcctgctgggccgcccgggttggaagggagggcagtgtgggcggagatctgctccttcggtgggggcctctggctcagatttggggccaaggaggcctctgtcattttaaagactcgtgtttacagttttgtatccaaggccgcactgctttgcctgttcctgtgtccctgtgtttaccagccaggctgggaggcggggagccaggaggggtgtgtggagggcgggggagatggtggcgtccaagtgccggatgctggtgaggctgggccgctccacttcctccggggctctcaggagctcctgggggccactgccgctctgtcccagggacagctcctccactccagcttcggtgttcccaattatcttcctgggataccttgacccccatcttcccccagcaccgtaggtgtcctggcccctgctcccctcaacctcaggcatgacagtgtctcccacatccctggtttccttctcccccaccgtggaacctaccttccctgtgggctcctccagcccaggacagccacagccagatggaatcagggtgttcccaagttgatgtggcagccccaggtcgcagccccaggagcagcacggagcctggccccaccttaccatcctggccttgccccagcacgggagctggcagcccctggcacaggcagcacccgccctgaagcccatctgcaaggggtctctcacctgccttccacctgggaccctgtacctgtgatgtggccctgggtatccacctggcctgggaaggtccgtagcatctggggaggggccctttatgaggctgctaaaagaattgtttgaggatgcccgctccatgagcgggtgatggtcacacacatctcatgtggcacagttcactgcctgggccttcgcttcccgcatttccacggcccaaaggtggcaaggtttagccagccagggctaaaaccatcgaggggagtggagctggctgctcaagtggggtcctccccaagtgcatttcccaacaactgcagcagttaagggcgtggctggtggcagccccagccgcaccccgaccccacacagtcctcataccccagctccaggccacctggggtctggcctttgaaagtcgcctgccttccaggcagctggcctcgggaccactgtcctcagggtcccgggcagggggactacctcgctgtccaggtcagacgtggccggcgctctgcccacctctaaaaccgtgccttggccccggcctccgatcatatccccagcagcccctccaagcgccgagcgccgtgggtgggcacggggcgctggcctgggtaggaggtcagaggcgccctgctctgggctgtgcccaggccactaatgatcgtgttgggaagtggaaggtctgcaggatcaagggggctggggggccggggaggggcggtgatgagcagccgtggaaaggccccaggcctggcatggagagagaagaggggctgtgggagttgcgtgggccagtgggaggacctgggccttcttgggagggagtggtctggagtggggggtagtgggtgaggggcgagcttcattctgcctgtctgggctggagcctgtttcctcccctggctgaagccagtgccggccccatcctgccttaagggtctcctgggtgaagacgagcccacaatcatcttggctctggcacctgcagcaaatcccatgggaacagacaggcagcgtggccatgggtgaatggagctgaggggctctgggctcctgacatcctgctctgacccttcctgaaagcccatggtctcttccatgctggctgcagtctgggaggcgttgggcccagcttggcctgtgaaagctgaaagcccacaccccctagtcagaggctggtttagctactcccctagtttagctactcttggggcagtgaaggccctggggctcgaagacctccccaggcaaccttaccctgcacacaccccactcctcctggcctgttcaggggtggtccctggtctccgtgctccttggcacaggccagtgccctctacctctgccaccacatccctggcagtggaggtccaagtcctggctgtcccccctctcaccagtggggccagggatcctggctctacccgctatgacttggttcaatggcccatcgcctctgcaactgactctgagggcattggagcagacatcaagccccaccctgcccaggcccatgcctggcacctggtttccacgacgaggcgcagctgtggctccgactgtggcagggctgggaagcagggggcctttgtcaggctcacggcctgaggtttctggcctctgtgatctcccctgggaacaggacggggaccgggccgcactccagcctgcccttcgtgagtttcctgaggtgtcctgcaatggccagattcgacggagaagccagtcagctcccttgtcccctcactgattcctggtgagtacgtgagtcctgatgcgtgtccactacccgctggccctgtgctggggcctggtgcccaacccaggcagagacgtctggggacagccacactttggggagttagggcctgggaggagcagggaggcctcctcagatgggcttgggttggacttgggagctggcctcgagggaggcccgcaggtgcagcagcctggaggcagagagctgggtgtgtcagtgcctgagagggccgtggtgggcagctcaccagcaaagggagcagaaagggcccgggggagaagtgggcagctcagagggaagaggcggggctgggatgctgagcagggtgtggacggagatgcagctgggtgcaccagtgtggtttggctgggaagggaggcgtgtgtgtgggggagagaaattgggcagtggaggtcctgtcctgagaaaggggctgtctgcaggcactctgctccctctcgtggcctagtctgcctctacaccagcagagacctccctgccctgcggccaccaggaatccatgcagcgtgcatgccccaccatagctccaccgccaccaggaattcaggtgctgctgaagctgcatcaagaaagccccagcccagtcgcctcccctagatgaatgagagtgagctcttttctaattgtgaaggacatggcagattgtagctgtgaagacactgtcaggtcactctgtggaagtttgaggtgagcccttccagggtcacctggccatggaggacccaggctcagcccatctttcttcaccatctgggggggttggtgatggagccacaacagcagcgagcatcacattgtctcaaaatgtcatccgcgtgagggaaggagggacggctcctccttgggtgcctccctctccttgggaggaaaacccttctcagaagcccccagaatgtgtctgctgaggtcctgtggtccagagcttgttccaggacaatgtgtacacttccgctggcaggggacatgggtgtcatgactggctgcctgcccacaggtgagcccgtggtatcatggatgccccagaagacacgagactcgtgggtctgagacaaagggccctgtttctcagcatgagcttcagctgtggctcctcttgcctacaatcccgtgggggcgacgggagtgcctggcgatgcagcacacacagctggcaggagcccaccctccctctgccattacccaggaggccgcagtgtgacatcaaaaatactctgcaacttggcccaggttcacattctgcaaaagctgtgagcttgcaaattgcctttgatcctataagagccatcatggtgatcaatttctttctacacaacgccagcacatatttaaccccccacacggagcaacgtccagtttaacccgcacagcagcaacccagcctccagctctgtctcaccaagcacgtgtcaacaattctcttcctaggtgattccagcagcacagcctggcagctcctgagcccttgggaagttctgcagctcggcttacccagggctgccctggccaaagccccagccactctcctttactgcagagagcgggaccgtgtcccccttcatccccctagaacggtagggctgggagctgcgtcagacctgcctccacgtgcctgtgggaagagacgtcggagtctgatcgcagacacaagaagatcagtcacccaaaaagataaaatatactcgaacttccgacccttcatcttcctttcagaacacactcacattttctataggaaaacagcctcataataataaaaactcaatttagcgaaagtgaactcacttatcttaagcaataagaaagccaaacattattggattcgttttatgcagtaaaataacggagatgcactaagtggcaacccccgagggaaaagccatcagagtcactgccagcgcagaatggtggcagaggctgcaaagccacattcccaccctggctgaaacatgggtggcttcatttgttgcaaaaacaaggtaactgccatttaaccagggaaagatgaagggaaaaaacaccccccaatcagaggctgtcagggagggcctctgtcctcggggcttgacctgcaggcaggccccagcagcagggctagggccgcactgggcgtgaggaccaagcgtgcagagggtcaagaggtgggtgaggagagggtagaaaaggcagtgggcaggtggggggaacaccagagggaggcagacgggggcaggaggaggaaggggcctgggtgccagagggaggtcaagacagggggaggtgggcaggagtgttgccagacacacggcagcccccggcccatgcccacccccgccaccctgcattggcacgaggtcccagatttccctgggacagtgccgcctctcctcactccgtggctgatgtggaatggactccgtcctctgagggctggggcagctgccaaggaaggggcgctaacatcacactgtcccccgagaaaggaaacccatggtgaccgctgtgctttgaacatttgcgtcccctccaaaacttatgtggaaacataatccccaatgcaacaggctgtccattttgtgtggctataataataccacaggctgggaactaatttacaaagaaaagacatttatttctcacagttctggaggctggaagtccaagattgaggtgccagctctggcgagggcctttgtgctgcatcggctcaccgtggaaggtgcaggggcaggaaagggtgagagagagagggcccagcttgctgtcgtaaccacccacagtgcagatagtaaacacgccccaagataatggcgttaacccctccacgagggtggaacccgcctggcctcatcacctcttaacggccccaccttttttttttttttttgagacggagtctcgctctgtcacccaggctggagtgcagtggcgcgatcttggctcactggaagctccgcctcccaggttcacgcattctcctgcctcagcctcccgagtagctgggactacaggtgcccgccaccacgcccggctaatttttttttttttgtatttttaatagagatggggttttcaccgtgttagccaggatggtctcgatctcctgacctcgtgatccactcgcctcggcctcccaaagtgctgggattacagacatgagccaccacgcctggcctgagatggagtcttgctctgtcgccaggctggagtgcagtggcgcgatcttgactcactgcaatctctgcctcccgggttcaagcaattctcctgcctcagcctcccaagtagctgggattacaggcgcctgccatcacctggctaattttttgtattttttttagtagagacagggttttgccatgttggccaggctggtcctgagctcctgacctcaagtgatctgcccgccttggcctcccaaagtgctgggattacaggtgtgagccaccgcgcccagctccccacctcttaatattgccatagtggcaattacatttccatatgaattttggaggggacactcaagccatagcccaggctcggatgatggtggtgtttgtcaacgtacacattcatttccctcctgggtgagtctgggcagtggtccaggctgccaggacacagatccctcctactcgtggcccctgggtcctgggtgtggatcttgctctcacaggtcaggctgcaccatcagggctcggcggcagcacagccagggtggaggaggttgacgaggcatgcttttggggtctctttgggatggggctcaggagctggcatgaggcacctgcccacactctgctgcccagaacttagacatgccagtgccctgagctgccagggagccaggaatagggacctgcctttgggtgccgcatgcccaggtgaggaagaaggggagccctcctgtgttgctgcaccttggtaactttactggacttttcagtgttttcctcccaagcgttgcccaaacctgcatcctgcccagcagtgagagagcccagggaccacctcctcactcacacctgctgctggcaaatcctctggacaaagtgcaatgctgcaacattttacaaaacagagtcgcccttgatggtcataatggccgagaaggaaaactcacgacgacggaagccatcgactggcgaaatttgatatggatgagcaccggcccgtggttcaggttttcgtagtaaaatttatgtgggggagaatttttttttgagagaaacgtgtgtttaatggtaaaaattagcataccccatcaccaggaatggcgtggagtagggacgggcagcagggacaggcaggtgacccctgtggagcctcacgtggcgaggatgaggaagacgaccaccaaacagaacagccccatggcctcagacacagcaaagcccagaatggcatcggagatgagctgctgcttgagaaacagattcccggcatagccaacaagctgccagacaccgttccaatgccaggcccgaagccagccacaccgacaggggctgccccaacaccaatcaacgtggctgctgtgtcaacatcccgggagacagctctggtctggaactcccacctggccacctggtgtggggagcggctgtaggaaggctgttcagatgaattttctgggctgttcaagaaggagacagacacagcctgattagacccgtggtacaacagcggaccagagctggagaggtgagtaatgcccgggggtctgcattttctgtctgcactcccactgccctgcagcacctgcgggcccacagcactcgcccggctgaaggtgacctaaggtgaccgactcacttttactcattgcttatgaaataagctgaatgtggagatcatcggaaacatgtttcaaagtgcgtgagccttgaggaaagctttctcccgccctcatgagtatccgccccagggggtgctttcctcgagagctggtccgtgttgcgttcccacagtgaacactttcaaggctgctgcgggaagttgcacagaaacggctggtgggcctggaggggatggtgaggcgcagtgggcctgtgtaccggatgccaaatccacagcatgggaggcagggcccactgcaggagccacacagcagctgtgtgctgctctcccacctgcaacctgcacctgtggggtgcacctgagtgaccccggccccccggggtgtctctgggatgcctcctaggaggagaggctccacgcctggagggagacaggtatcacacaggtgcgtggggtggagtgtgatgcagggaggttggggcagggccacacagagagaccccactcaggcaggccttgggtcagggtaggcctcaccaagtgatattatgttgggactggaccgtggccaaggctggcctgcaggcagggggcacacatattcctggcaggtgaggctgcccacaaagctcacctgcctgagaaccctacctggctggggcatgcgggagcctctggaccttcgcgccggcggagcctgcagtgtcgccagatggccacaagggggctcccgagcccggctctgggtccctttgaggagggagccgcgggacccggctgtgagaccgggacctgccagtggtgccccgaccccccgaccccacaggaccctgcgcggccaaaggctgaggctgccccagccccaggctgtgctgatgcccctgaccagaacccgagcccgattctgctcactgaacactcatctgctcccttgcctctgcctgccccggcagcgagggcctggccagtgggttcgtatcaactcccacgtcacctcccgtgtcatctgtgtgtcacctccatgtcacctcctgcatcagctgtgtcacctcccacatcacctgcatcagctgtgtcacctcccacatcccctgcatcagctctgtgtcacctcccacatcacctgcatcagctctgtgtcacctcccgcatcacctgcatcagctctgtgtcacctcccgcatcacctgcatcagctctgtgtcacctcccgcatcacctcctgcgccacctttgtgtcacctcccggctgaccatggcccagcagcatctccctgttgcagcgtccggagaggctgcggttgcacggggtgggctaaggaaggtggggctgcctcagcctgggccctgagtgagctctggagtggatcccacctccccaccaaagcccaagcaggagacaaccctttgctgctgaagccactgagcgcttggggctgtttgtttcggcctcgtccccgacggacgtgtctcccacagtcccaggccctgagtgcaggtccacactgaaccttgacgctcatcgcagactgaccctggcttgccctgggtcacactcgggctgaggccccgacagcctggcccggtcgaagctccccggcttatctcactcactgttgtccagggcccagcctcacggtgacatctgccacaagaaggctgggactctgtcccacttgtgttcaggaacgagagaccctgacttggtgtctgttatcaacacattacaaacatcactgggcattacaaaagatttctgagggctgggtgctgtggctcacccctgcaatcccagcactttgggaggctgaggtgggaggaggattgcttgagcccaggagtttgagaccagcctgggcaatgtagtgagaccttgtctctaaaaaaattttaaaaattagccaggcatggttgcgcgtgcctgtggtcccagctactcaggaggctgaggcaggaggatcacctgagcccaggaggtcaaggctacagcaagcagagatggtgccactgcactccagcctggacaacatagcaagaccctgtctcaagaaaacccacacaaaacacaaagaaagaaataaaaatccagatttcaaataatttaaacttatttatccaacacaaagcagttcttcatggcacactttaaacttcgaaattctttgctctccccatgcttggctgattgggtctggggcaggcgatggtgctcactggatccagtttctgacaaatctggattgagacaagcttcagaactggcccagatgatcaattttcatataagttaaggtgtcctccttgttccacagcttttagtgatttttttttgttttttttttttgagacggagtcttgctttctcgccaggctggagtgcagtggtgcgatcttggctcattgcaacctccgcctcctgggttcaagcgattctcctgcctcagccttctgagtagccgggagtacaggcacatgccaccacactcggctaattttttgtatttttagtagagatggggtttcaccgtgttagccaggatggtctcgatctcctgacctcgtgatccgcccgcctcggcctcctaaagtgctgggattacaggcgtgagccaccacacctggcgcttttaggtgatttgataatacatttttctgttaaaattttatgatacataatatagaaagaatctacgtaaaatgatgtccatgcatttatgcacacagagcccactttgagagacagaatatgagggcctttggtcctgccaggagcaaagaaagttaataaaaaatcaagtctgggccaggggtggtggctcatgcctgtaatcccagcactttgggaggccgaggcaggcggatcacctgaggtcaggggttcaagaccagcctggccaacatggtgaaaccccatctctactaaaaatataaaaattagccaggcgtggtgacatacgtctgtagtcccagctactcgggagtctgaggcaggagaatcacttgaacccaggaggcagaggttgcagtgagccgagatcgcgccactgcactccagcctgggcgacaagagtgaggctctgtctcaaaaacaaaacacaaacaaaaaaaatcaactctgggccaggtgtggtggcttgcgcctataattccagcactttgggaggctgaggcaggaggatcgcttgagcccaggagttccagaccagcctgggcagcatggcaataccttgtcactacaaaaaattttaaaacttagcagggcatagtggtgtgcacctgtagtcccaggtacttgggaggctgaggtgggaggataccttgagcccaggaggtggaggctggaatgagctatgattgcaccactgcactccagtctgggtgacagagcaagaccctgtctcaaaaaaatgaaaaaaatcaccctggagaacctgtatttataggaagacatattgattccagcggcaaacgcttagggctgcagagccctgggcaggctggatgctgtcttggccccatgtggggtgagggctgcagattgtggtggaggccccggggaggcagagggaaccctcgggaaccatttccctgccttctgctctcgtgactgaccttttcttggcgaaacttggtgggggcagctgggcctctgccactggcatcctttggatgcttcctggtggtggcaaccctgtggggaggagttggggaacctgtgggccaacgcggctccgtgagcctcatcaggctgcagggcaccttggttctcccttcctgacccctctctgcccgtctcctttctgctctgtttgtcagatttttttttctcattttgattccattttgtttctgacaactttcccaagaccattgctcctccagaggcggctgggtccacacagcttccctttgtgccggaccctcgccttgctgggtcttgggctgcaaagctcggatgctgacagccttaggttcctgtgctgaccctcgcggtttccgcatcccactcatcccactctcacctctagttcctttggagatagaccttccatggaaaatcccagttggagcacacccgccgcattcccgttccctcacctgcccactccgtccacgtctccagggctgggctgcaactgtggagaccaccgcctccagccttctccatcatggagactggaaggtgaagcccggctagagggcagcctggtggtggggcaagaaataggacggctcaccggctgagccagggtgatgaggcctctctgctcccccttcctctctccaaagcttgccaggacccacccagaccaggctgcggccttcagcacttccccaggccacaccacaagacagaggaactgagcccctctggggcacatgccctcccaggccaaagtaacaagacgcctggagagaagagcgcctgaaagaaaaacagcaccctccacagcatgacttgtgtgcagcaggagtatgagaccctctgggcaaagaattaaagacaaatgcggtaacatccttgaagaattaaggaaagatattagcaataacagggagaaagcaataacagggagcacaaagaactaagtaggaatatcaggtatcaaaataatgattgagaaaaatgtggtaactgaaattcagtgggacggacgcagccgaggaaaacaatctgcgaagtgacagacgaggggaaggaatcctggcagagtggccagcatgcaggaagaaggacagggactgtgaggagagaagtgggtgggaggacagagcagaagaaaaagatgagagggattttcaaacattagggatgaaagacgccacagaaatccaaaagatgatatgaggaaaacctgtacctagtcacaattatattaaaattgaagaatattaggaaaaaaagggaatatttaaaaaatgttgaaaagaaggaaaaagttttaatggaagagcaagtggtggataaagggtaagaatcacaccgacttcagacctttcaacatgattcaaaaatgcaagaggactacaaattatttttaaggtatcaaaaaaacccactttatacctttttttttttttctgagacagggtcttgcactgtcacccaggctgcagtgcggtggctcaatcacagctcaccacagcgttgaactcctgtgctcaagcaatcctcccacctcagcctcctgagtacctggagcacaggtatgtgctaccacacctggctaatcttttaattttttgtagagatggggtttccctatgtttctcgggctggttttgaactcctagctgcaagcaatgctcccaccccagcctcccaaaatgctggggttacaggcatgtggccaacctacacctataatcttatatccagcaaatttttaaattcaaatgtgaaggtatactaaaaacatttttaggcaaaagaggcctcagaatacttgctatacagagaccacattgaaaacactgtaggaaaaagttctcgcaaacgaagggaaaatcccaggagctgttgcaagagatacaggaagaaagagcgagtaaaggttattgttaatatcatgatatatacctatataatatactgttgataacagatatcatgaaaatgaaaaattgataatatgtctacaattacccataaccaaaactccagacaatatcaatatgatgcgggataaggaattaatcaaggaactaagattatgctaaagcatatatcttgttgggagaatatgaattatatttatgaatacattcaataaatgagtaaagttattaaaagttaatcttaagaacaatcaccatgaaagttacaagtacaattttttaaactagtaaaagaagatgtaatctattcaatggaaaacaggaaatgtggaagaaacaaacaaaaaataactttgatgatagaactaaatcataatacagttgtaatcacaataaatattaatggcttaaactaatcagttaaaaagtagagattcttgtattgaaattaaaaaaaaattaagacaagacaaagctaggcatagtggcagacacttgcctatagcccctgctactcaggctcaggaggctggggtggaggattgcttgagtccaggaatttgagtccagcctgggcaacacagcaagaccctgtctctgaaacaaacaaatgaacaaacaaagaaacgagcactccaagagcaactttataattaaaacaaaagaagacacaagttgaaaaattacaaggatagaaaactatgaactaagagggttatcatcacagttatagcagggaagctaggagtggagagggatcctggccattgaatgcttagacctggaaattccatacatcgcttctcaaatatcattggccagaacgaatgacaaggccaaggggtgagggaggagtaactctgtgctcctggaagtagagaaccactggctattggtgaatatgaacaatgtttactgctaccacatacagattcttaatataagataaaaaggaaacaccacaaatcaatgagacaagatcgtttataaatggtgttggcaaaatcgactcactatacagggaataatagaaactgggcctccaccacttatcccatatgtgcgtggacttgagccagattatagatctgtgaattgcaaaactataaagttaatgctaaaaaaaggaggatcacttattgatgttggagcagggaaaaagttataaaataaaaattcggaagcacaaatcataaggcagatgattgaaaagacagcttacatgaaaattcagaaaatacttcctgactgttctgtgcttggcttccttcacctgtaaaatggggagttaatttaactaaggggttgagagcagcccccaggccattgtaagtgcttcgtgtgctacatgttattacaataatcagtatttcatgccctttaaaacatctctagtaatgctttttcccaaaacatcaattttgcctgacagtaaaatgccacaaacttgtgagttttgtgagctactgtgtgcctggtttatcttttcccatgattttccctcctaactcttctgtgtcattttgttttgtgtgtgtctcttgaaaaaccacatagctggattaagagcatccatcttttaactggagaatgtagtccatgtctttttattttcattactcgttatttatttctacctccttattttgtgtttctatttgtcttgctttttctgagtatcttttaaatcgttttcttatttctttaggagttattttcctcacttaatctttcttcttctgatttagaagttatacattcagtttctattcttttgttaaacaaattttaaattttaccttttagagacaaggtctcacttgtcacccatgctgggtgcagtggtgtgatcatagctcactgcaacctcaacctcttgggttcaaacgatcctctagccttagcctcccagtagctaagactacaggcatgggccacaacacctagctaacttttaatttgtttgtagagacaggatcttgctatgttgcccaggctggtctcaaacttctgggctcaagtgagccttctgccttggcctcccaaagtgctgggattataggtatgagccactgtgcctggcctggcatcttgtttttatatggtattgaaaagctaaacatatttgggtctgttattaacatgagaagctgtactatgaggaagcgtgtttttaaaaattatgaaatgttaggctgggcgtggtagctcatgcctgtaatcccagcactttgggaggctgaggcaggcggatcacatgaggccaggagctagagaccagcctggccaacatggtgtaactccatctctacaaaaaatacaaaaactagctaggcatggtggtgcatgcttgtaattccagctacttgggaggctgaggcacgaaaatcgctttaacctgggaggtggagtgagccaagattgcaccactgcactccactccagccttggcaacagagcaagactttgtctcaaaaaaaaaaaaaaaaaaaaaaagttgtaaaaggattgtggaaaagggatcttatgtggttaaagtcggcaccgtcccccaaatcaccaacccccaggtcccaaggcctgggctgggccagggctgacagggaagcccaggagtcttttgaacccactcttcctgcctagaatagagacaggacaggctttatgtcccccattcctccctcccaactccagggacattgaaagtgtcctttgtacctacctgcaggaaattggggggctgggagggagggaactgaaaatacacatttgttatcaaaaataaacccctgagggggaggcggcaggaagattgccccccacatcccttccttcacatccaccccaccaaatataggaagagatgactccctctcctctattgaaaagccccatttaaaaatagattatactatcaaaatggcagcaggggagagacagggagacctggagtactggctggaggggccccccagacaggaaccacccccacaaaacccctccatgggaggaaacaggcaggaccccagggagtttggcagacaaaggaatggcttctcagggggaagaagaacaaagggacattcctccctggccaaaaagttggttaaaaaaggataagctgtctgagagaaaggttgaggaggtggaaatttctattccaagggtgtgattctgccttggccaagactcccaacccattaaatggtacaaattcttcctggaccccgagtatggccaggaataataaaacgaaactaacttctactcacatcctaaaatggacacagggctccctcatctccccacgggcaggccgaggaatgaagaaagaaaggtcgttctcaagccagaccccgattgtcctgtcttggggaaaaaagcggggaggtgggggagacgtcctgaccaccctaataggttaggtcaggcgcttcccagtggccttcaaaaaataaataaataaaccgcccctaccattgaagtaggagacgtgtcagggcagccactgggggacggacagaaaagagagaaaagagagaagctgtggaagctgagtgttttctgtggaggagttaatgagagtcactcctgggagaaatccttcccaaggatccccaccccaccacaatcagagcatgagtctttcagttgaactgtgtttctccttgagagagcacggatggagggaccccagaaggggtggtggtgctggtggtggtcatggcctctggggccctggcgagagcaccgcgggggtcgagaggccagccacgccgatggaagggatgtgcacctgggcgccgccactggacggaagctggcaggagagcttggccgggctgcggggcgcagcgggactcaggctgctccggaagtgaacgctgggaggcagcgagctgggtgtcagcagcgccggggtcaacgtgtgcgtaggaagcagggacagggtcagcgccggcctcggcgcctggaggccggagccagttcccgatcctggggtccgttcggctcccggcgcacctagcaggctcgggctgagtggaagctctaggtcccggggcttccggcccttctgcggctgggagatctgagggctggaagccgcgtggccgcccgcctgccctgcggtgtccataaggacctcggcagccacgctggcacgccctcctgtggagggacttcaggctcggccttggcggtttctggcacgaaccctctctcccccgcgaattccagctcttcctcgggcccttccacttccacttccgggggcaaagggcggcgcaagcccggctccacattcggctcttccaatttcaggtttggggcctcgggcggggtcaggatgacctgcagagggaagccggcttcctcagcctccaggcaggcctcccaggggcttggactgcaggagctgcgttggggagcaccgcagcaggccgaggctgagggggtggctgcggctgcagagactggatgtgaaggtggaacagaggcccgagcgcatgtacttgttccggctgttgcgcgccaaaccgccagggcctgccattcctgcacccttgggtgtgcctggctttcctgaggcagtgccccctggggcggcatgtgcagcagcaggggccacaactgccatggtgaagtaaccgacacctctgggtggggcgggcagtcctcactcagtggagcaccctgcgacctcaggataggacacaaacttgtagaccaacttctggccgctcaccttgcggatgatgttctcgtcatagtcgtgagaggtgacagcatgctggcagccctcactcgctctcggtgcctcctcggccttggcgcccactctggccacgcttgaagagcccttcagcccgccgctgcaccgtgggagcccttgtctgggctggccgaggccggagccggctccctcggcttgcagggaggtgtgaagggagaggcacgggtgggaaccggggctgtgcgcggcgcttgcgggccagcgcgagttctgggtgggcgtgggctccgcgggccccgcactcggagtggcaggccccgcctgccctgggcagtgaggggcttagcacccgggccagcagctgcggagggtgcgccggggtccccagcagtgctggcccaccggcgctgtgctccatttctcactgggccttacctgcctcgccgtagggcagggctcgagacctgcagcttgccatgcctgagcctccccgccgccccccaccgccacccgccggcatgggctccggcctggcccgagcctcccggaagagcgctgccccctgctccactgcgtctggtcccattgaccgtccaagggctgaggagtgtgggcacacagcgggggactaacaagcagctccacctatagcccaggtgcaagatacactgggtgaagccagcagggctcctgagtctagtggcgacttggagaacctttatgtctagctaagggattgtaaatacaccaatcagcaccctgtatctagctcaaggtttgtaaacacaccaatcagcaccctgtgcctagctcagggtttgtggatgcaccagttggcacgctgtatctagttaatctggtggggacttggagaacctgtatgtctagctaagggattgtaaatacaccaatcagcactctgtatctagctcaaggtttgtaaacccaccaatcagcaccctgtgtctagctcagggtttgcggatgcaccaatcggcactctgtatctagttaatctggtggggacttggagaatctttatgtctagctaagggattgtaaatacaccaatcagcactctgtatctagctcaagagttgtaaatgcaccaatcagcgctctgtgtctagctaatctggtggggacttggagaatctttatgtctagctaagggactgtgaatgcaccaatcagcactctgtatctagctcaaggtttgtaaatgcaccaatgagcactgtgtctagctcagggtttgtaaatacaccaattgacactctgtatctagctaatctagtggggacgtggagaacttttgtgtctagctcagggattgtaaacacaccaatcagcaccctgtcaaaacggaccaatcagctccctgtaaaacagaccaatcggctctctgtaaaatggaccaatcagcaggatgtgggtggggccagataagggaataaaggcaggctgcctgagccagcagcggcaacccgttagggtcgtcttctataggggaaagctttgtttttcactgtttgtaataaatcttgttactgcttcgtttttgcatttacagtgcctttgtgagctgtgacactcatggtaaaggtctgtagcttcatttctgaaaccagcgagacccccaacccaccaggaagaacaaacaactctagacgcggtgccttaaaagctctaacactcaccacgaaggtctgcagcttcagtcttgaaccaccgagaccacaaacccaccagaagaaaaaaaaaaacaaaaactcggaacatgagggaacaaacggcgggacatgccgcctattaagaactgtagcactcactgcgagggtccgcggcttcgttgttgaagtcagtgagatcaagaaccgaccaattccagacacagtagtacggcaaggcccgcctgagcttgtcgtaattcacgttggtcttgttcttgcgtcgcccccacggctaggccaccttcctctgcaaccaccaccatcccatgaagtccaggagctgtggccgttgccttgctctcagctgcagcagaaagtgccagagcgtcacaggtgggtccatcgccgggggagtgctcacgccatcctaggggtacctgtgtgtagcggggcggtggtgctggccatgctggcagctccgggaggtggggggctccatacgcggccccgccgccccccaggcctgggtgcggaggccggaaggttttttttttttacgttttaagtaattggcttaggaaaaacaaggatttttgtgtgccatcaagataacttgtgcttcatgttgtttttcattatgtcagtgattcacgaaaaaggtaattttttttcgcaaagacatttttctgaagtagagagctgcgtttgacgtcccaagtctccgcaaggtgtaacaagacaagcatcaaaagtaatgatttggggtgactttgccgtggttacattaataatgagatgtggggtagctaagggaaagagaagaggaaatgcggacaggccaattaggcttttttctttcacgttactctggtgggggttggtcctgggatgaaggtccgtgactttggagagggagactcctttttgactgggtatggtgggtctactccttagcgggctgactgccgtctcagtcgttaggagcatcacataaggtcctttccaggtgggttcaagcttttcccctttccaacttctgataagaatgtgatctcggggctggtgttgaactgagaattcaagggaggagaggatagaagacagactggatacatagtttttaagaaactcatcgtttgtctcaaatgttgggaggtgagtagtggaacttaaataaagcaacccatgaagcatttcataaggggataggccgatgtcttttcagggagcagttcagactcttatagggccatgggaagacacttagtcatggtaaccgggtttctagaattaatttaggtaggtgggtttttagagtctggttcattctttctgctcttcctggtgagggtggatgccagggagtatggtattcccactttatttgtagtgcttgggttagccctttaatgagcacggtaaagtgggtcccattgtctgaatcagtggtctctgttagtttgaacctgggtatgatgtgttctaacagggttttaactgcatcactggctgttgcgcgtgggaaggggagagcttctgcccagtgggtaaggtggtctgctatcactagtaaatacttgaggtggcctattggggtcatttcaatatagtcagcttggatgctttggaatggccttacccctggattgtaggctgggcatggtggctcatgcccataatcccagcactttgggaggtcaaggtgggaggatcctttgagactaggagttgaagacaagtcttgggaacttagtgagaccctgtcactacaaaaaaataaaaattagcccggtgacatggcacatgtctgtaatccccaccactccgaagactgaggtgggaggatagcatgagcttgaaaggtggaggctgcagtgagcaatggttgcaccactgtattccagcctgggtgacagagcaagagcctgtctcaaaaaagagattttaaactaattaggcttttttttttgtttgttttttttttgagacagtctcactctgttgcccaggctggagtgcaatggtgagatcttggctcactgcaacctccgtctcatgggttcaagtgattctcgtgcctcatcctcccaagtagttggaactacaggtgtgtgccatcacgcccagctaaattttgtatttttagtagagatggagtttcaccatgttggccaggctggtctcaaactcaacctcaggtgatctgcccacctcagcctcccaaagtgctgggattacaggtgtgagcaactgtgcctggtctaattgggcttatttgataagtaaagttataaagaaaacaaatagtatttgatactacatctttaaatcatatttttggatatgtcattaatgaatgcttcagaaattatgtggaaatcctagaaatcggatatgtcctggtataattttatcagccataatttcagatattgtgttaaagtgttgtatgttacagaaataaccagatttccttgtcaattgtatcattattataatgaactctcatcagatctttaaaaatggccattttaagcctttgccattcagttattcttttcctttgattctttactaaagtaatttgcaattaggtagacaaaagtggctattcttcaagattcatgaaaaagactctgacagttactccgaaatacagaccgctgctgatagctttaagatcataccattggactgtgtaagaattttcagaaatggaatgaaaaaactgatgtcatcagactactaatccagcttcaaacagaacaagattcaattacatgggactgaatgaacaaaggaagataatttttttttttttttttgagatggagtctcactctgttgctcatgctggagtgcaatggcgcgatctcggctcactgcaaccaccacctcccgggttcaagtgattctcctgcctcagcctcctgagcagctgggattacaggggtgcgccaccacacccagctaatttttttgtatttttagtacagacggggtttcaccatgttgttcaggctggtctcgaactcctgacctcgtgatctgcccgccttggcctcccaaagtgctgggattataggtgtgagccactgcacccggccgaggataatttttaaatgactttttgttggaaacattgctggttctttaatgttttgtttttcagattttagaaaacttttttcccttaagctgtcaatagtttgcagcaatttggtaagttacatctttgtgaacagagaggaaacaactattttctcccttcctaatccctccagaaccccaaaaccagtagtgagtgtttttattgaagggggccagcccctccacacctgtgggtatttttcgtcaggtgggacgagagactgagaaaagaagtaagacatagatacaaagtatagagaaagcacagtgggccaaggagaccagggctcagcatacggaggacccgcaccggcacgggcctctgagttccctcagtatttattgattactattttcactatctcagcaagaggaatgcggcaggagaacagggtgacagtggggagaaggtcagcaagaaaacgtgagcaaaggaatctgtgtcacaaataagttcaagagaaggtactatccctggatgtgcacataggccagatttatgcttctctccaccctaacatctcagtgtagtgaagagtaacagcagcattgccaccagcatatcttgcctccagacacagggcggttttctcctcagaataaaatgaatgtatgatcaggttttacaccgagacattctgctcccagggacatgcaggagacggaggccttcctcttatctcatccacaagaggctttcctctttttttttttttttttttttttgttgagacagagtctcgctctgtcgcccaggctggagtgcagtggcatgatctgggctcactgcaaactccgcctcctgggttcatgccattctcctgcctcagcctcccgagtagctgggactacaggcgcccaccaccacgcccagctaattgtatttttttttttttttttagtagagacagagtttcaccatgttagccaggatggtctcgatctcctgacctacctggtgatccatccgcctcggcctcccaaagtgctgggattacaggcatgagccaccgcacccggccgaggccttcctcttttactaatcctcctcagcacagaccctttacaggtgtcgggctagggggacggtcaggtctttcccttcccatgaggccatatttcagactgtctcagggcggggaaaccttggacaatacccaggctttccagggcagaggtccctggctttccgcagtgcattgtgtccctggttaatcgagactggagaatggtgatgacttttaccaagcatactgcctgtaaacattttgttaacaaggcatgtcctgcacagccctagatcccttaaaccttgattccatacagcacaggtttctgtgagctcaaggttggggctaaagttacaggttaacagcatctcaaggcaaaacaatttttcttggtacagatcaaaatggagtttcttatgtcttccttttctatatagacacagtaacggtttgatctctcttttccctacacttatttttatgacagtagagttatttgtaaaagttcagtaagaatctgttctccttgtaacggcacaattacagactctgatgatattaccaaggctttgaccggaatatcctatcttcagatacgaccacacagctttaaggaactagagttgactttatggagccagtaaacccccccttggaaaaattggcctgagggttcccagtcttgcaggttgagtaaggcagcccagcaacctctgtattttggggactgagcagaaaggaactcacccagatctataggtaccctgtgccaagtcagatggcatgtccttgatgtggcttcccagccccgggaggcctttacagttcaatctgagattctttatgaaaagctccagcaaagcaattttttttttattttgagacggagtctcattctgtcacccaggctggagtgcaatggcgtgatcttgactctgcaacctccgcctgccaggttcatgtaattctcctgcttcagcctcccgagtagctgggattacaggtgcacaccaccacactcagctaatttttttatttttagtagagacggggtttcactatgttaggcagactggtcttgaattcctgacctcgtgatccacctgcctcagtctcccaaagtgctgggattacaggcatgagccaccacgcccagcctccagcaaagcaaatttaaagagagcgaatgtggtcaactgcttcttgttgcacttatgtaaacaatcaggccaagtatagtgaaactagactgactttgcaaacatatcactcttatttggatcaacatttatggaaatgtgggagtgactgtggagaaaaaaatgattcaatgcaaaactgcagggcaccgtgatgagatttcagccctgctcattgtttacgaggttttgttatttatctacaaactggactggatcttgaatttttagggaaaagaaagatcagactgttattgtgtctatgtagaaaaggaagacataagagattccattttgacctgtaccctaaacaattgctcacagaaacctgtgctgtatgggatcaaggtttaagggatctaggctgtgcaggacgtgccttgttaacaaagtgttcacaggcagtatgcttggtaaaagtcatcgccattctccagtctcgatgaaccaggggcacaatacactgcggaaagccgcagggacctctgccctggaaagccgggtattgtccacggtttctccccatgtgatagtctgaaatatggcctcgtgggatgagaaagagctgaccgtcccccagcccgacacccgtgaagggtctgtgctgaggaggattggtaaaagaggaaggcctcttgcagttgagatagaggaaggccactgtctcctgcctgcccctgggaacggaatgtctcggtataaaacccgattgtacatttattctattctgagataggagaaaaaccaccctgtggtgggagacgagacatgctggcagcaatgctgccttgttatttactccgctgagatgtttgggtggagagaaacataaatctgtcctacgtgcatgtccaggcatagtaccttcccttgaacttacttgtgacacagattcctttgctcacgttttcttgctgacctcctccccactgttctcctgctgcattccccttgctgagatagtgaaaatagtaatcaataaatactgagggaactcagaggccggtgccggtgcaggtcctctgtatgctgagcgctggtttcctgggcccactgtgctttctctatactttgtctctgtgtcttatttcttttctcagtctctcgtcccacctgacgagaaatacccacaggtgtggaggggctggccccttcagaattcttctagttttctctaatatcaggcaacaactctgcaaactaatttttccaatttttccctcaccctctgacttggaatcagtcaaatttaaaactgctctgttcctgaagccctgtgagctgaaatgggacaagttgatgtaaactttagagaaatcatccccacagatcctgtgcgggcagcttctgcaacacctgacctgcaaatcaggaaggcccttcagctgcctacctggctgcagctgaagatgcttcaggcccagcgtctagaaatcttccagcctggtgcccactgggttcggaaactgcatttctaagtgttaacctttgtgtttcgtttattttcagagtctctcctctttgaatgtccaactgctagcaccatgcggcaaaatgtcctcttctacccagtcccaacagaaaatccagctggttcttaatgaacgaaaggccacccaacaagaaaatgtacttatattgttggagggaaaccagaatgtctcctctttctttaaacagggtggactgacaaagattctctgcttggccaaactacagtcgggctctggaaccttctcctaggccagcctgcacttccttgtaagaaaaaggctttaaaaagtacccggtggggcccggagcggtggctcatgcctgtaatcccagcactctgggaggctgaggtgggcggatcatctgaggtcaagagttcaagaccagcctggccaacatggtgaaaccctgtctagtaaaaatacaaaaattagctgggtgtggtggagggtgcctgtaatcccagctactcgggaggctgaggcaggagaatcgcttgaacccgggaggcagaggttgcagtgagccaagatcatgccactgcactccagcctggtgacagagtgagactccgtctcaaaaaaaaaaaaagaacccccctaagtcaggttaaagacccactcttgacatctgatcacccttgatcctgagttcctcatcttccaccatctcccaggtctgatcaccctggtctgtcttcagcaaaaatcttcctgggctaatttagccagaaccctccttccccccaatatttcctcttgggaatgtccgtcctccgagtttacccagctccctccttggctgtcgatccctgccagcccatgctgtgttaagaactgagccccatctctctcccccatggccatggtccctgctcctgtggcggtggtcctgaatcacacctgcttccgcattgaacaactatcatggaataattttttctttaacatttctaaacacactcttaggaggcgccagcagccagcgtgcggagttaagtgcctgtgccctttgtatgaaagtgtcaccgttgtcctggtcttgaggggtggctttcgggtgtaaacggccggcagaggtgagtagatgctgggaggctgctccaggcgtcttgtttgctccagggttcttgagactctcctgtctatgagaacgtgcagtggcacgggacggccgccggggggctcccgagtccggctctggagtctgtggccgcgcgagtgcacctgcctgggccggccctgacggattttttttttttttttttgatggagtctcactctgtctcccaggctggagggtagtggcgcgatggcagctcactgcaacctccgcctcccgggctcaagcgattctcctgcctcagcctcctgagtagctgggaccacagacacccgccaccacgtccagctaatttttgtgtttttaatagagaccgggtttcaccatgttggcctggctggtctctccaactcctgacctcaggtgacccacccacctctgcctcgaaaagtgctgggattacagatgtgagccaccacgcccggcctccttttggatgcttctaaagtctctttgtctctggtgttggcagttccatcggcaagcgtcaaggtgtggacgcggtttgcttttatttatcctgcttgggacttggccttgatcctgacacatcctgttattcagcgattttggaaaattcccagccactgcctcccccgactctgtttctcctttgggcagaagaagcccttgtgggagcctcggtccagcctccgcggggctgcgctcgggctgggtggcgtctcctgctctttcttcggtgttaccagctcctgctcctgcgtgtcctctgcgctgcctgtcccatccattcttattttagcctcatctattacggttttcagttctagaagttcttcgtaaaactctcaggtcatttcaaaatgcaatgtgcagtaatttcccattttgcagtaatatttgaatagcttctgtaagtaagtttaaaaaatctcttggccgagcgtggtggccacgctgtaatcccagcactttgggaggctgaggcaggaagatcatgaggtcaggagatcgagaccatcctggctaacacggtgaaaccccgtgtctactaaaaatccaaaaaaattagtcgggcgtggtggcgggcacctgtagtcccagctattcaggaggctgaggcaggagaatcgcttgaactcgggaggcggaggttgcagtgagccgagatcgcaccactgtactccagcctgggcgacagagcgagactccatctcaaaacaaaacaaacaaaaaaaccctcttaagcacacattgcatattctatgtctgataacgccgacattttgcttttgtttgggttcttattctatagtttcttgtttcactgattcttgtttctgcttctttagggcttttctgatttgtatgtgagctgggttcctgggatcctgatctgggcgcgtctttgaggcttgcctctgaggtccgctgtccccgcatgagcggacggcagagcgcgcctgcctgggagcccaggaggctgccgggccagggaccccgggaaccccgggaaccccgggaacctctcagcagcagaactgcagtggcacaagacggccaccagggggtcccgagccggtctctggggtccctgctggggttgaggggctgtggctgcagacgcggacctggcagggggacccgaaccccaacagggccctgaccggccccaaggctgagcctgccctgtcccaccagcgcccagaccccgatgttgggccggggccttcctttccttgtcccgaccctctgaggttcctccccggggtgtgagctgattgtgagcacacggaggccttcctcctctctggggctctggagcccctgggggcctgcagggcctgggcctgggcctggctgctgtcctctgtgctcaggaggcttctcccacccacccacttccgggcacagcccccagccccacacccagccgccgggagggcatccccaggggaggaccctctgctccggagccgcgtcccttgtcctccagggacagtggccggaggctggtgcctcaagctcgtgcgcctcatgcagcatcccgtgggtccattcgcgaccatagtgaagacccgcaggccccaggcccgagccggctcccgggcaggccgcgttctggggcttctgcggggacactgggccacgccaggaggaagggtcctgaccagggtcagggagcatcggatgctgccggcagaagtggggggcgcggggccccaccgaggagcccaggccagcttccccatctgccccaggtgcagccctgcaaggcccccaggccacagcgtccccaggtcacagcgtccccaggtcacagcgtccccacacccagggaatgcaggactttggcagaggctgggatcccagaccacagagccccacaagctgacgcctgttcgcggatgccacagccatctccgcggcaggcgctggggaggggaggggatcacagtgctggacacggaccgggccccagccctgagcccaaggcagagccgggatccggccccgagagcgcccctgcccctgcccctgcccctgcccctgcccctgcccgtgcccctgcccgtgcccctgcccctgccccgagcccgggaagcgccgcgtggtcggcggcgttcgatgctgctgtcggccacacgggggcagcagagcctcagcggctgccgcagcgggtccagtttccggccgccggggttgggctggcggtgcctgggggtcctccccagaggcccgcgtgtgaaacgtccgagtgcgctgggcgctggacacggagatgggtgcttgggccacgggcctgggggaccccacacggccggctaggcaggcccagacagcccagggtgggggttccatgggggcaggaggggagaagcctgggctgtggagcagctgggacgtccggggaagggcctgggggtcagaggggcggctcccgggacagggaggcacgtggaggggcggggtttgtggcagccccggagccgcctctgaagcttccatctgcagcctcctgtggggccgggtctgcttctcttgctgggcacccacatccacccccgaggggtgtgcgacaacccccattccagcccactcagatggtctctagcccctcccgtcacagtgaaccccggtgtcggtgcgagacgcctccgtgtattcccggacgtccctctgcaggcccatccccacctcacagacagtcacacccttccaggccttgccccatccgcagtccctggcctcaccatcgcattgcagggaggcgggcatatgcaacctccatgaaataaagccctaacggagaaggccagagtgggaacttcgtttccaccagcaggtggggcagacaccctggctagccccggggaaaaccagtaaaaatactggatttaaatcccttcgaattctcctttctacaggcaagctgtttagtgagaaagaaagggccctgcaaagatcctccccaggtggacgggcagcccccaagcctgtattgagctcccggacgctgctcctggggaagggcctgccgaggacaggggccagtgggagcccctgcctgaccacaggctgttctgcagcccaggtcaggagcgctggtgcctgccgtgtggggtggccctggtcctgaccgcctggggtcccaggtggtcccgggttgtaagagtctgtggtgcttgtgaaaagcttgcacatccttccaggggagactcgcgcgtggggcgagggcaggagcaggagctcataatcacacaggaaaacaggaagccctgaaccccgggctcgggaagcggcggggcgtcaggtttggaggggcttcgtcccccaccacctccccatttgcacccccagtccctgacccgcatctttcctcacctggtcactgtcccccaccctgtcccccaccctgtcccccaccctgtcccctgtctgccatctccctcccaggagggggctgctcctgcctagcacgcggtgcccttcctcccacgtcgcttaattatatttgaaaatacaacatttgaaacgtgcaaagaatggaggggcttttctgtgagtgcagggttcccctcccgtgtccccccaccagggggcttccccgtccagccccggcttgtccctttcattttaacaaaacgtcctcaccacagtgcatgtgtgttttataaaagcagtattggaagttaatgcttttaatacagaaaaaaaagaacccgaaacaatataactgtcctaagtgatgttgagtggggagtgccgggtgggagttgaactgcgggaccacgatccctccacttccagcctgtcctgggggtgtcatgtggccccttctgaccagccctgggcaacttctggatggacgggtggggaggggccgtggaggggatctgggaccaggagagagagagcgtggccaggcagccccaggagggccctccagagcccgagtgggcctgcgtctgtggtccccaggtgcggtccctcgaggtggcgtgtgggccccccaggcccgcgccctgcggttccagcgcctccccaagcctctgtccctgcagcccccaccccccctgcactttcctctcctttgtctgtgctggtggtccctctctcactgtcccacacaacaccgcaccgccctcccccaggaaagcctccaccttttctcttagtgaaatagaagccctttcaaggtgacatgtcacctactcacagaacagtgccccaacccaggacgcagcctgaggcccctcaggagcattgtgtgcccccaggcctgtccccagtggtccccaccgtgggcccaccacagctcctgctgtcaagggcagcctgggtctgagccccgtccccctgtgcagggcacgggtctgggggctggcttgtcccctgctgggcggtgggcggcctggggtgtctcccagacacgctgcctgcggccggctggtgtggactgggcctggtgggccaggagctgccctcactatggtgacaggatcgggctgccaggctcctgtgggggctcagcaggaggggatgggagacggcaatgctcacgcctgacctgctgcccttgggggagccgtggtgccacctggccggcctgcctgagagacccccacggctggtgtgggagcctgggggagccctgggcaggtggtggggcagtgggcagaggtggctgcagagggacagggcctggccaggacgtcaccctgaggccactggagaggtcagcaggggcccaaggagatgcagggattggcagctggggagcacaggggtactcctgagccgtggtacccaaaggtcatgagctgagaggggaaaggcccagagccgctggatggtggattctgggcacctgatccgcagggtgtggtggccctctgagggacccctctgacagactgcaggcaagctgtcaagggtgtgtgtgtctgagggtgagtgagtgtgtgtgtgagggtgtaagggtgtgtgtgagagtgtgggtgtggagtgtgtgacagtgtatgagggtgtgggtgtgagggtatgtgagggtgtgtgggtgtgtgtgtgtgagggtgagtgtgagaatgtgaagtctgagggctgtgtgatggtgtgtgagggtgtgtgtgagagagggtgtgagggggtgtgtgagggtgtgtgagggtgagtgggtgtgtcggtgtgagggtgtgtgggtgtgagaatgcatgaagtctgagggttgtgatggtgtgtgtgggtgtgtcagggtgtgtgtgtgggcatgtgagggtgtgagggtgtatgagggtgtgggtgtgtgagggtgagtgggtgtgtcggtgtgagggcacatgagggtgtgtgggtgagtgtgagagagaatgcgtgtgaagtcagtgtgtgatgggtgagggtgtgtgggtgtgtgagggtgtgtatgagggcatgtgagggtgtgtaagggtgtgagggggtgagggtgtgactgagagtgtaagggtgtggggatgtgtgaggatgtgtgtgtgaggatataagtgttaggggtgcatgagagtgtgagggtgtgagggcttgtaaatgtttgtgaaggtgtgggagtgtggagatatgcggaagtgtggggtgagtgtgagggttgtgagaatgtgtgggagggtgtgagtgtgggatgtatgaagttgggattgtgtcagcatgtgtgtgagaatgtgggtgtatgagggtgtaagggtgtgtgagaatgtgggtgtgtatggatgtgtgggtgtgtggatgtgtgtgggtgtgtgaagtgagaatgtgtgtgtgggtgtgtgtatgagggtgtgagggtgtgagggttgtggatgtggggtgtgtgagggtgtgagggagtgtgggtgtgtggtgtgtgagggtgtgtgtatgtgtgtgaggatgtgtgggatgtgtgtggatgtgtgggagtgtgagggatgtgtggggtgtgtggatgtgtgggagtgtgaggatgtgtgagggtgtgtggggatgtgagggtgtgtgtggatgtgtggggatgtgagggtgtgtgtggatgtgtggggtgtgtgtggatgtgtggggtgtgtggggtgtgtgtggatgtgtgggagtgtgaggatgtgtgggtgtgtgtggggtgtgtgtggatgtgtggggtgtgtggggtgtgtgtggatgtgtggggtgcttcagaatgtgtgtggatgtgtgggagtgtgaggatgtgtgagggtgtgtggggtgtgtggatgtgtgagggtgtgagggtgtgtgtgcacgtgtggggtgtggggtgtgtgtggatgtgtggggtgtgtggggtgtgtgtggatgtgtgaaggtgtgagtgtgagggtgtgtggatgtgtggggtgtgtgagggtgtgtgagggagtgggtgtgtggtgtgtgagggtgtgtgtatgtgtgtgaggatgtgtgtggatgtggggtgtggggtgtgtggggatgtgtgggagtgtgaggatatgtgagggtgtggggatgtgagggtgtgtgtggatgtgagggtgtgtgtggatgtgtggggtgtgtgtggatgtgtggggatgtgagagtgtgtgtgagtgtgagggtgtgagggtgtgtgtggggtgtggggtgtgtggatgtgtgggggtgtgtggggatgtgagggtgtgtgtggatgtgtggggtgtgtggggtgtggggtgtgagggtgtgtggggatgtgaggatgtgtggggtgtgtggggtgtgtgtggatgtgtggggtgtttgaggatgtgtgtggatgtgtgggagtgtggggatgtaagggtgtgagggcttgtggggatgtgtggtgtgtgtgagcggctgtgtgcactggccgagttgcctgctgctgtcctggcctggggccaggcgtgtgccagctcctgtgtttgttgtgtgcccggcgtgtgctgggtgcccgagtcgggctgggtgtgtctgggtgtggccctggggtgtccctttctggacgtgtgtctccgtgcagaacggaggtcctcgtgttcccagaaggaagcccccagccccaggcgggtgcctgagaatagacctggggcctgtgggcgtggcagggctgcccctcggctcctcatggaccccccggacaccagtcccaccctgtgtctgtgatgctcactctctgagccttccctgaccccatgtgccaaagcctggcccagcaatgccacgtgtgcatgtgtgagcgtgagcttggcagcgggtgggagaatgtgtgcgtcagtgtgtgagcgtgagcacggcctgtgcttgtctggctgtgggactgggggcctctgtgacgctgtgagcccttgtggacctgagtgtgggccgtgtgagctgtgtgcacgtggctgtggctgagtgtgagcctctgagtgtgtgtgtctgtgccgtgtacctctgtgtgtctatatgtgtctgtgtgcctctgactttatgtgtgtctgtatctatctctgtgtgtgtctctgcgtgtggtagcatgtctgtgcttgtgtacctgtgtctgcgtgtgtctttgtctctgtgtgtgcctatgcgtgtctgtgtgtggtagtgtgtctgtgcttgtgtttctgtgtctgtgtgtctctgactctgtgtgcctatgtgtgtctgtgtgtctctgtgtgtgtggtagtgtgtctgtgtgtctctgactctgtgtgtgcctatgtgtgtgtgtgtctctctctgtgtgtgttagtgtgtttgtgtgtattgtgtgtctttatgtctctgtatgtctatgtgtctgtgtgtctctgtgtgtttgtgtgttctgtgtgtctctgtggggtgtgcatgactatatttgtgggaggctgtatgtgcaggaagggccccctgagcattgtcacccgggctgcaccctgggggtcttcccagggatcctttcctcaaacttgagtcctccctggagggcttaggttccactgagggggtgggcgcgggcacagacccctcctctaggaggctggggtggggctgtcctgcctggctgggacacgggtcagaatgtccccccatgtggtccaccctgttctaggcacagggtgtcatctcccagggtctcagctgctggggtgatgggccccggacagcccctgggtgtggggtggggtcctatggaggcctctgtgtcccactgaagatgcagggctggggttgggcaggtctgttctggggtggtctcgtggggcaaccccagagggtactgaggccggggtagggttgggcgaccccacctagggtctacgggctgaaagcgcctgggttggccaggcctgggcacaggggaggacagaggtttggtgacaggtgggctgtgaggggcccagcaggtgcacggaggaagctctgtccccaggtgacccacaaaatcctcttccgagggtgctgggggtcctgttcctgggggccatgcctgggacctccatgcaggggtctcctccctggcccagctcccctggggcaaggtccgacttgttaccccctccaccaggcagtcctctgggaagtgccctggggcctggtcactctgggcctggccacagcattggcctggacatggggtgtggctggggagtgtgaatagtcaggaatcctgcaaaccagctgcctgggtgccagccttccccccacctcccccaatgcaaatcgccatctcggaggtgggtgggggtttccacaccactgtcccacctgctctgtggttcccattttcagcatttttagaaatatttgcaagaatgtgtttgtgcctgtgtggtggggtgggggtgggagctgcggcccggtgcccatgaggtcttgtttttcagactggacgggggtgggggagggggagctgcggcccccccacctgctagtgtgtccagcctcctgagtggggcagcgagcgtcctggctgggccccagggcatgacccccgatgagtgtgaggcgctgaggccgagtctggtccttggcgaggaggcccagaaggcccaggtgcccgtcctgagcgttatccagggccctgcctcaggcctcatgccggggccaagcccagggctggctggtggccacgcagagctgagaggggcggggaagtgaggctgggttggaggaaagctgaggggcccaggcctcccactccagcccccgaggcagaccctggcccacccagggaccccctcccatgcacacaagcacacacaacacatatatgggcatgcgtgtgcacacacactcgctgcagcccgcagcactggctggcccaggtgtcctcgggacgtggtccacgcggtgctgacacgagctggccctgagcgcgggctctgcggggtgccattcccaggccctgcaggggcacatgcggtgtcgtggggcagcaactgtgacctctgccccgcagacccggacatgccgccagagaggccaaggcgtacgctctccgagccttccctgaccccatgtgcccaagcctggcccagcaacgccatgtgtgcatgtgtgagtgtgagcttggcaacaggtgggagaatgtgtgtgttagtgcatgagtgtgagcatgagcgtgtgagatgcaagcgtgtgtgcagtgagtggtggatgagctggaggtgtgaggttgtgcgtgatgcggacaggtgtgtagtgtggacaggtgtgtggtgtggacaggtgtgtggggtggacaggtgtgtggtgtggacaggtgtgtggggtggacggggtgtagtgtggacaggtgtctggtgtggacaggtgtgtggtgcggacaggtgtgcggtgtggacaggtgtgtattgtgggcaggtgtgtggggtggatggggtgtagtgtggacaggtgtgcagtgtggacaggtgtgcagggtggacaggtgtgcggggtggacaggtgtgcggggtggacaggtgtgtggtatggacaggtgtgtggggtggacagggatgtggggtggatgggtgtagtgtggacaggtgtgtggtgtggacaggtgtgtggggtggacggggtgtagtgtggacaggtgtgtggtgtggacaggtgtgtggggtggacggggtgtagtgtggacaggtgtgtggtgtggacaggtgtgcggtgtggacaggtgtgtggtgtgggcaggtgtgtggggtggatggggtgtagtgtggacaggtgtgtagtgtggacaggggtgtagtgtggacaggtgtgtggggtggacaggtgtgtggtgtggacaggggaggcaggttcatgacacggggcaggacagtggccaggggctgcaagcgtgacctgcgggagggggtgcctgtgtgcgggcatgtctgtgtgtgtctttatgtgtctgtgtgtgtgtgtctctatgtgtgtcagtgtgtgtctgtgcatccacgtgcatgtgtgtgtgcatatccgtgtgtctgtgtctttatgtgtctgtgtgtgtatgtgtttgcctgtgtgtgtctctgtgtctgtgcatccatgtggatgtgtgtctatatgtgtgtctctgtgcacatatgtgtgtgtctgtgcatgtccgtgtgtgtctgtgcatttctgtgtgtgtctctgtgcatgtctgtgtgtgtctctgtgcatgtctgtgcatgtctctgtgtgtgtgtctctgtgcatgtctgtgtgtgtctgtgcgtttctgtgtgtgcatgtctgtgtgtgtctgtgtgtatgtgtgtgtgtctgtgcatgtctgcgtgtctgagtgtcaggggatggcctgtgcggggctcgcagtgcaggcgggtttgctcacacctcccccgcagggctgagcctccagactcccagccccatacaggccccagcccaggggggagccgggcggtgcttggggcctggagccctgacccggggagtcagggcaggactagggtggaggctctggtgactcagcctcctcgtatgtgtgcactgcagtttgtcctccgtgcatcccttggtggacacttgtggggcttcctgggaggcggccccagacttgggcagattctaggacccagagggatggggcagaggcagggatgacagagacagacacaaagcagagagacggaggcagagggagacatgcagagtcgcggagacatccgggctcaggccccgactctcaggggccacccccagggaggacacgcagtgcacccccacacccacacctcacacacacactcacacccacatacccccatccacacacacccagagacacacagacacccacagccacacactcacactcacgaacttatccagtcacgtcccacacactcccacccaacccatacaccacacacctacacaacccatacaccacacacactcacaaactatataccacacacacaccaaccatacacctatatacactcacacacccatataccacacactcacacacaacccatacaccacacgcacacaacccatacacctatacacactcacacctacaaactatatactacacactcacacacaacccatacacctatacacacacacccatataccacacacaaccatacaccacacacacaaaccatataccacacactcacacaacccatacacctatacacactcatacccatataccacatacaaccaatataccacacacacacaacccatacacctatacacacacacctatacaccacacacagcccatacactacacaatcacaccacaaactgtataccacacactcacacataacccatacacctatacacacacacccatataccacacacacaacctgtgcacctacacacacacatacaccacacacacacaactcctacacctacacacacccaccacccatacacacacagcctatacacctacacacactcatacactcatatagcacacacacaacccatataccacacacacaacccacatacctatacacacacgcccatacaccacacactcacacaacccatgcaccacatacacccacaaactatatgctacacactcacacacaacccatacacctatacacaatcccacaacccatacacacttacacaacctatacaccacacacactcacaatctgtataccacacacacaacccatacagttatacacacacacccatataccacacactcacacacaacccatataccacacactcacacacaaaccatacatctatacacatacccatatgccacacatacaacccatacaccacacactcacacacaacacatacaccacacacacaacccatagaacacaaacacaagtcataaccacacacacagcccatatacctatacacattcacacacacaacccatacactacacacacaacacatacacctatacacacactcaattcatacaccacacacacacagcccatacatctatacacaaactcacacacaatccatataccacaaactcacacacaacgcatacacctatacacacacatgcaactcatacagcacacactcacacaacccacagaccataaacacacacaagccataaccacacacaaacccatacacctatacacacactcataaacaagccatacacccctacacaacccatacaccacacactcacaacccatacacctatatacacacacaaccatataccacaaactcacgctcaacacatacacctatacacacacacaactcatacaccacacactcatacacaacgcacagaccacatacacaagccataaccacacacacacaacccgtacacatatatacacactaataagccatacacctacacatacaacccatacaccacacattcacacataacccatacacctatacacacacacacacaacccatataccacaaacacacacaacctatacacacatacaacccatacaccacacacacaacacatacacaccacacacacacataatactcatacacacacccatacaccacccccacacagaacccatacaccacacacacacaacctatacacctatacacacactcacacacacaactcatataccacaaacacacacaacacatacacctatgcacacacacaacccatacaccacacattcacatacaacccatacaccacacacacacaacacatacatgaaacatacatacaacccacacaccacccactcatacacaacctatacaccacacacacaactcatacacctatacacacacaacacatacacctatcatacactcacaacacatatacctcctatacacacacaacacacacacttcctatacacacaacccacacgcctatacacacatcctcactcacactcaccctcacattcatatactcactaacacacttccacactcacaccctcacccacacttacacccccacccacactcaaaccccgacgctaagtcactgtcacatttgtacccatgctcacacgctcacacactcaccccccaccagctccagggctcactggtgtgtgcccaccaaacccccctcgggggtcccctctgtaagccgacagtgctctgctcatcggtggcctggggaaacagggcccacccaaggcctggctcaggaaaggctccaaacacacatggcccaggagcaaatgggcagagctcagcctgcagctgggagcggccgagcgggtgctgggccagagtcggggcctgtctgtgggtgaggggcacggcagcacgggcccacctgcacctacaaggcctggcccccgaggtcactgggccaccacccagccctcgccctgttccccgtctgtgctggccggggcaggactctgagcctcggggaaacccacagatacacacgggaccccgaacatcgggctggggaggctggggtgggtaacaacatcccagagggaggagcaggaggtcctgggaccctgcgcactgcgaccccagccctgggggctgaagcccaggacagcctcaggtctcccaggagggactggatagtgggggatggtcagagaacaggacagccagcagggtgcagcccgaggacagggatggatgctgggaggtcaacaggacaggggcaggggcaggggctgtggagtgtgagaaggtcctggagggcctggagaacctgtgggtcagtgtctgtgggaaggaggccaggagcagccctgagtggccaggctggcagggatgaggaggtgggggcagtgaggtgagggtgaccgagacaggcctctggccagggaggggaccttggctgggctctgactgaacccagggctcctggagaaggggccccaggcggggatgaggatgtgggcatctgactccatcaacaatggggcttccaacacgcacagcctgggcctcggagacctgggccctgacccgcctccccctggcactgggccgggtgccgtgtgtggtccccagtccccgcagcacctcccccacactggtcacgttccagggcccctctgaagcacctgctgtgaggggatgtgaggaggggacagggacttgggcctgagctgccgggtcgggggggagtcggggacccaggctcagcgtgtggctgcggaccagacagatggggatggaggaggacacgccctgtacccactgcctgccaaggggctggacccatgcccagtctaggccatgtcccccgaggcctgtgaaccttcactctgagccactaaaacattcaggagctttgaaagcagcccccgtccttgtcactatgcgatgactctgagcatcacgctgtccctgctggatccaccctccagccccagcgagggaggctgggccccgggcagcaggtggtgagggcagcgggcacagccacgctacagcacacacagggtctcagggacgcgtccaccacagcccgtgcacaggctccccacggcactgagttcacccggggcgcgggccgtttgtcctcaggagtcccgctgtaccctccgcccccagccctgtcctgctgaggctgcagctgggtcccggggcacagggcggccctgagcaccttgtcatgttggtccctgtcgggtgggctgctggctctctgtggagctggcagagccgcggttcagccttggaggccggtcctggggcccagcagccgtggggagcactgcccagtcccgtgcccacagggaatcacctgggctgaggaagggcccacacgccgacgggatcggggtcaggcagcgcacgcctggcaccgagatcccacgtcccgaagtggggacacggcccaggggcactgttccgggagggtctcaagatggggtctcctatttcaatcttcactccttctgcacctgttagctgggaaccttctagaaggaggggtgtcctcaatcatggggtggttgtgagctgagcacagatcatgcaggaaggtacatggcttctccttcaccaggaaaacagtgcagagagacagagacacagagacagagtaacagagaaagacagagagacagagacacagagacagagacagagtaacagagaaagacagagagacagagacacagagacagagacagagtaacagagaaagacagagagacagagagacacagacagagacagagtaacagagaaaggcagagagacagagagagacagagacagagtaacagagaaagacagagaggcagagagagagagacagagacagagacagagtaacagagatagagagacacagagacagagacagagtaacagagatagagagacagagagagacacagagacagagtaacagagaaagacagagacagagacaggcacagagataagaaagatacacagaaacagagagagacagagacagagatagtcactgtcacattcatacccacgctcacctgctcacacacacacacctcacacacactcacactcacactcacctcacacacacagtcacacacacactcactcacacacactcacacacacacactgagcttccctcaggccctgtcacttccgatggggcctacggcctgtctaagcctctgggccaccagcccctggctcaccggtgtgtgcccaccacaccccgccttgggggtctcctctatgagctgggcacatgccctccgctctgttcatggctggcctgggggaaacagggcccacccaaggcctggctcagggaaggcctcaaacacacatggcccaggagcaaaggggcagagctcagcctgcagctgggagcgggcaggggtagtggagtgggcggagggcctggagaacctgcagggcttcgatgtctctgggaagggggcccaggagcagctcagcgtggctgggccggcagggccgaggaggtgggggccgtgagggaggggtgactcggctgtgtggggtgccgggggacacgggctttgctccggctgagcccaggcagtggcgaatccctgagctgccaggaggagagcagggccggggtcaggcagaggtgggccgcggggccaagggctgcggccggtcgggagcagtcggtcggttgagggcaccattacatggagggctgtgagacgggagaccccattcccttcattccttgtgcacgtgttagtgaggaagcttctagaaggagggcattgctcgtagtgggtgagtgtgagcacagatcatgcaggctggcgtgctgccgtgaagtgcctctctttactttccagacctcagcatggcaagcccgtcctgcgccccagggtctttctggagtacacgccgcgcggtcctggtgggcaccatacctggcacccacgctttggccgggcccgaaccttgcgccctcccagcccccatgtggctctcccttggccatcctggccttttgccagtcctcctacctcaccctagggtctgcctggccctgccctcccttcctagccccccaaggaggctggagggcacccctgcgtccaccagcagcagctcctcatgggcgagtctccttgggccagtgacacatagtgtgccccgatggtgccacggcagcctgggccctccgccttcctgcttggcaggcacccccgctccctgcaccctcaccggggcacctgtgagccctgagggccagtgggggtctcactgctgctccctcccacagcctagcctcgggcctcagggctctgcatccaagcggcccagggctccctgcggtctcagcccgagtgggcctttgagccttcgcgttctctgcagggtgggacctgcccaagggctgctgagggcttcccaggggtcctgtgggtcccacctaggggcaagctggtgaggaaagtgggtcctgccatggcggccgggtgggctgagttttcggcatctctgggcccaacagcaggtccctggagcggcgcccacccctcccccaggcaggtgtgagggctctgatctgtttctccttgagtgactcattctgggcagacttggccctcagggcacatgcaaatggttgtttgttccacaccgaaaacatgtttcttgccctctgaggctgtttccagaaatagcttgcacgattctccacctgcagctgcagccgccacccacccagtgtggccaggctggcccaggcctccagattcggggacaccccccgccccctcccccagcgtggccaggctggctcaggcctccagattcagggacacccccccccccaacagcgtggccaggctggctcaggcctccagattcggggacacccccccaccacagcgtggccaggctggctcaggcctccagattcggggacacccgccccctcccccaggacaggcccacttgggttactgacactgggaccaccctgcaaacgtcaactttattgaattcagtggttctgaacttgttgccatctttgggaccaggacccaggggcagcccccaggttggcaggaagggcaggggagccaacgctggcagggcccccagccaacccccaccccagaagccccaaggaggctgagcggaggtggccctggtggcctgggcacaggcagcccgattggtacaaggcctgtctggtgcaggcccgcacctcccccaccctcatggcctggtggtccccactgtacagagagaacactgaggctcagcagggccagggacatggcctgaggttacatggtgatgggggctgggtctccgggcctgggggccgtggtgggtgcagcacccggactgcgtgggctgtggcctccctgctcccagctctgtcacacccgtctccatctgagcctccagctccatctttcccgctgtccctgtctctggccacccttctgtctccctgtctctctgcctctctgaaggtatctccctgcccgaatctctgtctctgtcccattgtcggtgtctctgactcatctctgtcaagcccgtctgctgggctttgtcccgccatcttgcctgtcttggcctctctctctttctgtgtgtctccgtctgtgcctcctttctccatccatctctcccccgtgtctgtctctatccctccgtctctcttcccgtctatccctccctctgtgcctgtccctttgctgtgtccctttctttgcctctgtctctctgtctgtctcttcgtgtccctgtgtgtgtctctctctgtctctctgcttctctttctgtatctctgtctatatctcagcctctttgtgtccctgtgtgtgtgtctctctcttctctgtctttccatgtctctgtctatatctctgtctctctgcctctgtatctctgtctgtctgttcgtgtccctgtgtatgtctctctctgtctctttctgtatctctgtctatatctgtctctctcatctgtctcttcctgtgtgtgtctctctgtctctctgcctctgtctctgtctctctgtctcttcatctctgtctgtctctgcctgtctgtgtcatttggtgtctctgtttttgtatgtctctctgtttgtctgtgtctcttcctctctgtagctctgcctctctctatctctccttatatctgtctttctctctccctgtttctttctctgtctctttttgtctttctgagtctgtctctgtctctgtctcttcctctctgtatatacctctctgtctttctgttgctgtctgtctctgtttctcttctcctctctctatctctctttgtctgtctttctctgcctttctaactctgtctttctctgtctctctgtctctatctcagtctctcttcttatctctctctctgtctctctcactctctgtatctctttgtctctgtctttctcttatctctatcgctctgtctctatctctctttctgtctctctgtatctctatctctgtctctctcatgtctatctctctgtctttctctgtctctctgtatctctgtctttcatctctatctctatctctgtctttctgtctctatctctgtctctctatctctttctctgtctctctgtatctctctgtctctatctctctctgtctttctctgtgtctctgtatctctgtctctatctctgtctctctatctctctctgtctctccctgtctctctctatctctgtctctccatcccatgtgggtctgtgggtttccccgaggctcagagccctgccccggtcagcacagacagggaacagggcgagggctgggtggtggcccagtgaccttgggggccaggcctggggggtgcaggtgggcccgtgctgccgtgccccccacccacagacaggccccggctctggcccagcacccgctccgccgctcccagctgcaggctgagctctgcccgtttgctgctgggccatgtgtgtttggggcctttcctgagccaggccttgggtgggccctgtttccccagaccacccatgagcagagtgtagggcacgtgcccagctcacagaggggacctctgaggcggggtgtggtgggcacacagcagtgagccatgaggctggtggcccagaggcttggacatgccgtgggccccataggaagtgacagggcttgagggaagctcagtgtgagtgtgtgagcgtgggtatgaatgtgacagtgactctctatctgtctctttgtatctctgtctctctgtgtgtatctttctatctctgtctctctatatgtctctctatctctgtctctctgtatctctatctctctgtgtgtatctttctatctctgtctctctttcttgatctctctctatctctgtctctgtaactctctttatctcttactgcttctgtttctctcactctgtctctgtctctctttatctctgtcttgctctctctctctgtaactttatctctgtctctctgtttctatctctgtttttctctgtctctgtctgtatctctgtctctctttatctgtctctctgtctctgtgtatctctgtctctctgtaactttatctctgtctttttctgtctctgtgtgtgtctgtctctgtgtctttgtttttctctctgtctctgtcaatgtctctttctgtatctgtttctttctctctgtctctgtctctctatctctgtctctatctctctgtctctctgtaactcctcatctctgtctctgtgtctgcatgtctctttctgtgtctctgtttctctctctgtctctgtctctctgtgactctgtctctgtctctgtctctgtctttctctgttactctgtctctctctctgtctctctgtgactctatctgttactctgtctctgtctctgtctctctctgtctctctttctctgttactctgtctgtgtctctgtgtctctctctcgtctgtctttctctgttactctgtctctgtctctgtgtctctgtctctctgcactgttttcctggtgaaggagaagccatgtaccttcctgcatgatctgtgctcagctcacaaccaccccatgattgaggacacccctccttctagaaggttcccagctaacaggtgcagaaggagtgaagattgaaataggagaccccatcttgagaccctcccggaacagtgcccctgggccgtgtccccacttcgggacgtgggatctcggtgccaggcgtgcgctgcctgaccccgatcccgtcggcgtgtgggcccttcctcagcccaggtgattccctgtgggcacgggactgggcagtgctccccacggctgctgggccccaggaccggcctccaaggctgaaccgcggctctgccagctccacagacagccagcagcccacccgacagggaccaacatgacaaggtgctcagggccgccctgtgccccgggacccagctgcagcctcagcaggacagggctgggggcggagggcacagccggactcctgaggacaaacggcccgcgccccgggtgaactcagtgccgtgaggagcctgtgcacgggctgtggtggacgcgtccctgagaccctgtgtgtgctgtagcgtggctgtgcccgctgccctcaccacctgctgcccggggcccagcctccctcgctggggctggagggtggatccagcagggacagcgtgatgctcagagtcatcgcatagtgacaaggacgggggctgctttcaaagctcctgaatgttttagtggctcagagtgaaggttcacaggcctcgggggacatggcctagactgggcgtgggtccagccccttggcaggcagtgggtacagggcgtgtcctcctccatccccatctgtctggtccgcagccacacgctgagcctgggtccccgactcccccccgacccggcagctcaggcccaagtccctgtcccctccccacatcccctcacagcaggtgcttcagaggggccctggaacgtgaccagtgtgggggaggtgctgcggggactggggaccacacacggcacccggcccagtgccagggggaggcgggtcagggcccaggtctccgaggcccaggctgtgcgtgttggaagccccattgttgatggagtcagatgcccacatcctcatccccgcctggggccccttctccaggagccctgggttcagtcagagcccagccaaggtcccctccctggccagaggcctcactgtctcggtcaccctcacctcactgcccccacctcctcacccctgccagcctggccactctgggctgctcctggcctccttcccacaaacacggacccacaggttctccaggccctccaggacctttgcccactccacagctcctgcccctgtcctgttgacctcccagcgtccatccctgtcctcgggctgcaccctgctggctgtcctgttctctgaccatcccccactgtccagtccctcctgggagacctgaggctgtcctgggcttcagcccccagggctggggtcgcagtgcgcagggtcctgggacctcctgctcccgcctctcccatgttgttacccaccccagcccgatgttccaggtcctgtgtggatctgcaggtttcctggaggctcagaggcctgccccgtccagcacagacggggaacagggcgagggctgggtggtggcccagtgacctcgggggccaggccttgtaggtgcaggtgggcccgtgctgccgtgccccccacccacagacaggccccgactctggcccagcacccgctcagccgctcccagctgcaggctgaggtctccccatttgctcctgggccatgtgtgtttgggtgtgagtgtgggtatggatgtgacagtgacttagtgtgtggctgtgagcatgggtatgtttctgtgtgtttgtgtgtgaatgttgtataatagtcgtggtgtgtgtttgtgagtatgactgtgtgagaggggcttgcacctgagttcctgggcccatcttgctgcctctttctctccctgtgtgttctctgcctctgttgtgttctctctgcatgtctgtctccatgtctctttttccctgttcccatctcctccctttttctcccatctctgtctctgtttcttatctatctcatctcatctctctctttctgtctcttgtgtctctgtccctccccgtccctgtctcttatctctctccatccccatctctctctctgtgtctgtctttgtccctgtctctatgtctcttgtctctccccatccctgtctctctctatgtctctgtgtctcttatctctccccatccctgtctctctatgtctctgtgtctcttatctctccttgtccttgtctttctctgtctacgtctctgtgtctctctccatccctgtctctctctatgtctctgtgtctcttatctctccccatccctgtctctctatgtctctgtgtctcttatctctccttgtccttgtctttctctgtctatgtctctgtgtctctccccatccctgtctctctctctctgtgtctcttatctctccccatccctgtctctctctatgtctcttcatctcttatctctctccccatccctgtctctctatgtctctatgtctcttatctctccttgtccttgtctttctctgtctatgtctcttgtctctccccatccctgtctctctctctctatgtctctgtgtctcttatctctccccatccctgtctctctctatgtctcttcatctcttatctctctccccatccctgtctctatgtctctgtgtctcttatctctccccatccttgtctctgtctatgtctctgtgtctcttgtctctccctgtccctgtctctctctatgtctctgtgtctctctgggcccctggtccaatgtccccttcccagaacccctgtttccctggtgtggggtgcaggtccttctgtggtcctgtgggccgtgcttgtgctgggcacagcctgccagggcagccgctcaagccccagggctgggcactgcgtcctggctctggccaagggccctggggagagctgagggaggtgcgtgcagggtgtgaggcccaccacagtcactgccagatgctcagtgctggtgcttccctgggtctgctgtgtggtgggcacagccctcgtgagggctgcccatggaggaggcctgccgcctagagagcccggacagggggacaatggcctgtgctgaccctggcggaaccctggctgaccccagatgaccccagatggccctggctgaccctggcggaacccagatgaccctggctgaccctggctggccctggctgaccccagatgaccctggctgaccctggctgatcctggctgaccctggctgacctctgcctaaccctggacctggaaagccctagctgaccccgggctggttggggctgggcctccctgtggctgcagcccctcgctcaggccccaggcacacctggccaggtctcggttttggggcatgtttctcagaacagcagttctctggctggaacacctggcctgggctgtgttcacaatgactcagccgccccacagggctattttggatatttctgcaggtgatggggtacaagaggcttcaggagagagagaaaagcaagagaatacaaacagcatggcctcccccgaccttcctgtccccactcctgtactgtaccccctccccagtgctaagtcgagacctggcgaccccttaggggctggggctgggtgtagctcacagggcctgggctggtcctctccccaccaagtcctcctggggcctacacacccctctgagcctggaaaaatggagcaagtcattggggtcatttcttcatctaccagtgagtacatgcactgagagggtctcggctcccctggaggcctccctccaccactgcaggtcacttactcatgagggccaaggctcagaaatcagacaggactcagtgtctagtcagactgatacatgctcagaaaaggaatcagatttcaaaatgaatatgtataagaaaagaaccggggatcagtgatcaggaacagggatccatgatctggtccagggctcagcggtcaggaacagggcccagcgatcaggaccagggctcagtaatcaggaccagggcccagtgatcaggaccagggcccagcgattgggtccagggctcagtgatcaggaacagggctcagtgatcaggaccagggcccagtgatcaggaacaggggccagtgactgggtccagggctcagtaatcaggaccagggctcagtgatcaggaccagggctcagtgatcaggaacaggggttagtgatcaggaacagggctcagtgatcaggaccagcattcagtgatcaggaccagggctcagtgatcaggaacagggctgagtgaccaggaccagggctgagtgatcaggtccagggctgagtgatgaggaccagggctgagtgaggaggtccagggctgagtgatgaggtccagggctgagtgacgaggtccagggctgagtgacgaggaccagggctgagtgacgaggtccagggctgagtgacgaggaccagggctgagtgaccaggaccagggctgagtgatgaggtccagggctgagtgacaaggaccagggctgagtgacgaggtccagggcaaaaaacaggagtaggactcagtgatcaggactaaggctcagtgatcaaggctagaattaagtgatcaggaacagggaccaagtagtaggaccagagctcagtgatcggtaaacgggcccactggtcaggaccagggccctgtgatcaggatgaggacccagtgaggaggaccagggctgtctaggttatgaggaatagggatcccatgtagttcttaggagcaggcttctttgccatggtctctggtgaatccagcattcatccttgggcctcagcctcattcaagatcaggtcatttcttgattttgggaccaggggtaccctctgtccatgcccaccatgaccaccatgacacccagggggactttgaagcaggcgttctccagtctaaagccaccaccctttccctgacccccgtctcctcattcagagtctgtgaacattttccttggggccactttattgcacctggaagccacgtgagtaagggcgggtcggtgatgtctgaaagggctgagttctggcaagcatagctggcttctccaagaggttcctccacacttcctccctgcaaagacagaggggtcacagcctgaaggagcagcatccttgccaacgccctctgtctcagccctggcctggctcatgggagcctggacggaatcctcgttactgcactggagggaagctcagccctgaccctgggcctgcgcgtgtcctcagtgtctgtgaagggcccccaggagagcacgtccccccacagtgggagcaggtggtgctctcctcttagccaatcactgcagcccaccccatctactgtgggctcatccccctcctgggctcccacctgtgccttgccggctcccgctcagtactgggggccctccctcttgccagatgggccccggacgctggtcacggtcagtgctgtgctatagaacaggctcagcaggaagagggtgaggaaggtgatggtggtgggccacaggttggcgccgggggtctcctcctccagggtctcctgcggcaagtccagcaccacatagggaggcggcatctgccaatctgcaacacagcaagagcctgccaggcccagactcccagactcgtgtgaacagcggctatgcttccttggggtctggggacagtggggtctgggtccccatctaaggcctgagactcccccagggaggatgaggaggcagggtcccaggtgaggggctgggaccttctgtctttgacattcttagggcacttcagggagagacttggcagggcagaaagtggacaccatctgcttctccaagggaagcttgagcccgaggtaccctcccgcccctcccaccccaccccgtctcagtcccagccacgtattcagtgactgggtcccggggccagagaggaccagacacacccaccctcaaggagatctgggtccaagacagagacctgggtctgacactcagtgtgccaaaggttgaatgggcaagaccagaggcctctgttgccttcccagggaatgtggctgaggggttacaagcgagggccaggtgagggccaccagcacgggcatcctcattttcctcagggtctcagggcatagacctcccatgtacagctgtacctgcttgtcatatgctgatacatccagtcattcacctgtctttctatccttccgtccatctatccatccatccatctataaagctattatccgtatatccacccctccatcagtaacactcctacccactcacccatccattcatcgtccattcatctattaatgtaaggctatcacttaaatatccacccatatatctataaagctattttccatccattcatccttcttccatctatccatccatccatccatccatccatctataaagctattttccatctcttcattcatccattcataaagcaattctccatccaattatcttccatacacctagcctccatagatctacccacccacccacccatctatcctcaatcctccctccatccacccatcctccattcacccctccatctatcttccatcctccatccacccttccatcctccatccgcctacccacccatccatcatccatccatccatcatccatccatcagtccatccatcttccatccttcatccactcatccatcctccatccacccatccttcatccatccatccatcacatatccatccgtccatcctccatccagccatttacccacccatccattttaccacccatccatccttcatctacccaccctccatccacccatccattcattatatgtcctaggatctacccatgtgtctgcctgatctctgtctgctggttcagcccctcatctgttgattctctctctttccccctctctttaaaagcccctccccaggccaggtcctgggtcccatgggctggagggcttctctgtggcagggcttccccaagtgacctgttgctctcaattaccctctggtgactggaccctcaggggtgacagtggcctccacctcaccttggccctgagagcagagggaggcagccagaaggcgggggcccctggggaggcccggaagatgtctaaggcacgagcaggggcctcactgcccccttgtgggagtctgggtgccaggtgtccccacagtggttgtgggactgttctttcactcctgggagccccaggcagaagccagaggcatgcagagggccctgggcaggccctgtctcactggcctgcttctgatgccaccccacgcggcccctccctgtctatgctttgggtcctagttgggcttaggaagggatgggagacttggccaggcagggagcaggggctgcctgggaggggtctgtggagttggtccctgagctgtgcacagtggaaacacagggaagccagaggggcctgggggagcaggctgagcttgggggcttgggaggggactcccctggcttttctggaactgggtctgggctgtgaacgttccactcctgcagggctcaggcgtatatgtgagtgtgagtgtgcatgtgtgcccacgtgccccgtacagagcagtgtggttaaggggaggtgccccttcctgcatgcgtcagtgggacgtcctgaggcccacccactagggtggtggggccctcctggagcttgtcctcccagtggggccctggagtccagcccctcactccctcgccactcctgccactacctgcgcctttcttggctagcctgctccttttaccctccctattccctcccagctacagccagaggcggctctctcagggacaaacggccatgccactgctcactcagaactgtccggggcatgtgcgtctctcagaacccatcctgggctgtgcctgccttggcagacctaagatctcacaccagcgaggcctcctgcaccacacactctcacactcacaactcacactcacaccagggtggaaagtctcatgggggtgccaggggccccccgaggctcagggcagggggtattcttccctgtccatgccctggccctttcccaagtgctgagaccctgaggatggacagacaggcgccggatggaagcgtggggctgcttgggggagcatggagtttattcaggggtggggacaggcgggcggctcagtagcaggtgccatccgcctccgccatgacaacagacacattgatgtgggtgggtttacccgccatgcggtcgatggtcttctgtgtgaaggccagcggcagggcctcgtggcccaccatgcaggagaaggtctcccccttcttccagtcctcagctgccacgcgcagtatgctggttacagcgtaggtggtggtgccctggctgggctcctgccgggatgcccaagtcaggtacttctcgcggggcagctcctgtgacccctgcagccagcgaaccagcacatccttggggctgaagccacgtgccaggcacgtcagcgtcaccagctcgttcagggccagctcctccgacggcggcggcagcaggtggacctcgggccggaatgtgtttcctggagggtagagagccaggtcagggggctgggcaggggatgagagagcccctctgctctggtgggcaccctgggctgtgtcctggcccctcagcctgcctcagtttccctctgtacttggcatgagcactggagcccaggattgggagggaggaggcaggccgggaatatgctttgcaaaccagagcactgagcagggccccgagcagggtctggacccaccggattttgtgatgttggcggttagtggggtcttcaactcggggtgggcagcagtgcaggtgaaggtctccccatggttccatggctgggcacagccaggcaggacactggacacgctgtagcagccacagaggtcacgctcaggtggtccttgaacagcgctcttcccacttgagggcgtccaggtgaaggtggcaccagaggcatctctcaggccggtcagtgtgcacgtgaggttcgcttctgaacctaagagcaggtcctcgagggccggtcggtgcagcgacagtcgggggtggcagcatgggggaggtgggggaactggagtggagagatggcctgagctggtcagaacgcccttccccgtgcccccgcctcgcccctcctggcctgtccaccaccacctcctggggctcggcccgcggtccactctggtgtgagtgaaggggcggctccctgtggggaacacgggtgcaggcgcagtgtcagggcaggacggggtggccccgccccactccccagcctgccctctgacctcggcagggcacagtcacatcctggctggaattcgtgtagtgcttcacgtggcatgtcacggacttgccgtctgggcactgtgtggccggcagggtcagctggctgctcgtggtgtacaggtccccggaggcatcctggctaggtgggaagtttctggcggtcacgttctgtccgctttcgctccaggtcacactgagtggctcctgggggaagaagccctggaccaggcatgcgacgaccacgttcccatcttggggggtgctgtcgaggctcagcgggaagaccttggggctggtcggggatgctggaacacagaatgcgctgtgaggacgcggccctcatgccatgtccccaggaggacaggctgtacctgcctctcctctacactggaggaacccagcacagagaggcctggtgacagccccaaggttacacagctcctgcaccatgggcctgcggttggacccagctgtctcatcccagcgacacagtttctgaacatgctccttagatagggcctctgacccaggccatcccagacacaagttatattaaacagggctctgccatggagtggctgagtcccctgagctccctgaccccagttcctgctctgggtgggggacatgtcttgctctttcccctgcccctagagaggattttggtgggggctctgaggagggggcctgggctctgagtgctgtgtgcatggggtaggggtggagtggcttggctgtgaccccatccccctgtccctggtcagagtctcagtccaacacccaccactccatgagccccaccccaggcccaaacaagccacagtggacccctgtggcctatgaggtctcgggactagaggccaacaggctaagccatgtccctgccaggccctccaggacagggcctgttacccaggggagctctgggcccagcccactccaaatttccttcaggcagtgggcaagagagaagacagaatcatggtgcaacagagctgcgtggccctcagaacccctaagaacacagctgggctcagggctctgcaggtggagtcacactcaacccacggcctccttcccacattagcagccacctcagctcatccagcccagcccagcccaggccagtccagctcagtccagctcagtccagcccagcccagctcagcccagctcagcccagcccaccccagggcagctcagtacagctcatcccagcccagcccagcccagctcagctcagctcagcccagcccagcccagctcagtccacctaagctcacccagctcagcccagtctagctcagctcagtccagctcagcccagtctagcccagcccagtacaggtcagcccagctcagcttagcccaggtcagtccagctcagtacagctcagctcagcccagcccagtccaacccagcccagcccagtccaacccagcccagctcagctcagcccagcccagctcagctcagctcagcccagcccagtccaacccagcccagcccagctcagcccaggtcaacgcaacccagctcagctcagcatagctcagtccagctcagcccagcccagctcagcccagctcagctcagcccagcccagctcagcccagctcagctcagcccagaccagctcagtccacctaagctcacccagttcagcccagtccagctcagatcaggtcagcccagcccagcccagcctagcccagctcagctcagcccagcccggcccagtccagctcagctcagctcagctcagctcagcctagcccagtccagtttagcccagctcagcccagcccagctcagcccagcccagcctagcccagcctagctcaccccagcctagtccagctcagcccagctcagctcagcccagctcagcacagcccagctcagcccagctcagcccagctcagcccagtctagctcagcccagctcagcccggcccagccgagctcagcccagcccagcccagtccagctcagcccagtctagctcagcccagctcagcccggcccagccgagctcagcccagcccagcccagtccagcccagcccaatctagcccagcccagctcagcccagcccagcccagcccagcccagtccagcccagcacagtccagcccagcacagtccagcccagcccagtctagcccagtctagcccagtccagctcagcccagcccaggccagcccagcccaggccagcccaggccagcccagcccagcccagcccagctcagtccagctcagctcagcccagctcagcctagcccagtccagcccagcccaatctagcccagcccagcccagcctagcccagcccagcccagcccagcccagcccagcccagcccagcctagcccagcccagcccggctcagtccagctcagctcagcccagctcagcccagcccagcccagcccagctcagcccagcccagcctagcccagcccagcccagcccagcccagcccagcccagcccagctcagtccagctcagctcagcccagctcagcctagcccagtccagcccagcccaatctagcccagcccagcccagcccagcccagcctagcccagcccagcccagctcagtccagctcagctcagcccagctcagcccagcccagcccagcctagcccagcccagcccagcccagcccagcccagcctagcccagcccagcccagcccagcccagcccagctcagcccagcccagcccagctcagtccagctcagctcagcccagctcagcctagcccagtccagcccagcccaatctagcccagcccagcccagcccagcccagcccagcccagcccagctcagtccagctcagctcagcccagctcagcctagcccagtccagcccagcccaatctagcccagcccagtccagcccagcccagcctagcccagcccagcccagcccagcccagcccagcccagcctagcccagcccagcccagctcagtccagctcagctcagcccagctcagcccagcccagcccagcccagtccacctcagccccagctccagctcagctcagcccagcccagctcagcccagcctagcccagcccagctcagcccagctcagctcagttcagctcagcccagtccagtgtagcctagctcagcccagtgtagcctagctcagcccagcccaggccagggcagctcagggcagcccacatggacgtgtatcagttggctccaggtcatcttctcctctgccctctggctcggctcagcctaggcctcggctcaacttaggcctcagctcagccatgaaagctgttcaccttgtatcccaggaagggccgggtcatcccagcttaggcctggccagcctggctcagcccccagtgcccagatccttcctgcctggttaggaagccctgccctgtggttccggagtccctgtggtgacctcttttgtccttccctcttgtcttggtgcctgttctccaccttttgcttccagaaggggccaggaccagcctggctggactcctcaatgtgcagagaaggagacggaggcctggagacctccaagacccacctggtcaggctgctggagggcccgcagtgctgagtgggcggcctccggcgtgcaggccctcatggcaggtccaccctcacgggcgtctggctgcctgccaagagggctgctgtggggagggagccctggcccggcccaggtcctgccttgatggccgtctgtccttagcagagccctgctccgccgcgctggctgtgtccacagatgtggctggatgctgaggggctggaggggagggcctgcatgcccgtacgtctggcctacagacggggtcactcgcccacttcctgccccagcagacacggctgcgcggctccacgtcatgtctggcctgtggtctggctgtggtggggccaggtgtgtgtggccagggctctgtgaccccaccggccgtggagcctcacggctccacatggctccacagggcggggtgggggccacgctgcagggaaacaggaacagacacagttagaggctcagagaccccgagacagagatggcaaaggggagacacagggccagagagggtccccgaccacccgcaggggaagggcgcctgtgagtggactcccgttgaaggggccttggggccacagggcgggcatcaggctggggagagtgagtcttgcgctgctgggttggagccactcgggcctggcctccctcggcctgccccatgggccactgggggccccagactgcagcccagggtgggggcatgggggcaccccgtctcctagcctgcagccctgcgggtcagggcggccaaggtgcctgctctaccctgtccagcactgcccaggtggcactcctactgtgggtcaccagagagctggccgttgcgttggagagatcccgccagcgatgctggccctggagtcgggggaggccagctatgtctgggggctcgggtggcaccggcaatgggaggccaggggcgcttcacagaggagctgctgcagcggagtcctggaaagcgtgggcgtgaatggaagatgccctggccatggggccgggccaccccggcggaggctgtcgggtgaaatccagggagtgacagtgaggccggatcagggcaggtggggccagaggaggagggaggtagcctggggctgccccagggtcctgggaagacacacctggcggttcagggaagctctggagcttttgttatgaaccttgggatgcccccggccctcgccagggggacgtggctgctgcgtcttagtcatttctggctgcaataacaaaaataccatagactggtgggttcagcagcaacattcatttctcagggaagctggaagttcaaggtcaggatggcagcagggtcaagttccaggaagggccgattcctggttcacagacccccatcttttcgctgcgtcctcacatggtggaaagagggcagggctgctctctggggtcccttttcttttgggtctctagtgagatcagggaccgagtcacatttttgagtgttccccctcaggccctaaccacctccctgaggccccagctctgcatgctctcactctgggatgacggctgtcacacaggagtttcgggcagacacagaccctcagaccatagcaccacccctgtctgcctctgcctctccccatccctgtgtctcctcgtctgtctccagctaggacacttgtcctcggacctagccccctcgataatccagggtgtccttcacctcgaaatccttgacaatccagggcgccctcacctcgaaatccttgacaatccagggcgccctcacctcgaaatccttgacaatccagggcgccctcacctcgaaatccttgacaatccagggtgccctcacctcgaaatccttgacaatccagggtgccctcacctcgaaatccttgacaatccagggttccctcacctcgaaatccttgacaatccagggcgccctcacctcgaaatccttgacaatccagggtgccctcacctcgaaatccttgacaatccagggttccttcacctcgaaatccttgacaatccagggttccttcacctcgaaatccttgacaatccagggttccttcacctcgaaatccttgacaatccagggcgccctcacctcgaaatccttgacaatccagggcgccctcacctcgaaatccttgacaatccagggcgccctcacctcgaaatccttgacaatccagggttccctcacctcgaaatccttgacaatccagggcgccctcacctcgaaatccttgacaatccaggattccttcacctcgaaatccttgacaatccagggtgccctgacctcgaaatccttgacaatccagggttccttcacctcgaaatccttgacaatccagggcgccctcacctcgaaatccttgacaatccagggcgccctcacctcgaaatccttgacaatccagggttccctcacctcgaaatccttgacaatccagggcgccctcacctcgaaatccttgacaatccagggttccttcacctcaaaatccttgacaatccagggctccctcacctcgaaatccttgacaatccagggctccctcacctcgaaatccttgacaatccagggcgccctcacctcgaaatccttgacaatccagggtgccctcacctcgaaatccttgacaatccagggttccttcacctcgaaatccttgacaatccagggtgccctcacctagaaatccttgacaatccagggttccttcacctcgaaatccttgacaatccagggcgccctcacctcgaaatccttgacaatccagggttccttcacctcgaaatccttgacaatccagggtgccctcacctcgaaatccttgacaatccagggttccttcacctcgaaatccttgacaatccagggtgccctcacctcgaaatccttgacaatccagggttccttcacctcgaaatccttgacaatccagggctccctcacctcgaaatccttgacaatccagggcgccctcgcctcgaaatccttgacaatccagggcgccctcacctcgaaatccttgacaatccagggtgccctcacctcgaaatccttgacaatccagggtgccctcacctcgaaatccttatcttgatgggatctgcaaaggcccttttgacaaataatgccgcactcaatggccccaggggctaggatgtggctctatcttttgggggccatggttgtacccacgggtgggttaataggggaatgaagagggggatggagaggccctgagacggcatcctcttgctcccgggaggccaggccatgtggaaggcaggggcgctgttccgagcctgggtgtgaatccgggcctctgcccctccccacgggccccgtctgtctcctctacgtgggtgctcatctggtcttcctctcaggcctttgaggcgatggaattttctgtgcgtgaggacgcctgccacacagtggggcagtgagctgactccttgcccttgctctggggccatggaggtctcatgatctagggtgcggggcagagaaagtcactgagctctgtcccccgggggggctcccggtccggggcaccttggctgcggagggccggtctgttgtaggagatgtgggtttgcgacaccctgggctggtgatggggtggatggagggcctggcttcctgagactgtgtgtgtgttggtatgagcgtgcccgagcgtgtcagcctgtgtgagtgcatgattggtgtgtgtgagtgcaaatgtgtatgagaggttgagtctgtgtgtgtgaacctgtgtgtttttgcatgtgcgagtgtgtgcctgcgtgtgtgtctgtgaatgagggagtgtgtgaggggagctgggcagcggctgtggccttggccctgtcctgcgacgccccctcctctggtgttgtttggacccagtcggcctcagcgctgcccgctttggggttttctaccccgtagggagccgtcgctcctcaccttctcccccgtgcccggctgctccgaggtcgcagcagaggacagggcggagggcccaggtgccgctgtcagactgaggcaggcttgcttcattccgctttgtgccagactccatgtgacgtggctctcctggcacagagcgaggctctccctgtggggccatcactgtgagaggactctcctgcattggggcattttgccaactggccctaaaaagtggtcttaatgatttacgtgccctcagtcagggccaagaagcacctccacccccttcatcccctcctccttcctttcacttttctcattgttaaaatggtttctttatattatcggccactgggtttttcctttccatgaagaacctattgctcacctttcttcttagtgatctctgagtgctctttgtatatgagggaaccctgccctttgtcatgcctatcatgcgttctctcccatttttaggatgttgtggagacccttgtaagcaggcctctccagccagggaggctgcacatttgccctgaggactggtgtgggtcaagcccacctgtggccccgatggctctggggccccagcctgctcctgggtcacctctcagctcttcaggaggtccaggctggtgggcggctgtgggctggggagtcagctttgtctgtgctcagtgggtgctggatcagggtgtgtggccagtggtcctaggggcccccatcagcctccaccttggtgactgtgcagctgcattcttggggcctcctgtgctgaccacagcatgggcctcttctggttttgcccacaaaggggtcgatgttgattgttgctttgactttacctgagaaggaggcatgagtctgggctggagaccagcagaccaggtatgacagggccgagctggggagtctctggggtgctgaggggtgattgatgggaaccactgcttgggcactttggctctcaggaccccagaatggcccctgcccttccttcccctctggctcctcctgcacgtcctcaggggtcctgcctcccgccagccactccagggccacacacacctcccacagagccctccggagacgtggggtttgtgaaaaggatctttactaagaaacccagagagaaagaagtatgactgctgaagccagaggctggacgaggtcatagggacgaggtcggcagctgctgtccctgcaggaaaccccttctctggctgtgggagcccctctacccactccaggggcccgaagccctcaactgtcctgtggcctggcctcagagggcttccctgtgccttcaggctgcagaaatgggggctgcaggtggatggcaggaggggtgggtgaagggatgggggctcaggtggatggcaggaggggtgggtgaagggatgggggctgaggatagatggcaggaggggtgggtgaagggatgggggctgtggatggatggcaggaggggtgggtgaagggatgggggctgaggatagatggcaggaggggtgggtgaagggatgggggctgtggatgggtggcaggaggggtgggtgaagggaaagaaggtctgggtgaggcttgggggacggggatgccagacacttggacctcagggctagaagggtcagaccgaggctggggagtgaggccgtgggctggtgttgggctggacgcagactcagctgtgtcctgggctgggtgccgggccctccttggcttttggtgattgtacagtcagaatgggagtgacccggagacccaggggcctgggatgagctcagaacggctagcagccacccctcctcgatgactctgttgaagggacagacacggttttcgggtgggggctgcgactggtggttctctcggcgcctgtaaccttgcggctgagccggcccctctgggctcaggttcactggccatcagcccacagtagtgaccttgtgcccccttttcttgtctgcttcccttttcccacccagggcagggcgcagcccgagggaggctcaggcgctggcagagaaaaagctgggcctggtggagcgtgagtggcccgcggcctaggcgtggggctggaggacgttggtgtagtcgagggaggtctggggcctcccctgccgcgtggctgagaggaaccgctgcacctgaggggagggcgtgggtcagggcgctctgctggctctgcccaaccccctgccctggccgggcccctggaggtgggtgcccaccatgaggagcgtgatggcggcgctgtagctcacgctgagcaggaagagtgcggcgaagatgcagaggccggtccacgtccacggcgcctcgccctcggcctcctccacgcacacgtccagctctgggggacctggccagtcagccctcccggctccacagtggcagcgggggtgggggacagagcctcctgctgctctcggcagtccctgctgctgtccggagtggcagagcaccctatccggggccctctgggactgcgcggagccgccagccagccctgagggtgggcacccaggtcccgagtcagtcaacggcccagagccaggccgaccactcctgacctctcgtccctgcgccccgactctggccccattttccctctgttccttacggcttctctcctgacctctggttacctccactccgcctctctagaccccacgccctccccagagaaggacccaacccctcggcacagcagtggccgcctcactcagggccctcggaaggatgcgtgagctctgcggcctggctcccaagacctgggactcactgcatgggtgctctgaggggctgtcctggtgtggactatgagcccaggcctgtgggtgtccagagctgcctcctggccctaccccggcccggccccgcccaccagcctggtccctctggctcctgccctgggtgccctccactcccttccccaacaccgtgagctgcctgctggtcccgggtcatcagcaggtgcaggtcccgcctcgggccctcacacctctttctgctgctccaggcccagagctgggtgcaggtgggctgggacgtgagagtgaagctgaatgtatggctgtgacggtgtgcagggactgtcttcagacatggaggggctttgtgctcatggggtgcccggtgcccgtgtttccgtgtggatttggtgggtgctgtgcccttggtgtgcatgaccggggggagcgtttggatctggggtgtcagatgcacatgtgggtttgaggtctgtgaggggcacgtagcctgctctggggttccggtgtgggtgagtgggggatggagcccacgcatccatcctgtgtttggctgtggggtgctgctgctgacagggtgacagggagggttggactggaggacaccacgtgagggcctctccatttctctctgggatccagcggcccaggtatggctcagaggaagggcttggcagtagcctcgctggaggcagcgtgagaggcggagtgtgggccacgtgtgaccacgtgtggggtgtctatggcgccctggtggtggtacagggtgctgtggagttgctatggggcctagtgtgtgcacagctgtgccttgagtgaggcgtgagtgggcgagactgggtgtgtgaggctggcgatcccctgggggccgattcaggatggaccaaggggcggtggggggcagtaggagagggggcctggctgctgacctgggcctggtgtgcccacagggcagggtggcggaggctgcggggtgtgagtgggctcggctccaccggccccggtgctggggccaggactcggcaaggcgggacagggcagagaggcgaacgccagtggcacagacttgggcgagggctgtcgggtcgtgtgtgtctgtgtgggggtttcacttagggctgtttttccacctggaggggcctgtgtgcccatctatacctgggggtgcaggggctcctgtccaggggggtagaagccaagcccccaagagagagggctgtgggggctcccttgccccttccctgaggacctcccctgggtctttggactccttggagggggtagacccagagtgggggcagagagggcccggggtagctgtgatgagtccctgcagatatgctgtttgacaaataaccctgacacgaaggcagatggatgagtggcacctcagccctgcccacctcctcccaccgcctctcctggggggactcagccctgcccacctcctcccactgcccctcctggggggcccattcctctgtgccaagatgcacctgcccacagccctgcccgctcccaagaatgggtgtacctggggctctgagcaggcacagtttattgggggtagcttcctggggtcattgcaacagtggacagaaggtctggccagtcctccccactgcacagctggatggagccctgggagggagggaggcaggagtacgtcatttaccgggatttacagacaccgctcgctggacggtctgtgaggggcttgctgcctcatggactgcacggcagatgaactcatctttctgctcccattcggccctggtcacctccaggcggctgaagacgaagaagccggagcccttggtcttgcggggctgcgtcgtgctgtgccgggcgtccgggagctgcacctcgttgtgcagccactgcaccgagatgtcctcaggcatgaagttctggatcaggcaggcgagggtgcgcttgtcccggctccccggccactccggcgtcgcaaacgcatagacttccggggcagcacgcgggcctgtggccagacgtggggtcagcccgggccccgctcactcgctccctcccttcccccacgaccccggcctgcccatggctcaccgctggtcttggtcgtggaccgcatgagggccctgggcaggtgggggtgggtcaccctgcactggtaggtctccccctcgatccagtctcgggtgcccaccggcagggtggacgtgacggttaacgtgccattgcgctgcttctcctcctttctggtggagtggttcacaggcttcccactggcccgggaccaggtcaggttcacggtccccttgctgggtgccaggtccaccaccagacaggtgatcgtgggcgacttgcggatgaacaggtcgaacgggctgggccggcttaggtaggcgctcacccctctcgggttggaatctgtggtacaccggagggctgtgtgaggcccacccgcccctcttctctggcctccgtggcggccaccagggcaggtgggaacgtacctgcacacttcttggtgctgtcctcaaaggtgtgaccttgataggtgacctggcaggtgtaggtgcggtctgacagccagtgcttctggctgagggtgagctcgctttgtgtggaggccagctcaccctcctgcgtggtagaggcggtggacaagtccacgtccatgacctgcccgtcctccagccaggtgatgttgatagtccctggggtgtacccagagacgaggcacaggagctggatggtcggggggaagtgcccgccgccgtcgcaggacgactgtaagatcttcacggtgggcggggtgaagtccctggagcagactgggggagagctggtggtcatgagggttgttggcctctctgagctctgtgtgccctcctcttgcccccgcgtcctggcccgggtccccaggcatgctgggtgttcccacgtttgagcccacccaccccctcaacccctgcccactctgccagccctcagcctggcactcctgggaactgtggtctctgagcttggccctctcttaccgctgaaggttttgttgtcgacccagtctgtggacgatggagtgtgtgccacacggcaggtgaacatctgcttggcccacgcacccgagacggtcagcaagctgatggtggcatagtgaccagagagcgtgagggtggtggctggtaaggtcatagttgtcccgttgagggagcctgtgtcccaggtcaccatcaccggctccgggaagtagcccgtggccaggcagcccagagtcacggaggtggcattggagggaatgtttttgcagcagcgggtcaaggggaagacggatgggctctgtgtggaggctgtgaggacagaacctagtcagtgccagcctcaggccagcgcccatcaggcctggggggcctggatgggggagctggggaccccgtggcagggatccagatggccaggctcattctgggcctttttccccacaatccccaggcccagggcggctcccagggcccccattcccccaccagaagctgttgctcagccactatcatcaggctgggctcaggaaggggggtgcctccaggatgaccccagcctccccctgcaagtgctgcacggtgggcactcaggagcagagacactgggccatgcccctaggctgaaacccagggaccccatggggcctgggaccccagagccctcccccttcaaactctctctgggctcatggtggatggtctgcctgccctccaaccctgaccccaaccccccaaggctgtggtctcagctcctcgggctcttgagtgccaagcctggatctccccatcacagcagccctcacctgacctgccagacccccatggtgctctgcccacccctgacctctaggggagggcgggaagacttgccctgatgccccaggcagtcagtccctcccaccacagaaccctggcccagatagtgcggtctgtacagcgtggcccttcgcccctggcctggagtcccaagtccccagcccatcctgcccctggagcccagtttagcttggtcttgaagtctgctctaggtacccccaaaatcacagtatccagccccgctctgcccaccgggacagccaagttcagctgagactggcctaccgggggagtcgccctctgaagttcactctaagccagcctggttcagcctggcccaggtcagcccaggacctccccttgcaggcagcaaactcttatttcagtccagccagctcaaccagcttgcttctgactcagctcctcttagccaggtgagaatggtcagtccagatcaatttagcccggtccagtttagctcagcaaagctggacctaaagtagccacctcaccccagcttcatccagatgaatacagtccagatcagcttagtcagttaagcctagcctagctagttaaatccagttacgaccagctcaactaatcctgctcaggcctgctcagcccagcccagctgaacccagtttagccgaggccaggccagcccagctgaatacagttgcccagtctagctcagcccagtccagcactgcccagtttagctgagctcagcctggcccagcccagctcatatcagcccatctcagctgaaccagtttgacccagtctaacccaaccccgctcagctgaacccagcccagcccagcccagcccagccaaacccagtttagcctagctcagctcagcccatttccacccaacccagctcagcccagcttacccagtccagcccagcagcccagttcagcccactcaggctagcccagtttagcccagcccagctaggttcagctctgctcagttcagcccagcgtagatcagcttatcccagcagaactcagtttaaatcaccccaacccaattcggttcaataatccaagcccagctcagtccagcttcttataaccctgtccatctcaggtcactcacccagcctagtcctccccagctcaacccagtttagcccaaaccagcttagtcagcccaactagctaagcttggctcaggtctgtccagctcagcccaggtcttccaatcacagctcaggcccggccaggccagctcagcccagctccatccacctcagtccagttggcccagcccagccaaacccagtttaggccaggccaggccagcccagcccatgtgaactcagttgagctcagcccaggtcagcccagttcagttaacctcaacctgacccagcccagcccatattagcatatctcagctgaacccagtttagcccaacccagcccaacctaggccagctgaacccaggttaggttaggttagcttagcctagagcagcccagcccaacccagcccaacccagcccagcctgccccagtctaacctagctcagcccagcccagcccagctgaacccagttgagaccaacccagctgagtccactcaggcgagcctagtttagcccagttcacgtgggcacagttcagcccagcccagctcatcccagctaaattcagatcaccccagcccaatttagttcaataatttaaggcctgctcactccagcttttaaccctgtccgtcgtcaggtctctcccccagcctagccctcctcagctcaatcccatttagctcagcccagcttactcagcccaaccagctaagcttggctcaggtctgtccagctcagcgcagccctgctgaactcaggccaggtcaggtaagctcagcaggtaataccccagcttggtctccttcagcccggatagtccacgagcacccattttatcctaagtagagaactgtagcttgtccctactcctgtgtcggcccagcttatttcaaccaagtccagtcaagtccaggtcagcctaattcagcttaactcaatcctggaccacccagggcaggccacctcagctcagcctgactttgccctgccccccagataagtccagctcagcccagctcagtccaccttagggcttaggataacccagctcaagcctagctcagctgagcctagctcatttccctctacccagtccactcactcaactcagctaaacccgcctggcccgggccagccccgatcgccctggctcaggacagcccagcttggccacctgtcctctaagggacagggtagccctctcagcccacccagctcgcctcagctcagtctgttaggcccgtctcagtctagtccactcagccaagcccccctcagtccgcccagctcagacttgccaagatcagccagttgcgcagtggagctcaggacagctccctgctgccgcctccccaccctccctcccagctctgggttggctgtccctgtcctaggggtggcaggcagtctgcacccagcctagccctgcccagcgtggggtctctgaccttcttggtcttgggcccagccaagattcccagccccctgccttctccaggtcggcgttaggctgtttctagctttcctgtgtccccatgcagggaagggatgcctagagtccacgcagtgaccaagaagcttggttgatgctgtgagggtggcccaggagtcccctcgctgtcaggggcccaggcagcctctccctcactgctgcctgggccggcccctcgattggggctcccggtgggctgggatacctgaagcgccgggtcgtccatttggtgcctgtggatggtgtggcccgtccggctccctgtcgggttcctggacagctcccagatgatcagtaaccgtggttgttatttctgtgccgggcagtggagcctgggtagggggagctctgcctcagtgctttcagctaaaaatggggtgggaacccccggaggcccgggccgccctggaagttcccttttctctctgttcttgggaagtcgattgagcaacagcgggggtcaggtgaggctccttcactaccgatgcacaccgagtgctgggggaggttctcttctctctcaggcccaaccccagggcccctgcctaggtcccggactctcactcttgacgcatgcgtggcttggtggtcccagtcagcaaacttggggtcccgttgcctgggaaagggagagggtactgggcatcgacgcctctgcttccacgaaagccttgtgaagaaaggatgggggcgcttttgtgcaggagaatgaggcgcactgaggtgaactggccctcgggggccgcgtgtcccagatgtgtgtgcagggcctcctgatggccgcagccctcgtccctgtgacccgcttggagctggcaccctgagtggtggcctcaccttgtactcactcccaggtcactgtcctgcagccgggggtcccaagctgggctgctcctcaaggcgagcacatgaaggctggggcctggctgggggctggcagggagctgtgcggaggtggctggtggctctgcaaggtccttgaagctgctggaggctggggacactgtgccccgtctatgccatgggtgggcgtgggcacatggagaaggctgggctcgggctcggtggccttcctggaggcgcccatggcattcgtccctggttgcacccagtgctctgctctgagcgagataatttccttcacaccattggcctgcctgtcccctggaggccagcatgcatggagtggccactggggaggggtgggttgtatagaatctttggggagggagacactgggacctgcccctgggaccctgggtgcccagggctggttgtcctgtggagggagaggggctgtcgggcctggtgccctcagagagatgctcaccacgtgtggaagacaccagaagggctgctggctgccagggccctggagggctatgatgtgaggctcagggaacgcaggctgggggtgagtgttcccaggctgtccaaggcccccatgccctgcttgtggccctggagaaaggtgccgtgtgggaggctgaggggaaaatgctgagttccctggaaggacccatgattctgagagaaaccacagcaggggtggtgagcctcctgttcccccacttcccgggccccggtgaggctgtgtgcactgtgtgggtgtgcctggggctccacttgcccctcccatgtacctgctcattttccccaggctgtgggcatttggggcaggggcctcagtgcctggtcggctctctcccggttctatccaatgccccaagctgtgctgggctggaggggccgggcagggtgagcccccaggaaggaggttggcatcccagctggggctccatctctggcctctgccagccttgagatccccagtcgtctgtgtctccctcctggggcccagcaggcctgctcagctctgagccccatgtccgttctcaccctgctctgcttttccttggggtgctggccctgccctggcctccagaaatggcccctgcccccaccccttcctgtctgaggggccgggctgttcctctcctgcccggcgtgtgcccacctaggcccaataggcatagtgcccccagcccctcctgccctgttctggccttcacgcccagccatgccggcagcctgcctcagtggcctgggccttcgccagcgcctggctctgtgtccagctgccactcctgtggccctacggtgctgcccctttccctcagtgatgggggctgggcttcctgggaacgggctgtgtctcagctgcacacacctgtgtgtgtcagtgtgcgcatgggagtgcgtgtgtgtgctgggggtgtgtgcaggaatgcttgtgtctgggggcagggggagcgtctgccttcctgccccaggcctggaatggccatgccagggtgggtgggagcagcgggtgcgaggacagtgctgctttgacgtctgcgtgtggctggtgggggcgggaggacgtggtgtggcacgagtctcgggctccccatctccatccagctgatcccagatggctgcgctcctgagggtttagagcagcccagggggtcaggaggctgttgggacgctggaggcaagcgctggcagggatgggggtgggctggccaggcagcgtggccagggggcttcgagccggggcagtgaaccatcccccaactttttaaagttttaaaagtcatatttacacaagtgtagtttacattcagtataatccatcctgtgacatgtgagtttcaacaaatgcacactcatgcaaccaccaccgtaatccagatgaacagttgcaagaagatgtagaatctctccaaatattccaccaggcccctttgcaatcaacgcctccctgatggccaggaatccattgatctgcattctgtcagaagattcagagtttatcattaaaatgatctattatggaaaatattataagcatacaaaacacaaaaccaagttttaaaaagtgaggtatttcttaaaagtttagtatacaaacaaaatgaaggtaccttcacattttactacagatgtgcagatagttttcttggtgcacagagataaggcagaattaagtcagaataaacgttctaaaactgacctccggaagaactagtcttagtcatttctttgcagagtatgtgaaccaagattcgggtttggtctttggtgttagcactgtgtcaaggatcagatagaaagtacaaatggaggggcccctttctgaggccaggccccactgtcggggcatgtggggtgaccaggggccaataccagctgaggctaagaggctgctctcagaagggtaggtttccaggtgtctcttgaaccctttgttcagaaccaggacatgtgtggctgggcagcagccttcagaccccccacaggctggtgcccggtgcccacagccctctcttgggtcgtcaggcccctgcacccgtggtggggtgttgggctccagagttccctgggaccagctgatctcttgtccttggttttggcccaaatgcaagcccctggtctcctccaagtaacttcctttccccagggctgtccaggccccaccgctccctgttccttcccagggcctcctgcaagtcccgatgctgacgcctctctgcccacctagtttgtggccgccgcctccagctctgtgtctgcctcccagcgagggagctgtggttgatgatctcgtgagtgtctgcccttctgaagggtacagtgtgaagtctcgtcagtctcacttcaatgcctaagcacctcttcagaaaccagggattcatccgggtttctccatctttaaccatgttttctaaaggttttcttggcaatttcctggcaatttgcaagacaggattttttggttgccaacttccaattagctttaaacttgccacgatctcccaggtcatcccatccatcgaggatgcttattacattcttcctgatttccatgtggccaaattcaatagttatttaccccaggcttgtattttggaggctaaagaactctgttaccagctatatccgtgctgtggctgccgtaacaaaatatcacaaatgtggcttaaaacaacaaaaattttttcagagttctgggagtcaggaatctgagatcaaggtgttggtggctgtctctgagtgctccaggggaggaccgtccacctcttccagcttcctgtggtgcaatagtttggatgtgtgtctcttcaaatttcgtgttgagatgtgattcccagtgttggaggtgggcctggtgggaggtgattagatcatggggctggacccctcatgaatggcctagcaccatctcccaggtgatgagcgagttctccctcagttagtccctgtgacagctcattgtttaaaagtctgggacgtgccacttctcttctcttgctccctcttgccatgtgacatgcctgctcccccttcgccttctgccgtgattgcaatctccctgaggcctcgccagaagcagatgccagggccgtgtttccagaatggctgcagaactgtgagctagttaatcctcccttccttgccacagtgcctggtgcaaacctcttttctttataaattaccagattcatgtttttttttttttctagtaacacaaatagactaactcagaacattggtattgaggagtggaacattgctataaggatacctgaaaatgtggaagcagctttggaatcaggtaacaggcagagaggttagaagaatttggaggactcagaagaagacaggaagatgagggaaagtttggaatttcttagagactattaaatggttgtcaccaaaatgctgatagacatatggactgtgaaagccaggctgatgaaatctcagatggaaatgaggaacttattgggaactggggtaaaggtcacgcttgttaaatcctaagaaacaacttggctgcattgtgttcatgccttagggatctgtggaagtttgaccttaagagtgatgacttagggcatctgtggaagacatttctaagcagatgtttctaaggtgtgacctggttgcttctaacagtctatggtaagatatgggagcaaagaaatgactgaaagttggaacttatatttaaaaggtgtaaacgacaaaataaaatgctaaaccaaggggattccaaagaaacctggaaaaccagttcaggccatgacaggaaggggagggtggtttggactccctcactataccctctccctgttggagcttaggctcagctgaccagtgttaacattaaaacagggagcttaagactgacaaagcagactctttgtagcaataaggtatcaaatcccaacctgactctggtatagcatcacatgacaggtggcaggcatggaaggaaattaaagtatttattgccagaatatgtttctctgacacattttggaagggccctgcaaagccgtctcttgtggaggaaatgtatattctgttgagaatctttttccctttccaggtctcttcctgattcaggagagatttatccaagagtctggcaccttttaggttctgataagagacattgaccatctcttctctctggaacgtggagccttcgtctacataacaagaaccttggcttccacaacccccttatcttaagcattgcttttcgctgacttcaactttttagataatttaaatttttcagccaatcgccaatcagaaaatcttcaaatccaccatgatttggaattccccactttgaattgtcctgcttttccaaaccaaatcaaaccaatgtatactttacatgtattgattgatatgtctccctaaaacataaaagcaggccgcaacccaaccaccttgcacaggtgttctcaggaccttttgaggctgtgccacagttcatggctctcatatttggctcagaatcaatttttcaagtgttttatggagtttggcttttttcatcaacaaagggaagcagagcataaaaaatgtggaaaattcacagcctggccatgtggtagaaaagaaaaggtattttcaggagacaaatataagtaggctatggagcagccagttgctagagagattagcataactaaaagggagctaagtgctcatatccagaacaaagggaaaaaggccttgaaggcattttggaaatctctgaggtggtctttcccatcacaggcccagaggccaagagggaaaggatggttttgtgggccatggccatggccactgctgcctgtgcagccttgggacactgctctccacatcctggttcctctggctccagccttggctcaaagggccccaagtacagcttaggctgctgctttggagagtgcaagccactataagccttggtgacttccatctggtgttaagcctgtaggcccccagaatgcaagagtgaaggaagcttggcatcttccctctagatttcagaaatgtatgagaaagcctagctgcccagacagaagcctcctgccagcatggagccctcacagagaacctctactagagcagtgccaaagagaatgtggggttgaacccccatataatgtccccaccagggcactgcctagcggagctgtgggaagggggccactgtcctccagaccccagaatggtggatccactggcagcttgcaccctgaatctggaaaagccacaggcactcaactctatcgtgtgagagaagccacaggggctacatcctccaaagccacaggggtagagatttccaaggccttgggagtccaccccctgcaccagtgtgccctggatatgggacacgcagtcaaaggagattaccttggagctttaagatttaataactgccctgctggatttctgacaagtatggggcatgtagatcctttctttttgccaacttctcccttgtggaatgggaatgtttacccaatgtctgcacactcattgtattttgggagtcaatttgtctttgatttcctaggctgataggtggaagggactcatcttcagatgagacttgggacttgggaattttgggttgattctggaatgaggtaagactttgggggattgttgagaaggcataattatattttgcaacatgagaaggacatgagatttgggggaccaggggtggaaggatatggtttatatatttgtcccctccaaatctcatgttgcaatatgattcccagtgttggaagtggggcctggtaggaggtgattagatcaagggggaagatccctcatgaatgattgagcatcttccccttggtgatgagtgaattctcccccagtcagctcacacacaatctagttgtttaagtctggggcccccctcagcctcttgctcccattcttgccatgtggcatacctgctgtcccttcaccttctgctatgctgtaagtttcctgaggtcctcgccagaagcagatgctggtgccatgcttcctatacagcctgcagaactgtgagccaattcaacctctttcctttataacttactcagcctcaggtatttctttacagtaatgcaaatggacaaacacaggtggctcctgacacacccctcatcttcttctttgtcatcatgtggcttatctccacgtgtgtctgtgtcctctcctcttatgaggacaccagtgtttggacttgggatccatccaaaatttagtatgatatcatctcaagtccttaacctaatttgtaaagaccctatttctaaatatggtcacattctgaggttccaggtgggcatacatttggccagggagatgccatcagcccaccacaccagcctatgcaggtacatttgcatatagcttagggttgacctttcccatggaagtattacatccccctctggactccagtttcacatgttttagaatgcttcgccttctccagcaggatgagtcttttttccttttttagtatttttctctcttttctttggattggattaaaaataattgatatattctattgatgcatctttaagttttcagttccttcttttgtcttctccaatctgttattaaacttgggtaatgtttttctctttcttttcttttttaataaaatagagatggggtttcaccacgttgcccaggctggtctcaagctcctgagatcaagtgatacttccctgttgggcccccaaagtgctaggattacaggtatgagccactgggcctggccaaatgtttttcatttcagaatcatacttttagttctagaattttcatttggttcttgtaactattttcagttttttatagagatacctcatctagtcactcatgataaccatattctctaagtctttgaacatttttaacataacttctttaaagtccttgtctgataactgtatctgcatctaggtcatcttggagttgatctccattgatccctttttcttctgactttggatcacattttcatgtttctttgcatccatggtaattttggatgtgcacctgatgttgttgataacatgtgtacaggctatggggtttgcatccttccttagcagagcattaattgtttttttcatgttagcaagcagttagcttgagttgactcaaactcccaagtctgtctgcctgggagttggcagtatctgcaatctcagttctcttgactatacaggtgctgctttctgctggaccctttggagttttccctacccatgcacacctaagggatcggccagaggtttcagtggagtttacctgcaggttgtggggtttcccttcggtgaccttctcctttatggacatcttctcttcatttccagctgctctgaaaatgtagccctgcatcccactcctcaccaggaggactgcagtttcctgcttgaactctagctgcacccattacatgccctggggtgtgacttcagatgaatatttcagggaataatccttactagtgtttgcctacttctggtcatgttccagtgcctgtaattggtgtgtgtgggtgttgtgtgtgcttacagcatttccagtgtttataattgccatctgccaaagggctagtctgatattagctgctccagcattattggaatcggaactactttctctcatgtggtttttcattttcatttccctgttgactagtgtggttcaacaccttttcatatgtttagtggctatttggatatcttctgtaaaacatctgttcaattctcttgcctattcctcgttggattatttgattttttttctcattggtttacaggggtcttctttatattatggatctgtttgtgtcagtcagttatatatgtttataggaagcattaagaagaactgaaatggaccaaatgattactaggtgccttccatggaaagcaaggcatcgtcttgtacactcttccaggttatttcattctgtggagctctgcatctttcatttcctttgaactattttacacctctataagccaggggtccccaacccctgggtcatgcactggaaccggttcatggcctgttaggaactgggccacagagcaagaggtgagggatgtgtgagcattcctgcccgagctccacctcccgtcagatcagtggcagcattagattctcataggagcgaaccctattgcgagctgcacattcctgggatctaagttgcacactcctcgtgaaatcctaatgcctaatgatctgaggtagaacagctttgtccccaagacatcccccgatcttggtctgtggaaaaattgtcttccatggaactggttcctggtgccaaaaatgttggggaccactgctctaagttgtacataattgatagcaatgcaaaaactctttgagttggtagaaatgcaagttctcacctttggaaggacaatgaattgctcctcatcttccagggaaaaggccagttttgcatctatctatgaactccttttagcattcctgaatcaattatgttaagtgtagtacttagaattccactttgaactggttacgacaccttaattaatgagataaagagcatctctgaaatgtgtcgtcatatgtttatgtgagtcctgatcataatagttttaaaaaatgatctcttaactcgttgtgatttcttctcccccacggccccacccagccgcagtatccacggagcttagttttctgtggcccaggagggcaggagacccggtgttgacggggagatctgagattggccccaacttttccccacagctctgcttcaaggagtgccctgggaaggcctcccaaccccacacctgtcctgttggccaaggcgagctccatgccatgtggcatctctgccgctggccacctggtgagtatctgttgaatagagaaatgtgcagcatctccacagagcttccagggcttctgtgctctccaaacatctctgggctcccggcaccctctcagggtatgatgtgttggtggctgggttgggcccctgtccctgagggtaggactcaggcaaggacaaagctctggactcaaagagctggtgtgggggtgagtgaaaggaacaggagctttggggtcagaaatgcgggtttcagcctgcattgtccccatgagcaggggcttgcaggctcaccaaggcctcagtttcttcgatggtgagagagtgtcagagactgcagcacgtatttgaaagtgtccagggacggcaggggtctgggttggaccagctctcctgaatactgagggtgcgatcttgaccattgtgaaaggaaaataaaatctcaggaccctaaagtcactatgccaaaaagaacagttgaggtgggaagctgagtcatgaaaaaaaaaaaaagtcatgcgtttccttttgtttccaaactgagagcagcagcagataggccaggtctacccaggtggcctccctcaccctgacaatataaattaacagcccggtcttcatgacatgggacaaaatgagacaagaaatcatccctcctgcccctgagacaaatgcatatttgacttcttcctctactctgtttattttcttataaagtgcagatttactgagcacaaggcgaatgcgtaattgctccctccacccctccttttcatgcaacgtgggggctcagtgagatgtaatcaaagcctcagaagaatgtgactctcccgtcttgcttttttctctttcatctttcccctcctccagcttttccccttttcaatattgaagcaggacatagtgtgactgcatctggggtcaggtgtggggtggtccatgtggatagtgaggaaggtggtccctgcccgtggtggtccgggtttcctgggagatggccagacgtgggtgctgaggggaggaggccagtgcagtcactggacgggagagagcatgtccattgtgctgagtgggctgggagggatccacagagaagacggtgtggctcaacagctggcactggggacaggaacgtgggtgaagggcctggcacatggagtagctcaaggcgtgaggctgtgacccacctggagagcctgtgcctgagtgtgctgggtgggtgctggggttgcaaacattcgtgtgcctgtgaggcccgtgtgtgtatgtgtgtgtcacgtggcccccatgcgtgtcaggcattgttgcgtgtcccccatgcgtggcaggcagcatcacatgtcccccatgcgtggcaggcattgtcgcgtggcccccgtgcgtggcaggcatgtgcagcctgagtaccatgccagatggggcgttctgtctcctccaggccctgccctgccatgtgagcagggagcttccccatgggactgatgttctgtctcctccaggcctggccctgtcctaccatgttagcagggagcttggccatgggagtggtgggcacaggcgtggctgtgccgggcctcactggctggattcggtggggacaccataccccttgctgagtgtgggtgttagagggttcgaggtgccctctgggaggtggtcgggcagaggcagggttgggagtgtgtggggagatgggtgttcagctaggttccttccctgtgcaggggctcagctgaaacctgggctctcactcccctcacccctgcctccccagcatcctcactctgcccctctcttcagcctgcctcgggccttgccctgggacccctgctgagatgacaggaggggcttcagcagcaccctgtgctgggtggacgccgaggtcacaggctcgctctgtgtctcctcacaaggccacgtggtggcaggtccttcctcctgtctaaccagagtcctgcttgctgctctgcaacccccttgggtcacgtggggcaggggcacctagcagggtgggcttcgtggactcaagggccaccagttcctccaggtcaacctgctcagatcgttccattctcccccttcccttggccacagagacctctgtatgctggggtgaccacaaatgtcacaacagcagagtcacaccaggaatgtcacaccatgtcacaccacatcacactatgtcatgccagggatgtcacgccacatcacaccatgaaactcatcatcacactagggatgtcgtaccctgccacaccccatcctgccacatcacaccatgtcacaccgcatcacatcacaccaaggatgtggcaccctgtcacagcacgtcacacgtcacatcatgtcacaccacacctcatcacaccacagatgtcataccccatcacaccacatcacattacatcacaccacgtcaaactacctcacaccccatcacaccagggatgtcacaccccatcacaccacatcacatgtcacaccacgtcacatgccacaccatatcacagtatgtcacagcctgttacacttcatcacaccacatcacaccagggatgtcacaccttgtcccatcacatcacatcatgtcacaccattccacatcatttcatattatagctcatcataccagggatgtcatacccatcacactatgtcacagcacatcacaccagggatgtcacactgtgtcacaccacatcccaccatgtgcaacaccacctcacaccagggacattacaccatgtcacaccacatcccaccatgtgcaacaccacctcacaccagggacattacaacatgtcacaccacatcacatcacccctcggatatcacactgtcataccacatcatacaacatcacaccatgtcctgtcacatcatgccacatgacatccacgtcacaccagagacatcacaccacgtcacaccatgtcatgttacatcacagcacggactgctggggtatgtgcaggggccgcccacagtgcagccttgctggagagttgagggagggtcctggggctgggcatggtgttccctcaggagggctgaccctctggaggatgctcggtcccaggtggaaagggggcggtgggccccgggtggctcagggaggggcccaatttccctaggggaacctggtccaggcgccaggccctgcaggggcaggagctgcaggaagcatctgcttcttcccaactcagcctgctcagtgcacggaatgacccggagcccggcaccatcctgggtttcctttccttatcctggccaggccgtccatcctcagacagtggactggagcccaccccaccagggcacccggaggcccgtagggccccttgaagggcagagggtggagatctctccagcagggtccctgagggctggcaccttctctggacaaagctctcctgcatctctgggacgccatccttgggcttgggatagagccggtgatgcagcagctgcccgccctgcaccccaggtgctgtctccctcaccccccgcggggctgcagcagcgtgtcctgagagttaaagggctgggcttcagcacccagttcaggccaggccccctggagcccaccctccagtggcgagccttcccacggcatggcagggcctggagtctggggatttagtccccaactccgtgtttggtgcagctccagctgctcgatgccacacaaacgaatccaaccactcctccttcctgggtgagatggtctctctcctgccacaggcaactccgacggcattttccagccaccgcagccaccgcagccactgcagtaacaagaccctgtccttgactgagttccagccaggctcctcggagcctctccactcggcctcaaccttggcttgtaaagacttgagcagacactaacagtttctaacagcttctggccgtacccctaggccgacccctgccccgtcaacacctgcctgagaaagctccgtgcaccagaactcaccgtttggaccaaccccgacctccctttctcagggtgtctgctgagagggccgcaaccacacgtccttctatccgttcccgatgtctgtgcatttcctgtgacccaggagggtctttctcaagacttgagagccgctccctgaagtgtcccctttgtgaaggatggggcctgtgtctccaggctctgggaggacagaatcctgacctcaacagtggccggcacggacacagcaggtcccatcccggggacgctgaccagcgctgggcaacttttcccttccccgacgactgagccccgagcacccaccctgctccccctaccacctccctttacaaggctgtggcctctgcacagatgaaggtgagtccaggtcatgccggactctttcttctgttgcaatagttatttctgttgaaaatccgtccttgctacatgatctagtgcccagctttatctttgaaaatgtctctctccacctttgcctctcctgccttgtcctcgttcctggcacccaccatgtgtcctatgggctgaattttaccatagaatgaatcacacaccaggtttcacctgtgcctgatgagggtgacagtttgatgagattttaggcttagaattgatgctgaaaggactaagacttgggggatgctgagacagatgaatgtattttgcatgtgagaagaacatgaaatttggggggccatagcatggactgttatgagttaaattgtggcccctacaaattcatatattcaagtcttaatccctggcctcacaatgtgactatttggagatggggtctttacagaggtcattaagttcatatggggtcactaatctaatgcgatgtgtgttcttataagaagagaagcttaggacacgggcacacagagggatggccatgtgaggaccagggaggagacggtgtctacaagccaaggagagagggcttgagagaaaccagccctgcctgcatcctgatctcagattcctggtctctaggcctgggaggatccatgtctgccgtgggagctgccccgctgtggtcctgagctgacgcacacagatctgacacccacctctcgcttcggaccatggttggttctggaaggccctccctgtggctctgcctggccagcctgagccagctcccagcctcgacccagctttccctggaggccctgtcccccgcagagtgaccagggcaggcagcaccgtgcccagcaggaggagaaactgcatccatgtagaaaagaggagaagccccgggggtccatgtagcgacaggggccagggagggccgctcgggcaatgcgtgtggctgcaggaggcggggggcgagtgcagggagcccccgaggtgcagctcgaccagcctcctcctgaccgtgcttcccaccgggggcaggaggcgcgtggacacaggaaggcggctcccatcacgaagtacaagacttaaaaaggatattttattgtcatcacaaaagaaacatcaaagacaattaatgagctttagaaaatttaaaagaagaagaaaagccaaagctgaaatggtgacacctccttcgagtgagcccgggagtcctccctgacggccgaggcaggcgctggccgcagtcccgctcgagcctcccttcctgtctgtggattctgcgtgacagtcacggaacggtgtgatgggggcagcagagcgtgggggcctctgtccagcactcgtggccagcagccccgctttcgcaagaacacgggcaccctctttgtcgtcttgcctctccacctggtgcccccagagtggctgcttgttcctgctgcacgtgacccgggactggacgccagcctctgtgatgagttctggctgtgtccacgctcctggctctcccggtgtccctccacctctctccccgatgctcctgggcctcctctgtcctcaggccccaccaaggctgagtcttgcccgcctgggacctggtcaccagccttctgtgggaggcctgtctgggcagatgcccagcccttccttgggctatcctcacccttgcactgtggggctcctgcagcggccacatggcccaggctcttctccgagtgatctcggtggactggagtgggtggtaggtggcagtgtcctgggcctggccctttctctccccagtgcggactctggggctggctgtccctgcgggtccagttccacccgagaatccagcagtgtgggcaggcagccaaggggtggtgctggcaccgagactgttcccaggagccagagagcagcgttctttgcttgaaatcagaacaacctcattcctcatgtcaggagttcacgggagtgcccggaatggaggctggctggctgcgggctgggaggaaggccgtctgagtgagccttcgcagctctcggaagcctccccaacagggcctgatggtgctgtggcttccctaccttggcgactgatgctcccactcaccatctggaaaccatgcctgtgttcaggaggctggcgtggacggggttggctccagggcgaggtcctgcctgagtgggggcctgggatgccggttacctccttttgtgtgagcacctggtggtccagagggcagggacgtcctgctgaggggacacctggccctcagcgccctgcatgcaccaagcagcggaggtctggggtagacctgctatgcacagggtctggaaggggggcgtttcagggctcagagggcgactgcgaagccagagagccatggggttgagggcggtgaggtcagggggcaggtgtggcctgggtggtggctgagcatggcccacggctcgtgtgtggggtctgggcggccctggacaccccgcagagggtggccctaggccccctgccttatcatgttcctgtagtcggggacgatggtctgcttcaggtccaccactgaggagaagatccacttcacctgtaggcaaggcacagcacaggggtgagcgaggccacagccctgcccctgagccccacccacccctcaggccacccaggccacagccctgctcccaaggcccatctgcctttcaggccacccaggtaccggggctctacactgcctgcccccaggcctggacatggagagcagagccatggtagtgacagcatgtggataacacagaagacaacgtcagggacaggtggggacagcgtgggggacagggagaggtggggagattgggggacaggtggggacagcatgggggacagtgtcagggacaggtagggacagcgtgggtgacagggagaggtggggagagtgggggacaggtgcggacagcatgggggtcagtgtcagggacaggtagggacagcgtgggggacagggaaagctggggaaagtgggggacagcatgggggacagtgtcagggacaggtagggacagcgtgggggacggggacaggtgcggacagcatgggggacagtgtcagagacagggacagtgtggggggtgagtgggggacaggtggggacagcatgggggagtgtcagggacaggtggggacagtgttggggaaggtggggactgtggggtacagtgttggggaaggtggggacagcatgggggacagtatcaggaatgggggaccgcatgtgggacagcgtcagggacaggcggagactgggggacagtgtgggggaaaggtgggacagcatggcggacagtgttggggacaggctgggggagagcattggggacaggtacagcgtgggggacagaatcagggagaggtggggagaccgtggggcacagcatcaaggacaggtggggacagtgtgggggacagtgtcaggatgggggatagcatgggggacagtgtcggacatgtggagacagcctgggggacactgttggacaggtgtgtacagcatgggggacagtgtcagggacagtttgtggagagagtgggggacagtgtcagggacagtgtgtgacagcatgggggacaatgtcaaggacagctggggacaacgtgcggccgaccttgaagaaggtgacggtggcactgtagcacacgcttagcaggaagagtgtgatgaagatggtgatggtcgtccacagcccgtccagctccccgtcctgcgcctccgcacagctctcctccagttgcagctctggacaggaagggggtggtcagtgctgtgtccccctgggcttgggcctctgggggtgattccctctgtggcggggcccaggatgtagggcccggccgggatgggccaacaatgtcctgaggtcagctcccggaagctgtccaccctgggcaccagctttggccctggggctcagccagacacccggccctagatagcgacctggccctcagcaggacccactccccgtctcccgtgtccctccctgagccccagagggcaggaggatggtgaaacccacccctcatgtgaccccagctgcagggaagggctgtattgggacgtgggccagtgccagggacgcgacgtggcgtgtgttcccctgtgtgtgtggcggctgcaggggcaccttgtgagaggagggctgggtttgtctgagctggtcagcatgtggagaagctgccgagcggctcgtgggccttgaggtgccgcgtggggctcgtgggggcctgtgtctgaggagtgttcacgtgtgcgaggaccttgctctggtctgggtgctgtgcggttcgcccgggtgaggctccgtgtgtgaggcgtgcacgtgtgtgtgtggtggccgtgtggccggccaacctcagtgcggggtttgttgaacgggtctgggctgagtgtgtgtgtgggcatctggaccagtccctccacagggcccgagagtgcatgtccccggagtcggttgtgtccccatgtgggttcgaggctgggcagggctgccaggggttagtgccgtgggggtagatgggtgagggagggcctgtccctacgcacatggactaggcatgcccccgagtgggcatgcgggtcggaggacagggcgctcacagaacaggacagtctcctacagaggcaggggctgtgtgtctgtccccaggggctcctagggcttctcgtggcccagcccagggcaggtgctgctggagggagggccacgctggcaaatcccccaccctgccgagggcagcccctggctgagccccaccctaggcggcccaggcacacctgcacagcctgggccagtgtggggacagtgggacccgctctgcctccctcatgccactcaggcctcagactcggcctgacccgtggaaagaaccatcacagtctcgcaggggcccagggcagcgctgggtgctttatttccatgctgggcgcccgggaagtatgtacacggggtacgtgccaagcatcctcgcgcgaccccgagagcccggggagcgggggcttgccggccctggcactcatttacccagagacagggagaggctcttctgtgtgtagtggttgtgcagagcctcatgcatcacggagcatgagaagacattcccctcctgccacctgctcttgtccacggtgagcctgctgtagaggaagaaggagccgtcggagtccagcacgggaggcgtggtcttgtagttgttctccggctgcccattgctctcccactccacggcgatgtcgctggggtagaagcctttgaccaggcaggtcaggctgacctggttcttggtcatctcctcctgggatgggggcagggtgtacacctgtggctctcggggctgccctgtagggacagaggttggcacagcggtcactcccagggcagagggtgggccgagctgacctctgtccatgtggccctcgcaccccgtgggtcccacctttggctttggagatggttttctcgatggaggacgggaggcctttgttggagaccttgcacttgtactccttgccgttcagccagtcctggtgcaggacggtgaggacgctgaccacacggtacgtgctgttgaactgctcctcccgcggctttgtcttggcattatgcacctccacgccatccacgtaccagttgaactggacctcggggtcttcctggctcacgtccaccaccacgcacgtgacctcaggggtccgggagatcatgagagtgtccttgggttttggggggaacaggaagactgatggtccccccaggaactcaggtgctgaggaagagatggaggtggatgcgtcagcacccggctggggcctgtccctggatgcaggctactctagggcacctgtcccgccttgagctggagggcgaggcctgggttggcttacctgggcatgatgggcatgggggaccatatttggactctgcagagagaagattgggagttactcagatctgggaggagagaaggtgtctgagctgagggagtggagagtttggcctttggggtgggcttaggtcaggggcagggtcctcccggatatggctcttggcaggtctgagcgcagcacctgcccctgtatgcgcagggcctggggtaggggcatccagcctgtggctgcccggagcctggtggaaaaatccagaagaccctctccctgagcatgagtggggtggtcagaggcctccgggtgaggagacagatggggcctgccttgctgccctgggctggggctgcacagccggggtgcgtccaggcaggagggctgagcctggcttccagcagacaccctccctccctgtgctggcctctcaccaactctcttgtccaccttggtgttgctgggcttgtgatctacgttgcaggtgtaggtcttcgtgcccaagctgctggagggcacggtcaccacgctgctgagggagtagagtcctgaggactgtaggacagccgggaaggtgtgcacgccgctggtcagggcgcctgagttccacgacaccgtcaccggttcggggaagtagtccttgaccaggcagcccagggcggctgtgctctcggaggtgctcctggagcagggcgccagggggaagaccgatgggcccttggtggaagctgcaagagaggtggtgccatgtgaccgcggtgtgggacagagctgggcccagggcgcagaggcccctcggttcttgtctatctgcgatggtccatgcagggtccagtgtctgggctcacgggcattgggtgtgcgcctggctggcgccacctgcgtcaccttagccccctccctgcccccagccaaagtcaggcccggcctgccccagaaagcttgcaggaccggtggccctgtggtgcccttctgcaggcacccctgcagcctagggggcggggctcggcagccaggtcagcgctctgtgcctgccgggagtcagcacagtccagtgtctctagcttggcctcagctctggccatcggtgccacctcagggacggctcatgcccattggccccactccagccttttatgggtgcctggcttgaccagtggacactgttctcagatggcttctcgtgggtcccccgagtcccctgaagctcctgaccctgccgccccagcgtggccctccgctagtgagtgggcctgacttgcccagggccctggtcatagcctgccctctgccctccaaggcccttttcttctgtgcagcagaggggccagacactgcatagggtcggcgcccttcagccccagggccccggaaccccctgccttggaatagcctcctggagcctcctcctcagcctctcccctcctttccccttagccccagtgtgcagcagcccaggtcagggccctgagtgcctggatgccccctgcctcccagtgtcctgcattacttctggaggctcagtcaccacaacctcaccctcccagccctggcctggccttctcggccaccagcccacctcctccctctctccagagcttcccccggcaaggtccctgctgggctcaacccaggccccccagcacaggtaggagccttgcacctgcccttggccctccccaccctgcatggtgccaggacccccaggccacagggaggccccatttctctctgccgctggcccagtggccctggagtcccactgcaggtggggtgtgcccctgacctctgaggaggctaagcgccctgccctcagccaggccatcccctctgctcggccccagggccccgctcaccaccccttcccctcacctgcaccacaggctctggctgactctgcccaggccctgaatgggcccctctggcagccctctgctgctacactgccctgcaccacctccactcagcttcattgtgctgatggtcctggctcctggcagcccatcttgctccttctggggcgccagcctcagaggccttcctgcccagggtccgctggggccagccctgggaccctcctggtctcaagcacacgttccccctgcagccacacctgcccctgcctgagagcccagccctgagccctggaatgccttcccttctccatcccagctcgcccttgccaactgctcagtgggatggactcacactcccttcccggcaccaggaggctgcactgcactttcaccagctctcagctgtctgctgccggcaactacccagctcctgccaaagtctaggagctgagtgatgcctcccaccagccctgctcacctgtggctgccttgccctgagctctagtgcctgtcccctgctcgtcctgcctcccaccggccctgctgacctgcggcggctctgccctggtcccctgacctccaggagctgccccttgctcctcctgccccccaccggcccttttcacctgaggctgctctgccccggtcgcctgagctccaggaggtgccccctgctcctcctgccccccacctgcccctgctcacctgcggcggctctgccctggtcccctgagctccaggagctgtcccctgctctgcaacctcccactggccctgctcaccttctgatgctctcccctgtttcctgagttccaggagccgccccctgttcatcctgcctcccacctgcccctcctcccctgtggctgctctgccctggtcctctgagctccaagagctgccccctactccttctgccccccacctgcccctgctcacctgtggctgctctgccctggtcccctgagctccaagagctgccccctgctcctcctgcccccccacctgcccctgctcacctgcggcgtctctgccctggtcccctgagctccaagagctgccccctgctcctcctgccccccctcccctctcctgtttgcctgtggctgctctgccctggtcccctgagttccaggagctgccccctgctccttctacccccacctgccctgctcacctgtggctgctcggtcctggtaccctgaactccaatgcctgccccctgctcactctgtcctccctcaacccggggcagcaatgtcactcaggccactgttgcccccctgcctgtcctggcaccctctgtccaggtttgggctgtttttctggcctcatttttgtttttgcagcacttggcttgttccctatgctgtggagcagccccagtgtccagtcaggtctccccaacagagccccttgcctatgtgcccctcctggatgagctcccggatcctcccgtccctgcactgctcctgctctggaagcctctccggaacctcagctcctcagtggcctctgctctgctgggcctcagcccctcccctcgccccaggcctgctgcactctgggcctttctgggcctccctggactcttccctcctcccgcccgtgcactcagcacagctctcccctcctctccgctgctgaccacagccctgctccccgccagcaggtgccccagccccatcagctggctctgagcccagcccctgtccctcccctgtccctgcctctgcctctgggctccttggcttccacccttctgtcctgctgccacactcaccctcgctgctctgctcccggctcacctgctgtccttggtcctggctgagaggagggccctacggccagctctgctgaccctgccctgggctctggtgatgctgccggcctggacaagcccctccgttcacctggggcctctcctcctccctcgctctgctgcctcctgagctcaggtcggtcgtgcccatcctggcatcaccccacagccggttctgccgcatcccgtcatgttcctcgtgctcccagcccggtcgtcctggaggcctcagtcagcctctggtgtgtcctgccctgttggcttggaagcccctgcccacggtccccgtcgtctcgcactgggtgggcatcagtgcctgaaggctgcccacctcccccgtgctggctccgcttgggcttccatgtggggctggcctcgcgcccgcgtctccccagcctcttgcagcctgttcagcagctcaggtctaggagcgccgacggctgcgcccaggctgtcctcctcccgagcctgtgcccctgccctgtgctgaccccactcaccgaggtgggggtctcaacccttcctgttctggcgaggtacatgtgggcggccccgcccccgccgtcagccgctatttgtcttcctaggaaatcacagctcaggtcccaggtccccaggggtgtgaactccacgctgcaaagactaagaacaggattgaaaccagcggcaccccttacttcctgaagttcccttttcttctggtggtttctgtgtcagagggcgagggggagtccacacagagccgaggctgcctcatgggtgtgtggggatgggggtggtggctgcccccatactcccccatactcacgggagaaggtggggagcccggaccttgtgtgctgctcttttctctgtctctgagtccctggggctggactgagactggcagcgattatgaccattctgcccatggtctcagcctctcaatacctgggcctctcacctgaagcttctggccccccactgggccctggtggctgctttggcctgggcatctctccagctgactctcactcatggtggagggaggggagtgtgagttcatcccactgagcagctggcaaaggcgagctgggatggagaagggaagacgttccaaggctcaggtctgagctcacaggcaggggcaggtctggctgcagggagaacgtgtgcttgagaccaggagggtcccagggctggccgagtggaccctgcacaggaaggcctctgaggctggtgctccagaaggaacaagatgggctgccaggaaccagggccaccagctgtgctcctgggggccgaggggacttgggacaggtggatgaacacactgaagctgagtggaggtggtgcagggcagtgtagcagcagaggggagccagaggggcccattcagggcctgggcagagttggccagagcctatcgtgcaggtgaggggaaggggtaaggggcagggccctggggctgagcagaggggatagcctggctagggacaggacacttaacttcctcagaggtcaggggcacacccgagttgcagtgggactccagggccactgggccagcagtagagagagaaatggggcctccctggggcctggggatgctggcatcatgcagggtggggaggtccaagggcaggtgctaggctcctacctgtgctgggggagcctggactgagctcatcagggaccttgccaggtggaaactctggagagagagaggagctgggcaaggacggatgtggaggtgggaggtagcgggggacgagatgcagccagagggactgggcagaccaaaagcccgaggaggtttcgcacaggaagcatccagagtggaacaggaagcatgcagagtggaacaggaaatgtccagcatggaacaggaagcatccagaatggaacagggagcatccagagtggaacaggaaatgtccagcatggaacaggaagcatccagcatggaacaggaaacatcaagcgtggaacaggaagcgtccagcgtggaacaggaagcgtccagcgtggaacaggaagtgtccagcgtggaccaggaagcatccagaatgggcactttgaagggaaatcatgtccctcccactaaatgtgctctccacaaggacccggcccacccttgtgtccctgctggatccctgagctgacaccagccctgccctcagagagaatgtccaggagacaggtggaggtgcacgtgtgggtccctggggaaatccatcctccagccgcaggctcccagtcggctcccagcttctggctccggcttcaccccatggagctcataatgggctcaacctcccaggctgggggaggatgcagtgaggggccccgcactgcccatggcacacccagggggctggggagtctgcactgggctggggcagggaggcctcgtgcagcctgtggggctggcagctcaggacaacactcgtatccgttaactgtggccctggcaacacagcaccccagactgcgtggcttaaacaacagacgtttattccgtcctggttctggaggccgggcatctgggatggaggcctcggcggggctggcacctctgtgtcatgggagactctgtcccaggctctctccttgctgctgggctttgccggccgtctctgctgctcttggcttatggaagcagcaccatcttcacagggtgttctccccacgtgctgtctgtacccagattcccccttttcatgaggacagcagtcatattggatcagaggcttgccctactccagggtgacctcatctgaacttgattgcagttgcaaagactgtttccaaacaaggtcacattctgtggtcctgggggttaggacttcaacacatgaatttataggggacacattttaacccacaacagtttgccctccgctccccccataatcatgtccttctcacatgcaaaatccctgcaccccatagcaacatctccaagatggctaaccccttccagcaccaactcttagtccacaatctcagaggaatatcacctgcatcaagtgtgggagaaaccacagcaggggtggcgagcctcctgccccctctggcccaggtggggctgtgtgcactgtgtgggtgtgcctggggatccacttgcccccccatctatctgctcattttccccaggctgtgggcatttggggcagaggcctcagtgcctggcctgctctctcccggttctatccaatgcctgtgctgggctggaggggccgggcagggtgggcccccaggaaggaggatgggtcacctgttgctcccataagcccaggtccagtcccagctggggatccatctctggcctctgccagccttgaaatcccccagtcctctgtgtctccctcctggggcccaccaggcctgctcagctctgagtcccatgtccattctcaccctgctctgaaaaatgatgtttttcatttcagaatcatactttcagttctagaattttcatttggttcttgtaaatattttccgtctcttatagagattccccatctagtcactcattataatagtattttcctttaagtctttgaacatgtttaacataacttctttaaagtccttgtctgataactgtatctgcatctaggtcatcttggagttgatctccattgatccctttttcttctgactatggatcacattttcatgtttctttgcatccatggtaattttggatgtgcacctgatgttgataacatgcgtacaggctatggggtttgcattctttcttagcagagcattaattgtttttttcaatgttagcagttagcttgagttgactcaaactcccaagtctgtctgcctggcagttggcagtagctggaatctcagttctctcgacttacaggtgttgctttctgctgggccctttggagttttccctacccatgcacacctaagggatcggccagaggtttcagtggagtttacttgcagattgtgtggtttcccttcggtgagcttctcctttatggacatcttctcttcatttccagctgctctgaaaatgcagccctgcatcccactcctcaccaggagggctgcagtttcctgcttaaactctagctgcacccattacatgcactggggtgtgacttcagacgaatatttcacggaataatccttactagtgtttgcctacttctggtcatgttccagtgcctgcaattggtgtgtgtgggtgttgtgtgtgcttacagtgtttccagtgtttataattgccatctgccaaagggctagtctgatattagctgctctagcattactggaatcagaactactttctctcatgtggtttttcattttcatttccctgttgactagtgtggttcaacaccttttcatatgtttagtggctatttggatatcttctgtaaaacatctgttcaattctcttgcctattcctcgttggattatttgattttttttctcattggtttacaggggtcttctttatattatggatctgtttctgtcagtcagttatatatgtttataggaaacattgagaaaaattagtaggtgccttccatggaaagcaaggcatcgtcttgtacactcttccaggttatttcattctgtggagctctgcatcttttatttcctttgaactattttacacctctataagccaggggtccccaatccctgggtcatgcactggaaccggttcatggcctgttaggaactgggccacagagcaggaggtgaggggtgtgtgagcattcctgcccgagctccacctcctgtcagatcagtggcagcattagattctcacaggagcgaaccctattgcgagccgcacattcccgggatctaagttgcacactccttatgacaccctaatgcctaatgatctgaggtggaacagctttgtccccaagccatcccccgatcctggtctgtggaaaaattgtcttccatggaactggttcctggtgccaaaaatgttggggaccactgctctaagttgtacataattgatagcaatgcaaaagctctttgagttggtagaaattcaagttctcatctttggaaggacaatgaattgctcctcatcttccagggaaaaggccagttttgcatctatctatgaactccttttagcattcctgaatcaattatgtaagtgtagtacttagaattccactttgaactggttacgacaccttaattaatgagataaagagcatctctgaaatgtgtcgtcatatggttatgtgagtcctgatcataacagttttagaaaatgatcttttaactcgttgtgatttcttctcccccacggccccacccagccgcagtatccacggagcttagttttctgtggcccaggagggcaggagacccggtgttgacggggagatctgagattggccccaacttttccccacagctctgcttcaaggagtgccctgggaaggcctcccaaccccacacctgtcctgttggccaaggcgagctccatgccatgtggcatctctgctgctggccacctggcgagtatctgttgaatagagaaatgtgcagcatctccacagagcttccagggctactgtgctctccaaacatctctgggctcctggcaccctctcagggtatgatgtgttggtggctgggttgggcccctgtccctgagggtaggactcaggcaaggacaaagctctggactcaaagagctggtgtgggggtgagtgaaaggaacaggagctttggggtcagaaatgcgggtttcagcctgcattgtccccatgagcaggggctgcagactcaccaagacctcagtttctaccatggtgagagagtgtcagagactgcagcacgtatttgaaaagcgtccagggacggcaggggtctgggttggaccagctctcctgaatactgagggtgtgatcttgaccattgtgaaaggaaaataaaatctcaggaccctaaagtcactatgccaaaaagaacagttgaggtgggaagctgagtcatgaaaaaaaaaaaaaaagtcatgcgtttccttttgtttccaaactgagagcagcagcagataggccaggtctacccaggtggcctccctcaccctgacaatataaattaacagcccggtcttcatgacatgggacaaaatgagacaagaaatcatccctcctgcccctgagacgaatgcatatttgacttcttcctctactctgtttatttgcttataaagtgcagatttactgagcacaaggcaaatgtgtaattgctccctccacccctccttttcatgcaacgtgggggctcagtgagatgtaatcaaagcctcagaagaatgtgaccctcccctcttgcttttttctctttcatctttaccctcctccagcttttccccttttcaatattgaagcaggacgtagtgtgactgcatctggggtcaggtgtggggtggtccacgtggacagtgaggaacgtggtccctgcccgtggtggtccgggtttcctgggagatggccagacttgggtgctgaggggaagaggccggtgcagtcactggacgggagagagcatgtccattgtgctgagtgggctgggagggatccacagagaagacggtgtggctcaatagctagcaccggggacgagtacgtgggtgacgggcctggcacatggactagctcaaggcgtgaggttgtgacctgcccagggagcctatgcctgagtgtgctgggtgggtgctgggttcgcaagcatttgtgtgcctgtgaggcccgtgtgtgtatgtgtgtgtcacgtgtcccccatgcgtggcaggcatcgtcgcgtggcccccatgtgtggcaggcatcgtcgcgtggcccccatgtgtggcaggcatcgttgcgtggcccccatgtgtggcaggcattgtcgcgtggcccccgttcgtggcaggcatgtgcagcctgagtaccatgccagatggggtgttctgtcttctccaggcctggccctgccgtgtgagcagggagcttccccatgggactgatgttctgtctcctccaggcctggctctgtcctgccatgttagcagtgaccttggccatgggagtggtgggcacaggcgtggctgtgccaggctttgctggctgggcttggtgggggcaccataccccttgctgagtgtgggtagcagagggttcgaggtgccctctgggaggtggtcgggcagaggcagggttgggagcgtgtggggagatgggtgttcagctaggctccttccctgtggaggggctcagctgaaacctgggctctcagtcccctcacacctgcctccccagcatcctccctctgcccctctcttcagcctgccttgggccttgctctgagaccgctgctgagaggaccggaggagcttcagcagcaccctgtgctgggcggacgccgaggtcacagcctcgctctgtctcctcacaaggccacgtggtggcaggtccttcctcctgtctaaccagagtcctgcttgctgctctgcaagcccacttgggtcacgtggggcaggggcacctggaagggtgggcttcgtggactcaagggccaccaattcctccaggtcaacatgctcagatggttccattctcccccttcccttggccacagagacctctgtatcctggggtgaccacaaatgtcacaacacaagagtcacaccagaaatgtcacaccatgtcacactgtggggaaaagaaagatcagactgttactgtgcctatgtagaaaaggaacacataagaaactccattttgatctgtacaaagaaaaattgttctgctttgagatgctgttaacctgtaactttagccccaaccctgtgctcacagaaacatgtgctgcatggaatcaaggtttaatcacaccccatcacaccagggatgtcccacaccatcacaccacatcacatcatgtcacaccacccacatcacactatgtcacagcctgttacatcacatcacaccagggacgtcacaccctgtcccatcacatcacatcatgtcacaccattccacatcatttcatattatacctcatcaagccagggatgtcatacccatcacactacgtcacaccaaatcacaccagggatgttacatctgtcgcatcacatcacactatgtccaacaccacctcacaccagggacatcacaccatgtcacaccacatcccaccatgtcacaccacatcacaccagggatgtcacactgtgataggacatcacaccatgtcacacgatgtcatgttacatcacagcatgggctgctggggggtgtgcaggggcagccttgctggagagttgagggagggtcctggggctgggcatggtgttcccgcaggagggctgaccctctggaggatgctcggtcccaggtagaaagtgggaggtgggccccgggtggctcagggaggggcccaatttccccaggggaacctggtccaggcgccaggccctgcagggggcagcagctgcaggaagcatctgcttcttcccaactcagcctgctcagtgcacggaatgacccggagcccggcaccgtcctgggtttcctttccttatcctggccaggccgtccatcctcagacagtggactggagcccaccccaccagagcacctggaggcccgtagggccccttgaagggcagagggtggagatctctccagcagggtccctgagggctggcaccttctctggacaaagctctcctgcatctctgggacgccatccttgggcttgggatagagccggtgatgcagcagctgcccgccctgcaccccaggtgctctctccctcaccccccgcggggctgcagcagcgtgtcctgagagttaaagggctgggcttcagcacccagttcaggccaggccccctggagcgcaccctccagtggcgagccttcccacggcatggcagggcctggagtctggggatttagtccccaactctgtgtttggtgaagctccagctgctcgatgccacacaaacgaatccaaccactcctccttcctgggtgagatggtctctctcctgccacaggcaactccgacggcatttcgcagccaccgcagccaccgcagccactgcagtaacaagaccctgtccttgactgagttccagccaggctcctcggagcctctccactcggcctcaaccttggcttgtaaagacttgagcagacactaacagtttctaacagcttctggccgtacccctaggccgacccctgccccgtcaacacctgcctgagaaagctccgtgcaccagaactcaccgtttggaccaaccccgacctccctttctcagggtatctgctgagagggccgcaaccacacgaccttctatccgttcccgatgtctgtgcatttcctgtgacccaggagggtctttctcgggacctgagagccactccctgaagtgtccccattgggaaggatggggcctgtgtctccaggctctgggaggacagaatcctgacctcaacagtggccggcacagacacagcgggtcccatcccggggacgctgaccagcgctgggcaacttttcccttccccgacgactgagccccgagcaccctccctgctccccctaccacctccctttacaaggctgtggcctctgcacagatgaaggtgagtccaggtcatgccggactctttcttctgttgcaatagttatttctgttgaaaatccgtccttgctacatgacctagtgcccagggggatgctgagacaggatgaatgtgttttgcatgtgagaagaacatgaattttgggggccagagtctggactgtgatgggttaaatcgtggcccctacaaattcatatattcaagtcttaatccctggcctcacaatgtgactatttggagatggggtctttacagaggtcattaagttcatagggggtcactaatctaatccgatgtgtgttcttataagaagagaagcttaggacacgggcacacagagggatggccatgtgaggaccagggaggagacggtgtctacaagccaaggagagagggcttgagagaaaccagccctgcctgcatcctgatctcagattcctggtctctaggcctgggaggatccatgtctgctgtgggagccgccccgctgtggtcctgagctgactcacacagatctgacacccacctctcgcttcggaccatggttggttctggaaggccctccctgtggctctgcctgggcagcctgagccagctcccagcctcgacccagctttccctggaggccctgtcccccgcagagtgaccagggcaggcagcaccgtgcccagcaggaggagaaactgcatccatgtagaaaagaggagaaaccccgggggtccatgtagcgacaggggccagggagggtcgctcgggcaatgcgtgtggctgcaggaggcggggggcgtatgcagggagcccccgaggtgcagctggaccagcctcctcctgaccgtgcttcccaccgggggcaggaggcgcgtggacacaggaaggcggctcccatcacgaagtacaagacttaaaaaggatattttattgtcatcacaaaagaaacatcaaagacaattaatgagctttagaaaatttaaaagaagaagaaaagctaccaaagctgaaatggtggcacctccttcgagtgagcccgggagtcctccctgacagctgaggcaggcgctggccgcactcccgctcgagtctccctgtctgcggattctgcgtgacagtcacggaacggcgtgatgggggcagcagagcgtgggggcctctgtccagcactcgtggccagcagccccgctttcacaagaacacgggcaccctctttgtcgtcttgcctctccacctggtgcccccagagtggctgcttgttcctgctgcacgtgacccggggctggacgccagcctctgtgatgagttctggctgtgtccacgctcctggctctcccggtgtccctccacctctctccccgatgctcctgggcctcctctgtcctcaggccccaccaaggctgagtcttgcccgcctgggacctggtcaccagccttctctgggaggcctgtctgggcagatgcccagcccttccttgggctatcctcacccttgcaccgtggggctcctgcagcggccacatggcccaggctcttctccgagtgatctcggtggactggagtgggtggtaggtggcagtgtcctgggcctggccccttctctccccagtgcggactctggggctggctgtccctgcgggtcgagttccacccgagaatccagcagtgtgggcaggcagccaaggggtggtgctggcactgagactgttcccaggagccagagagcagcgttctttgcttgaaatcagaacaacctcattcctcatgtcaggagttcacgggagtgcctggaatggaggctggctggctgcgggctgggaggaaggccgtctgagtgagccttcgcagctctcggaagcctccccaacagggcctgatggtgctgtgacttccctaccttggcgactgatgctcccactcaccatctggaaaccacgcctgtgttcaggaggctggcgtggacagggttggctccagggcgaggtcctgcctgagtgggggcctgggatgctggtcactacctccttttgtgtgagcacctggcgggccggagggcagggacgtcctgctgaggggacacttggcccccagcgccctgcatgcaccaagcagcggaggtctggggtagacctgctatgcacagggtctggaaggggggcgtgtcagggtcagagggcgactgcgaggccagagagccatggggttgagggcggtgaggtcgggggcaggtgtggcctgggtgatggctgagcatggcccacggctcctgtgtggggtctgggcggccctggacaccccacagagggtggccctaggccccctgcctgatcatgttcctgtagtcggggacgatggtctgcttcaggtccaccactgaggagaagatccacttcacctgtaggcaaggcacagcacaggggtgagcgaggccacagccctgcccccaaggcccgcccacccctcaggccacccaggtgccacggcctcaccactgcctgctctgaggcttgaacttggagaacagagccaggtcaccaacagtatgtggacagcacagacgacagcatcagggacaggtggggacagtgtgggggacagtgtcagggacaggtggagacagtgggggagagtgttggggacaggtgaggacagcatggaggaaagtgtgagggacaggggacagcatggggacagtgacagggagaggtggggacagtgtggaggacagcatcagggacaggtggggacagcatgggggagagtgtcagggacaggtggagagagtgtgggggagagtgttggggacaggtgaggacagcttggaggaaagtgttgggacaggtgggggcagcatgggcgacagtgacagggagaggtggggacagtgtggaggacagtgtcggggataggggacaggaggaaactgtgggggacattgttggggatggggggatagcgtgggggacagtgttgggcacaggtcaagacagcgcggaggagagtgtccgggacaggtggggacagcatgggggacagtgtcagggacatgtggggacagcatggggacagtgtgtgacagcatgggggacaatgtcaaggacagctggggacaacgtgcggccaaccttgaagaaggtgatggtggcactgtagcacacgcttagcaggaagagtgtgatgaagatggtgatggtggtccacagcccgtccagctccccgtcctgcgcctccgcacagctctcctccagttgcagctctggacaggaagtgggtggtcaatactgtgtcctgctgggctcgggcctctgggggtgattccctctgtggcaggacccaggatgtagggcccggccgggatgggccaacagtgtcctgaggtcagctccccacagctgcctgccctgggcaccagctttggccccgggactcagccagacacccagccctagatagcgacctggccctcagcaggacccgctccccatctcctgtgtccctccctgaggcccagagggcaggaggatggtgaagcccacacctcatgtgacctcagctgcagggaagggcggcattgggaagtgggccagtgccagggacgcgacgtggcgtgtgttcccctgtgtgtgggggcctgtgtgtgtgtggcggctgcaggggcaccttgtgagaggagggctgggtttgtctgagcaggtcagcatgtggagaagctgccgagcggctcgtgggccttgaggtgccgcgtggggctcgtgggggcctgtgtctgaggagtgttcacgtgtgcgaggaccttgctctggtctgggtgctgtgcggttcgcccgggtgaggctccgtgtgtgaggcgtgcacgtgtgtgtgtggtggccgtgtggccggccaacctcagcgcggggtttgttgaacgggtctgggctgagtgtgtgtgtgggcatctggaccagtccctccacagggcccgagagtgcatgtccccggagtcggttgtgtccccatgcgggtgcgaggctgggcagggcagccaggggttagtgccgtgggggtagatgggtgagggagggcctgtccctacgcacatggactaggcatgcccccgagtgggcatggaggtcggaggacagggcgctcacaggacaggacagtctcctacagaggcaggggctgtgtgtctgtccccaggggctcctagggcttcccgtggcccagcccagggcagctgctgctggagggagggccacgctggcaaatcccccaccctgccgagggcagcccctggctgagccccaccctaggcggcccaggcacacctgcacagcctgggccagtgtggggacagtggaacccgctctgcctccctcatgccactcaggcctcagactcggcctgacccacggaaagaaccatcacagtctcgcaggggcccagggcagcgctgggtgctttatttccatgctgggtgcccgggaagtatgtagacggggtacgtgccaagcatcctcgcgcgaccccgagagcctggggagcgggggcttgccggccgtggcactcatttacccggagacagggagaggctcttctgtgtgtagtggttgtgcagagcctcatgcatcacggagcatgagaagacgttcccctgctgccacctgctcttgtccacggtgagcttgctgtagaggaagaaggagccgtcggagtccagcatgggaggtgtggtcttgtagttgttctccggctgcccattgctctcccactccacggagatgtcgctggggtagaagcctttgaccaggcaggtcaggctgacctggttcttggtcatctcctcccgggatgggggcagggtgtacacctgtggttctcggggctgccctgtagggacagaggttggcacagcggtcactcccagggcagagggtgggccgagccggcctctgtccatgtggccctcataccccgcgggtcccacctttggttttggagatggttttctcgatgggggctgggaggcctttgttggagaccttgcacttgtactccttgccgttcagccagtcctggtgcacgacggtgaggacgctgaccacacggaacgtgctgttgaactgctcctcccgtggctttgtcttggcattatgcacctccacgccgtccacgtaccagttgaactggacctcggggtcttcgtggctcacgtccaccaccacgcacgtgacctcaggggtccgggagatcatgagggtgtccttgggttttggggggaagaggaagactgacggtcctgccacaggtggtgctgaggaagagatggaggtggacgtgtcagcacccagctggggtctgtccctggatgcaggctactctagggcacctgtcccgccttgagctggagggcgaggcctgggctggcttacctgggcacggtgggcactcgacacaacatttgcgctctgcagagagaagattgggagttactcggatctgggaggagagaaggtgtccgagctgagggagtggacagtttggcctttggggtcggcttaggtcaggggcagggtcctcccggatatggcttttggcaggtctgagccaagcacctgcccctgtgtgtgaagggcctggggtaggggcacccagcctgtgcctgcctggagcctggtggaaaaagccagaagaccctctccctgagcatgagtggggcgggcagaggcctccgggtgaggagacagatggggcctgccttgctgccctgggctggggctgcacagccggggtgcgtccaggcaggagggctgagcctggcttccagcagacaccctccctccctgagctggcctctcaccaactgtcttgtccaccttggtgttgctgggcttgtgatctacgttgcaggtgtaggtctgggtgccgaagttgctggagggcacggtcaccacgctgctgagggagtagagtcctgaggactgtaggacagccgggaaggtgtgcacgccgctggtcagagcgcctgagttccacgacaccgtcaccggttcggggaagtagtccttgaccaggcagcccagggccgctgtgctctcggaggtgctcctggagcagggcgccagggggaagaccgatgggcccttggtggaggctgcaagagaggtggtgccatgtgaccgcggtgtgggacagagctgggcccagggcgcagaggcccctcggttcttgtctatctgcgagggtccaggcagggtccagtgtctgggctcacgggcattgggtgtgcacctggctggcgccacctgcgtcaccttagccccctccctgccccaaagccaaagtcaggcccggcctgccccagaaagcttgcaggaccggtggccctgtggtgcccttctgcaggcacccctgcagcctaggaggcggggctcggcagccaggtcagcgctctgtgcctgccgggagtcagcacagtccagggcctctagcttggcctcagctctggccatcggtgccacctcagggacggctcatgcccattggccccactccagccttttatgggtgcctggcttgaccagtggacactgttctcagatggcttctcgtgggtcccccgagtcccctgaagctcctgaccctgccgccccagcgtggccctccgctagtgagtgggcctgacttgcccagggccctggtcatagcctgccctctgccctccaaggcccttttcttctgtgcagcagaggggccagacactgcatagggtcggcgcccttcagccccagggccccggaaccccctgccttggaatagcctcctggagcctcctcctcagcctctcccctcctttccccttagccccagtgtgcagcagcccaggtcagggccctgagtgcctggatgccccctgcctcccagtgtcctgcattacttctggaggctcagtcaccacaacctcaccctcccagccctggcctggccttctcggccaccagcccacctcctccctctctccagagcttcccccggcaaggtccctgctgggctcaacccaggccccccagcacaggtaggagccttgcacctgcccttggccctccccaccctgcgtggtgccaggacccccaggccacagggaggccccatttctctctgccgctggcccagtggccctggagtcccactgcaggtggggtgtgcccctgacctctgaggaggctaagtgccctgccctcagccaggccatcccctctgctcagccccagggccccgctcaccaccccttcccctcacctgcaccacaggctctggctgactctgcccaggccctgaatgggcccctctggcagccctctgctgctacactgccctgcaccacctccactcagcttcattgtgctggtggccctggctcctggcagcccatcttgctccttctggggcgccagcctcagaggccttcctgcctagggtccgctggggccagccctgggaccctcctggtctcaagcacacattccccctgcagccacacctgcccctgcctgagagctcagccccgagccctggaatgccttcccttctccatcccagctcacccttgccaactgctcagtgggatgggctcacactcccttcctggcaccaggaggctgcactgcactttcaccagccctcagctgtctgctgccagcaactacccagctcctgccaaaatctaggagctgagtgatgcctcccaccggccctgctcacctgtggttgccttgccctgagctctagtgcctgtcccctgctcgtcctgcctcccaccggccctgctcacctgtggctgctctgctctgattccctgaggctaagcctcagtcctgctcaccttctgatgctctcctctgtcccctgagctccaggggctgtcccctgctcgtcctgcctcctacctgcccctgcttacctgagggtgctctgccctggtgctctgagctccaggggctgtcccctgctcctcctgcttcctaccagcccctgctcacctgtggctgctctgccctggtcccctgagctccaggggcttccccctgctcttcctgcccccaccagcccctgttcaccttcagatgccctcccctggtcccctgaagtcccagagctgccccctgttcctcctgcctcccaccagcccgtgctcacctgccgctgctctgccctggtcccgagttccaggggctgcaccctgttcgcccacctcccactagccatgctcagctcttgatgctctgtcctggtcccctgagctccaggagctgtcccctactcgtcctgccacccaccagcccctgctcacctgaggcacctgaggctgctctgccctggtcccctgagctccagggtcttccccctgctcatcctgcctcccacctgcccttgttcaccttcagttgctctgccctggtctgctgagctccaggaggtgccccctgctccttctgcccccacctgccctgctcacctgtggctgctcggtcctggtaccctgaactccaatgcctgccccctgctcactctgccctccctcaacccgggcagcaatgtcactcaggtcactgttgcccccctgcctgtcctggcaccctctgtccaggtttgggctgtttttctggcctcatttttgtttttgcagcacttggcttgttccctatgctgtggagcagccccagtgtccagtcaggtctccccaacagagccccttgcccttgcccatgtgcccctcctgggtgagctcccagatcctcccgtccctgcactgctcctgctctggaagcctctccagaacctcagctcctcagtggcctctgctctgctgggtcagctccctgaacgcacggagcctcacccctcccctcgccccaggcctgctgcactctgggcctttctgggcctccctggactcttccctcctcccatctgtgcactcagcacagctctcccctccactccgctgctgaccacagccctgctccccgccagcaggtgccccagcgccatcaggtggctctgagcctagcccctgtgcctcccctgtccctgcctctgcctctgggctccttggcttccaccctcctgtcctgctgccacactcaccctccctgctctgctcccggctcacctgctgtccttggtcctggctgagagagggccccacggccagcactgctgaccctgccctgggctccagtgatgctgctggcctggacaagcccctccgttcacctggggcctctcctcctccctcgttctactgcctcctcagctcaggtgggtcctgcccatgctggcatcaccccacggccggctctgccgcatcccgtcaggttcctcgtgctcccagcctggtcgtcatggaggcctcagtcagcctctggtgtgtcctgccctgttggcttggaagcccctgcccacggtccccgtcatcttgcactgggtgggcgttggtgcctgaaggctgcccacctcccccgtgctggctccgcttgggtctccatgtggggctggccttgcccccacgtctccccagcctcttgtagcctgttcagcagctgaggtccaggagcgcccacggctgcacccaggctctgtccttctcctcccgagcctgtgcccttgccctgtgctgaccctactcaccgaggtgggggtctcagcccttcctgttttggcgcggtacatgtgggcagacttgcccacgccgtcagctgctatttgtcttcctaggaaatcacagctcggccctcaggtccccaggggtgtgaactccacgctgcaaagactaagaacaggattgaaaccggcggcaccgcttacttcctgaagttcccttttcttctggtggtttctgtgtcacagggtaagggggagtccagacacagccgaggctgcctcatgggtgtgtggggatgggggtggtggctgcccccatactcgtgggagaaggtggggagcccggaccttgttcactgctcttttctctgtctctgagtccctggggctggactgatactggcagtgattatgaccattctgcccgtggtctcagcctctcaatacctgggcctctcacctgaagcttctgacccccactgggccctggtggctgctttggcctgggcgtctctccagctggctctcactcatggtgcagggaggggagtgtgagttcatcccgctgagcagctggcaaaggcgagctgggatggagaagggaaggcgttccaaggctcaggtctgagctcacaggcaggggcaggtctggctgcagggagaatgtgtgtgcttgagaccaggagggtcccagggctggccgagtggaccctgcacaggaaggcttctgaggctggtgctccagaaggaacaagatgggctgccaggagccagggccaccagctgtgctcctgggggccgaggggacgtgggacaggtggatgaacacactgaagctgagtggaggtggtgcagggcagtgtagcagcagaggggagccagaggggcccattcagagcctgggcagagttggccagagcctgtggtgcaggtgaggggaaggggtagggggcagggccctggggctgagcagaggggatggcctctgcttagcttagggcacttagcttcctcagaggcgaggggcacacccgagttgcagtggcactccagggccactggactacaagcagagagagaaatggggcctccctggggcctgggggatgctggcatcatgcagggtggggaggtccaagggcaggtgcaagtctcctacctgtgctgggggagcctggactgagatcaggagggaccttgccaggccgaagctctagagagagggaggagctgaggaaggacgaacgtggaagtgggaggtaaggggggatggtatgaggccagagggactgggcagaccaaaagcccgaggaggtgtcgcacaggaagtgtccagaatggaataggaagtgtccggaatggaaaaggaagcatccagcatggaacaggaagcatccagagtggaacaagaaaggtccagcatggaaaaggaagcatccagagtggaatgggaagcgtccagagtggaacaggaagcatccagaatgtaacaggaagcatccagagtggaacaggaaatgtccagcatggaacaggaagcatcaagaatgtaacaggaagcatccagagtggaacaggaaatgtccagcatggaacaggaagcatccagaatgtaacaggaagcatccagagtggaacaggaaatgtccagcatggaacaggaagcatccagaatgtaacaggaagcatccagagtggaacaggaaatgtccagcatggaacaggaagcatcaagaatgtaacaggaagcatccagagtggaacaggaaatgtccagcatggaacaggaagcatccagaatgtaacaggaagcatccagcatggaacaggaagcatccagagtggaacaagaaacgtccagcatggaacaggaagcatccagcatgtaacaggaagcatccagagtggaacaagaaacgtccagcatggaacaggaagcatccagcatggaacaggaagcatccagcatggaacaggaagcatccagagtggaacaagaaatgtccagcatggaacaggaagcatccagagtggaatgggaagcgtccagcgtggaacaggaagcatccagagtggaacaagaaacgtccagcgtggaacaggaagcgtccagcatggaacgggaagcatccagaatgtaacaggaagcatccagcatggaacaggaagcgtccagcctggagcaggaagcgtccagtgtggagcaggaagtgtccagcgcggaacaggaagtgtccagcgtggaaaaggaagcatccagcgtggaacaggaagcatccagagtggaacaagaaacgtccagcgtggaacaggaagcgtccagcatggaacgggaagcatccagaatgtaacgggaagcatccagcatggaacaggaagcgtccagcgtggagcaggaagcgtccagtgtggaacaggaagcatccagagtggaacaggaagcatgcagagtggaacaggaaatgtccagcatggaacaggaagcatccagcatggaacaggaagcatccagcatggaacagggagcatccagagtggaacaggaaatgtccagcatggaacaggaagcatccaggatggaacaggaagcatccagtgtggaacaggaagcatccagagtgtaacaggaaacatccagcgtggaacaggaagcatccagcgtggaacaggaagcatccagcgtggaagaggaagcgtccagcatggaacgggaagcgtccagaatgggcactttgaagggaaatcatgtccctcccactaaatgtgctctccacaaggacccggcctgcccttgtgaccctgctggatccctgagctggcaccagccctgccctcagagagaatgtccaggagacaggtggaggtgcacgtgtgggtccctggggaaatccatcctccagccgcaggctcccagtcggctcccagcctctcgttccagcttcaccccatggagctcataatgggctcaacctcccaggctgggggaggacggagtgaggggccccccactgcccatggcacacccagggggctggggagtctgcactgggctggggcagggaggcctcgtgcagcctgtggggctggcagctcaggacaacactcgtatccgttaactgtggccctggcaacactgcaccccagactgcgtggcttaaacaacagacgtttattccgtcctggttctggaggccgggcatctgggatggaggcctcggtggggctggctcctctgtgtcatgggagactctgtcccaggctctctccttgctgctgggctttgccggccgtctctggtgctcttggcttatggaagcagcaccatcttcacagggcgttctccccacgtgctgtctgtgcccagattcccccttttcatgaggacagcagtcatattggatcagaggcttgccctactccagggtgacctcatctgaacttgattgcagctgcaaagactgtttccagacaaggtcacattctgcggtcctgggggttaggacttcaacacatgaatttataggggacacattttaacccatgacagtttgccctccgttccccccataatcatgtccttctcacacgcaaaatccctgcatcccatagcaacatctccaagatggctaaccccttccagcaccaactcttagtccacaatgtcagagaaacatcatctgcatcaagtgtgagagaaacccagggtgagattaggagagaaaccacagcggggtggcgagcctcctgccccctccggcccaggtgaggccgtgtgcactgtgtgggtgtgcctggggctccacttgcccctcccatgtacctgctcattttccccaggctgtgggcatttggggcaggggcctcagtgcctggtcggctctctcccggttctatccaatgccccaagcttgctgggctggaggggccgggcagcgtgggcccccaggaaggaggatggcttcccagctggggctccatctctggcctctgccagccttgagatctccggtcatctgtgtctccctcctggggcccagcaggcctgctcagctctgagccccatgtccgttctcaccctgctctgcttttccttggggtgctggccctgccctggcctccacaaatggcccctgcccccaccccttcctgtctgaggggctgggctgttcctctcctgcccggcgtgtgcccacctaggcccaataggcatagtgcccccagcccctcctgccctcttctggccttcacgcccagccatgccggcagcccgcctcagtggcctgggccttcaccagctcctggctctgtgtccagctgccactcctgtggccctacggtgctgcccctttccctcagtgatgggggctgggcttcctgggaacgggctgtgtctcagctgcacacacctgtgtgtgtcagtgtgcgcatgggagtgcgtgtgtgtgctgggggtgtgtgcaggaatgcttgtgtctgggggcagggggagcatctgccttcctgccccaggcctggaatggccgtgccagggtgggtgggagcagtgcgtgcgaggacagtgctgctttgacgtctgcgtgtggctggtgtgggcgggaggacgtggtgtggcacgagtctcgggctccccatctccatccagctgatcccggatggctgcgctcctgagggtttagagcagcccagggggtcaggaggctgttgggacgctggaggcaagcgctggcagggatgggggtgggctggccaggcagcgtggccagggggcttcgagccggggcagtgaaccatcccccaactttttaaagttttaaaagtcatatttactcaagtgtagtttacattcagtataatccatcctgtgacatgtaagtttcaacaaatgcacagtcatgcaaccaccaccgtaatccagatgaacagttgcaagaagatgtagaatctctccaaaaattccaccaggcccctttgcaatcaacgcctccctgatggctaggaatccattgatctgcattctgtcagaagactcagagttcatcattaaaatgatctattatggaaaatattataagcatacaaaacacaaaaccaagttttaaaaagtgaggtatttcttaaaagtttagtatacaaacaaaatgaaggtaccttcacattttactacagatgtgcagatagttttcttggtgcacagagataaggcagaattaagtcagaataaacgttctaaaactgacctccggaagaactagtcttagtcatttctttgcagagtatgtgaaccaagattcgggtttggtctttggtgttagcactgtgtcaaggatcagatagaaagtacaaatggaggggcccctttctgaggccaggccccactgtcggggcatgtggggtgaccaaaggccaataccagctgaggctaagaggctgctctcagaaaggtaggtttgcaggtgtctcttgaaccctttgttcagaaccgggacgtgtggctgggcagcagccttcagaatccccacaggctggtgcccggtgcccacagccctctcgggttgtcaggaccctgcacccgtggtggggtgctgggctccagagttccctgggaccagctgatctcttgtccttggttttggcccaaatgcaagcccctggtctcctccaagtaacttcctttccccagggctgtccaggccccaccgctgcctgttccttcccagggcctcccgcaagtcccgatgctgacgcctctctgcccacctagtttgtggccgccgcctccagctctgtgtctgcctcccagcgagggagccgtggttgatgatctcgtgagtgtctgcccttctgaaggtacagtgtgaagtctcatcagtctcacttcaatgcctaagcacctcttcagaaaccagggattcatccaggtttctccatctttaaccatgttttctaaaagttttcttggcaatttcctggcaatttgcaagacaggattttttggttgccaacttccaattagctttaaacttgccacgatctcccaggtcatcccgtccatcgatgatgcttattacattcttcctgatttccatgtggccaaattcaatagttatttaccccaggcttgtattttggaggctaaagaactctgttaccagctatatccgtgctgtggctgccgtaacaaaatatcacaaatgtggcttaaaacaacaaaaattttttcagagttctgggagtcaggaatctgagatcaaggtgttggtggctgtctctgagtgctccaggggaggaccgtccacctcttccagcttcctgtggtgcaatagtttggatgtgtgtctctccaaatttcatgttgagatgtgattcccagtgttggaggtgggcctggtgggaggtgattagatcatggggctggacccctcatgaatggcctagcaccatctcccaggtgatgagtgagttctccctcagttagtccctgtgacagctggttgtttaaaagtctaggacgtgccacttctcttctcttgctccctcttgccatgtgacatgcctgctcccccttcgccttctgccgtgattgcaatctccctgaggcctcgccagaagcagatgccagggccgtgtttccggaatggctgcagaactgtgagctagttaatcctcccttccttgccacagtgcctggtgcaaacctcttttctttataaattaccagattcatgttttttttttttttctagtaacacaaatagactaactcagaacattggtattgaggagtggaacattgctataaggatacctgaaaatgtggaagcagctttggaatcaggtaacaggcagagaggttagaagaatttggaggactcagaagaagacaggaagatgagggaaagtttggaatttcttagagactattaaatggttgtcaccaaaatgctgatagacatatggactgtgaaagccaggctgatgaaatctcagatggaaatgagaaacttattgggaactggtgtaaaggtcacgcttgttaaatcctaagaaacaacttggctgcattgtgttcatgccctagggatctgtggaaggttgaccttaagagtgatgacttagggcatctgtggaagacatttctaagcagatgtttctaaggtgtgacctggttgcttctaacagtctatggtaagatatgggagcaaagaaatgacttaaagttggaacttatatttaaaaggtgtaaacgacaaaataaaatgctaatccaaggggattccaaagaaacctggaaaaccagttcaggccatgacaggaaggggagggtggtttggactccctcactataccctctccctgttggagcttaggctcagctgaccagtgttaacattaaaacagggagcttaagactgacaaagcagactctttgtagcaataagatatcaaatcccaacctgattctggtatagcatcacatgacaggtggcaggcatggaaggaaattaaagtattttatgccagaatatatttctctgacacattttggaagggccctgcaaagccgtctcttgtggaggaaatgtatattctgttgagaatctttttccctttccaggtctcttcctgattcaggagagatttatccaagagtctggcaccttttaggttctgataagagacattgaccatctcttctctctggaacgtggaggcttcatctacataacaagaaacttggcttccacaacccccttatcttaagcattgctttttgctgacttcaactttttagataatttaactttttcagccaattgccaatcagaaaatcttcaaatccacctatgatttggaattccccactttgaattgtcctgcttttccaaaccaaaccaaaccaatgtatactttacatgtattgattgatatgtctccctaaaacataaaagcaggccgcaacccaaccaccttgcacaggtgttctcaggaccttttgaggctgtgccacagttcatggctctcacatgtggctcagaatcaatctcgtcaagtgttttatggagtttggcttttttcatcaacaaagggaagcagagcataaaaaatgtggaaaattcacagcctggccatgtggtagaaaagaaaaggtattttcaggagacaaatataagtaggctatggagcagccagttgctagagagattagcataactaaaagggagctaagtgctcatatccagaacaaagggaaaaaggccttgaaggcctttcggaaatctctgaggtggtctttcccataacaggcccagaggccaagagggaaaggatggttttgtgggccatgcccatggccactgctgcctgtgcagccttgggacactgctctccacatcctggttcctctggctccagccttggctcaaagggccccaagtacagcttaggctgcttctttggagagtgcaagccactataagccttgggaacttccatctggtgttaagcctgtaggcccccagaatgcaagagtgaaggaggcttggcatcttcactctagatttcagaaatgtatgagaaaccctaggtgcccagagagaagcctcctgccagcatggagccctcacagagaacctctactagagcagtgccaaagagaatgtggggttgaacccccatataatgtccccaccagggcactgcctagtggagctgtgggaagggggccactgtcctccagaccccagaatggtagatccactggcagtttgcaccctgaatctggaaaagccacaggcactcaactctatcgtgtgagagaagccacaggggctacatcctccaaagccacaggggtagagttgtccaaggctttgggagcccaccccctgcaccagtgtgccctggatatgggacatgaagtcaaaggagattaccttggagctttaagatttaataactgccctgctggatttctgacgtgtatggggcatgtagatcctttctttttgccaacttctcccttgtggaatgggaatgtttacccaatgtctgcactctcattgtattttgggagtcaatttgtctttgatttcctaggctgataggtggaagggactcatcttcagatgagacttgggacttgggaattttttgttgattctggaatgaggtaagactttgggggactgttgagaaggcatgattgtattttgcaacatgagaaggacatgagatttgggggaccaggggtggaaggatatggtttatatatttgtcccctccaaatctcatgttgtaatatgattcccagtgttggaagtggggccactaggaggtgattagatcaagggggcagatccctcatgaatgattgagcatcttccccttggtgatgagtgaattctcccccagtcagctcacacacagtctagttgtttaagtctgggccccccctcagcctcttgctcccattcttgccatgtggcatacctgctctcccttcaccttctgctatgattgtaagtttcctgaggtcctcgccagaagcagatgctgatgccatgcttcctataaagcctgcagaactgtgagctaattcaatctctttcctttataagttacccagcctcatgtatttctttacagtaatgcaaagggacaaacacaggtggctcctgacacacccctcatcttctcctttgtcatcatctggctacttccatgtgtgtctgtgtcctctcctctcatgaggacaccagtctttggatttgggacccatcgaaaatttagtatgatatcatctcaagtccttaaactaatttgtaaagaccctatttctaaatatggtcacattctgaggttccaggtgggcatacatttggccagggagatgccatcaacccagcacaccagcctacgcaggtacatttgcatatagcttagggttgacctttcccatggaagtattacatccccctctggactccagtttcacatgttttagaatgcttcgccttgtccagcaggatgagtctcttttcatttttagtatttttctctctcttctttgcattagattaaaaataattgacatagtctattgatgcatctttaagttttcagttccttctcatgtctgctccattctgttatgaaacttgagtaatgtttttctatttcttttcttttttaataaaatagagatgggatttctccatgttgcccaggctggtctcaaactcctgggatcaagtgatccttccttcttggcctcccaaagtgctaggataacaggcatgggccactgtgcctggccaaatgatgtttttcatttcagaatcatacttttagttctagaattttcatttggttcttgttaatattttccctttcttacagagattccccatctagtcactcattataaccatattgtcctttaagtctttgaacatatttaacatgacttctttaaagtccttgtgtgaaaactgggtctgcatctaggtcatcttggagttgatctccattgatccctttttcttctgactatggatcacattttcatgtttctttgcatatatggtaattttggatgtgcacctgatgttgttgataacatgtggtacaggctatgggttttgcgttcttccttggcagggcattgattgtttttttcaatgttaggaaacagcttgagttgactcaaactcccaagtctgtctgcctggcagttggcagtagctggaatctcagttctctcgaccttacaggtgctgctttctgctgggccctttggagttttccctacccatgcacacctaagggatcggccagaggtttcagtggagtttacttgcagattgtggggtttccctttggtgaccttctcctttatggacatcttctcttcatttccagctgctctgaaaatgcagccctgcatcccactcctcaccaggagggctgcagtttcctgcttgaactctagctgcacccattacatgccctggggtgtgacttcagaccaatatttccgggaataatccttactagtgtttgcctacttctggtcatgttccagtgcctgcaattggtgtgtgtgggtgttgtgtgtgcttacagcttttccagtgtttataattgccatctgccaaagggctagtctgatattagctgctccagcattactggaatcagaactactttctctcatgtggtttttcattttcatttccctgttgactagtgtggttcaacaccttttcatatgtttagcggctatttggatatcttctgtaaaacatctgttcaattcttttgcctattccttgttgaattatttgattttttttctcgttggtttacaggggtcttctttatattatggatctgtttgtgtcagtcagttatatatgtttataggaaacattgagaaaaacaaaagattagtaggtgccttccatggaaagcaaggcatcgtcttgtaccctcttccaggttatttcattctattgagctctgcatcttttatttcctttgacctattttacacctctataagccaggggttcccttcatcacaccatatcacactatgtcacaccagggatgtcacaccacatcacactatgtaactcctcatcacactggggatgtcgtaccaggtcacaccccatcatgccacatcacactgtgtcacaccgcatcacatcacaccaagtatgtgacaccctgacacagcacatcagacatcacatcatgtcacaccacacttcatcacaccccaccccaccagagttgtcacaccccatcacaccacatcacattacgtcacgccatgtcaaactacatcataccccattaccccagggatgttatgccacatcacattatgtcacaccacaatacaccacatcaaattgtgtcacaccacatcacaccccatcacaccagggatgttatgccacatcaccttatgtcatgccacatcacaccacatcacaccccatcacaccgtggatgtcacccgtcatcacaccacttcacataatgccacacaacatcacaccccatcacaccaggggcgtcacgccccatcagaacacgtcacattatgccaaaccacatcacatcatgtcacaccacaccacaccacactatgtcacagcctgttacacttcatcacaccacatcacactagggatgtcacaccttgtcccattacatcacatcatgtcacaccattccacatcaaaccatattatgccccatcataccagggatgtcataccatataatactatgtcacactgcatcacaccagggatgtaacaccacatcacaccatgtccaaccttgtagcccaacaccacatcacagaagggacattacaccatgtcataccacatcacaccatgcaactcctcatcacatgagggaggtcgaaccctgtcacaccccatcatgccacatcacaccatgtcacactgcattacatcacaccaacgatgtgacactctgtcacaccacatcacacatgtcacaccagagatgtcacactccatcacatcacatcacatcacacccgttaaatgatatcataccccatcacaccagggatgtcacaccgcatcacatcaggtcatatcacatcacactacgtcacaccacatcacaccaggggtgtcacactctgtcacaggatgtcccaccatgtcacaccataccacatcacaccatatcatatcctatcatactagggatgtcatgccccatcccactatgtcacaccacatcacaccatgtccaaccatgtcacatcacatcacaccacatcacaccatgtcacaccagggatgtcacactctgtcataccacatcacaccatgtcctgtcacatcacacattacaccctggcacaccatggatatcacaccacatcacaccatgtcatgttacatcacagcatggactgctagggggtgcgtggaggcagccttgctggagagttgagggagggtcctggggctgggcgtggtgttcctgcaggaggactggccctctggaggatgctcggttccaggtggaaagggggaggtggggcctgggtgcttcagggaggggccatccttgggcttgggatagagccggtgatgcagctgctgcccgccctgcaccccaggtgctctctccctcaccccccgcggggctgcagcagcgtgtcctgagagttaaagggctgggcttcagcacccagttcaggccaggcaccctgaagcccaccctccagcggcgagccctcccacggcacagcagggtccgggctctggggatttcacccccaactctggtgcagctccagctgctcgatgccacacaaacgaatccaaccactcctccttcctgggtgagatggtctctctcctgccacaggcaactccgacggcattttccagccaccgcagccaccgcagccactgcagtaacaagaccctgtccttgactgagttccagccaggctcctcggagcctctccactcggcctcaaccttggcttgtaaagacttgagcagacactaacagtttctaacagcttctggccgtacccctaggccgacccctgccccgtcaacacctgcctgagaaagctccgtgcaccagaactcaccgtttggaccaaccccgacctccctttctcagggtatctgctgagagggccgcaaccacacgaccttctatccgttcccgatgtctgtgcatttcctgtgacccaggagggtctttctcaagacttgagagccgctccctgaagtgtccccattgggaaggatggggcctgtgtctccaggctctgggaggacagaatcctgacctcaacagtggccggcacggacacagcgggtcccatcccggggacgctgaccagcgctgggcaacttttcccttccccgaagactgagccccgagcaccctccctgctccccctaccacctccctttacaaggctgtggcctctgcacagatgaaggtgagtccaggtcatgccggactctttcttctgttgcaatagttatttctgttgaaaatctgtccttgctacatgacctagtgcccagggggatgctgagacaggatgaatgtattctgcatgtgagaagaacatgaattttggggcccagagtctggactgtgatgggttaaattgtggcccctacaaattcatatattcaagtcttaatccctggcctcacaatgtgactatttggagatggggtctttacagaggtcattaagttcatagggggtcactaatctaatccgatgtgtgttctaagaagagaagcttaggacacgggcacacagagggatggccacgtgaggaccagggaggagacggtgtctacaagccaaggagagagggcttgagagaaaccagccctgcctgcatcctgatctcagattcctggtctctaggcctgggaggatccatgtctgccgtgggagccgccccgctgtggtcctgagctgactcacacagatctgacacccacctctcgcttcggaccatggttggttctggaaggccctccctgtggctctgcctggccagcctgagccagctcccagcctcgacccagctttccctggaggccctgtcccccgcagagtgaccagggcaggcagcaccgtgcccagcaggaggagaaactgcatccatgtagaaaagaggagaagccccgggggtccatgtagcgacaggggccagggagggtcgctcgggcaatgcgtgtggctgcaggaggcggggggcgtgtgcagggagcccccgaggtgcagctggaccagcctcctcctgaccgtgtttcccaccgggggcaggaggcacgtggacacaggaaggcggctcccatcacgaagtacaagacttaaaaaggatattttattgtcatcacaaaagaaacatcaaagacaattaatgaactttagaaaatttaaaagaagaaaagctaccaaagctgaaatggtggcacctccttcgagtgagcccgggagtcctccctgacggctgaggcaggcgctggccgcactcccgctcgagtctcccttcctgtctgcggattctgcgtgacagtcacggaacggcgtgatgggggcagcagagcgtgggggcctctgtccagcactcgtggccagcagccctgctttcgcaagaacacgggcaccctctttggcgtcttgcctctccacctggtgcccccagagtggctgcttgttcctgctgcacgtgacccgggactggacgccagcctctgtgatgagttctggctgtgtccacgctcctggctctcccggtgtccctccacctctctccccgatgctcctgggcctcctctgtcctcaggccccaccaaggctgagtcttgcccgcctgggacctggtcaccagccttctctgggaggcctgtctgggcagatgcccagcccttccttgggctatcctcacccttgcactgtggggctcctgcagcggccacatggcccaggctcttctctgagtgatctcggtggactggagtgggtgggaggtggcagtgtcctgggcctggccccttctctccccagtgcggactctggggctggctgtccctgcgggtcgagttccacccgagaatccagcagtgtgggcaggcagccaaggggtggtgctggcaccgagactgttctcaggagccagagagcagcgttctttgcttgaaatcagaacaacctcattcctcatgtcaggagttcacgggagtgcccggaatggaggctggctggctgcgggctgggaggaaggccgtctgagtgagccttcgcagctcttggaagcctccccaacagggcctgatggtgctgtggcttccctaccttggcggctgattttcccactcaccaactggaaaccacgcctgtgttcaggaggctggtgtggacggggttggctccagggcgaggtcctgcctgggtgggggcctgggatgccggtcactgactccttttgtgtgagcacctggtggtctggagggcagggacgtcctgctgaggggacacctggcccccagcgccctgcatgcatcaagcagcggaggtctggggtagacctgctatgcacagggtctggaaggggggcgtgtcaggggtcagaaggtgacttcgaggccagagagccatggggttcagggcggtgaggtcgggggcaggtgtggcctgggtggtggctgagcatggcccacggctcgtgtgtggggtctgggcggccctggacaccccgcagagggtggccctaggccccctgcccgatcatgttcctgtagtcggggacgatggtctgcttcaggtccaccaccgaggagaagatccacttcacctgtaggcaaggcacagcacaggggtgagcgaggccacagccctgtccccgagccccacccacccctcagggcactgagggccacatctcttcccccaaggtccacccacccctcatgccacccaggccacagccctgcccctgaggcccatccgcccttcagtccacccaggtgccagggcctcaccactgcctgctctgaggcctggacatggagagcagagccagggcaccaacagcatgtgggcagtacagaagacagcgtcagggacaggtggagacagtgtgggggatagtgttggggacaggtggggacagagtgggggacagtgtcagggacaggaggagacagagtggtggacagtgttggggacaggaggaaacagtgtgggggacatttttggggacaggaggggacagtgtgggggacagtgttggggacaggtggggaaagcatggtgtacagtgttggggactggtggggacagcgtgggggaaagtgttggggacaggaggggacagcgtgggggacagtgttagggagaggtgggaacagtgtaggggacagtgtcagggggaggtggggacagcgtgggggacagtgtcagggaaaggtggggacagtgtgggggacagtgtcagggagaggggacagtgtgggggacagcgtcagggagaggtggggacagcatgggggacagtgtcagggagaggtgcggacagcatggacagtgtcgggacaggtggggacagtgtgaggacattgttgggacaggtggggacagtgtgggggacagtgtcggggacaggtgggaacagcgtgggggacagtgtcagggacaggtggggacagcattggggagagtgtcagggacagatggggacagtgtgggggacagcatcagggacaggtggggacagcatgggggacagtgtcaaggacaggtggggacagcatggggtacagtgtcggagatgggtggggacagcatgagagacagtgtcggggacagtgtcagggacaggtggggacagcatgtgggacagtgggacaggtggggacagcatgggggacagtgtcagggacaggaggagacagcatgggggacagtgttgcatacaggaggggaaagcatggggacagtgtcagggactgtaggggacagagtgggggacagtgtcagagacaggaggagacagcatggggacagtgttggggacaggaggggacagcgtgggggacagtgtcggggacaggtggggacagtatgggggacagtgtcggggacaggtggtgacagcgtgggggacagtgtcagggacaggaggagacaggagaagacagcatgggggacagtgtgaggtacaggaggaaactgtgggggacattgttggggacaggaggggacagcgtgggggacagtgtcagggataggaggagacgagaagacagtgtaggggacagtgtcgggacaggaggggacaggaggaaacagcatgggggacattcagggacaggaggggactgtgggggacagtgttggggacaggtggggatagcatggggtacagtgttggggactggtggggacagtgtggggaatagtgtccgggacaggtggggatagtgtgggggacagcgtcagggacaggtggggatagtgtgggggacagcgtcagggacaggtggggatagtgtgggggacactgtcagtgacagtttgtgacagcacaggggacagtgtcagggacagggaacgtgtgggggacagtgtcagggacagtttgtgacagtgtgggggacagtgtcagggacaggtgggtgcagcattggggatagtgtcaggcacatgtggagacagtctgggggacactgttggacaggtgggtacagcgttggggagtgtcagggacaggtggcgacagcgttggggatagtgtcagggacatgtggagacagtctgggggacactgttggacaggtgggtacagagtgagggacagtttgtgagagcgtgggggacagcgtcagggacaggtggggacagcctggggacagtgtcagggacagtgtgtgacagcatgggggcaatgtcaaggacagctggggacaacgtgcggccgaccttgaagaaggtgacggtggcactgtagcacacgcttagcaggaagagtgtgatgaagatggtgatggtcgtccacagcccgtccagctccccgtcctgcgcctccgcacagctctcctccagttgcagctctggacaggaagggggtggtcagtgctgtgtccccctgggcttgggcctctgggggtgattccctctgtggcggggcctaggatgtagggcccggcctcgatggcccaacagtgtcctgaggtcagctcccggaagctgtccatcctgggcaccggctttggccctggggctcagccagacacccggccctaaatagcgacctggccctcagcaggacccgctccccgtctcccgtgtccctccctgagccccagagggcaggagatatgaagcccacccctcatgtgaccccaggagcagggaagggctgtattgggaagtgggccagggccagggacgtgacgtggtgtgtgatcccctgtgtgtgtgtggcggctgcaggggcactttgtgagaggaggactgggtttgtctgagctggtcagcaagtggagaagctgccgagaggctcgtgggccttgaggtgccgcatggggcttgtaggggcctgtgtccgaggagtgttcacgtgtgcgaggaccttgctctggtctgggtgctgtgcagttcgcccgggtgaggctccgtgtgtgaggcgtgcacgtgtgtgtgtggtggccgtgtggccggccaacctcagtgcggggtttgttgaacgggtctgggctgagtgtgtgtgtgggcatctggaccagtccctccatagggcccgagagtgcatgtccccggagtcggttgtgtccccatgcgggtgcgaggctgggcagggctgccaggggttagtgccgtgggggtagatgggtgagggagggcctgtccctacgcacatggactaggcatgcccccgagtgggcatggggggtcggaggacagggcgctcacagaacaggacagtctcctacagaggcaggggctgtgtgtctgtccccaggggctcctagggcttctcgtggctcagcccagggcaggtgctgctggagggagggccacgctggcaaatcccccaccctgccgagggcagcccctggctgagccccaccctaggcggcccaggcacacctgcacagcctgggccagtgtggggacagtgggacccgctctgcctccctcatgccactcaggcctcagactcggcctgacccgtggaaagaaccatcacagtctcgcaggggcccagggcagtggtgggtgctttatttccatgctgggtgcctgggaagtatgtagacggggtacgtgccaagcatcctcgtgcgaccgcgagagcccggggagcgggggcttgccggccgtcgcactcatttaccccggggacagggagaggctcttctgcgtgtagtggttctgcagaccctcatgcatcacggagcatgagaagacgttcccctgctgccacctgctcttgtccacggtgagcttgctatagaggaagaaggagccgttggagtccagcatgggaggcgtggtcttgtagttgttctccggctgcccattgctctcccactccacggcgatgtcgctggggtagaagcctttgaccaggcaggtcagggtgacctggttcttggtcatcttctgggatgggggcagggtgtacacctgtggttctcggggctgccctgtagggacagaggttggtacagcggtcactcccagggcagagggtgggccaagccggcctctgtccacgtggccttcgcgctccgtgggtcccacctttggttttggagatggttttctcgatgggggctgggaggcctttgttggagaccttgcacttgtactccttgccgttcagccagttctggtgcacgacggtgaggacgctgaccacatggtacgtgctgttgtactgctcctcccacggctttgtcttggcattatgcacctccacgccgtccacgtaccagttgaacttgacctcagggtcttcgtggctcacgtccaccaccacgcacgtgacctcaggggtccgggagatcatgagggtatccttgggttttggggggaagaggaagactgacggtccccccaggggttcagttgctgaggaagagatggaggcggacgtgtcagcacccggttggggcctgtccctggacgcaggctactctagggcacctgtcccgccttgagctggagggcgaggcctgggctggcttacttgcacatggtgggcatgtgtgagttgtgtcacaacatggggttttgggctctgcagagagaagattgggagttactcagatctgggaggagaggtgtctgagctgagggagtggagatcttggcctttggggtgggcttaggtcaggggcagggtcttcccggatatggctcttggccagtctaagtgcagcacctgcccctttgtgcgcagggcctggggtaggggcttccagcctgtggctgcctggagcctggtggaaaaagccagaagaccctctccctgagcatgagtggggcgggcagaggcctccgggtgaggagacagatggggcctgccttgctgccctggactggggctgcacagccggggtacgtccaggcaagagggctgagcctggcttccagcagacaccctccctccctgtgctggcctctcaccaactgtcttgtccaccttggtgttgctgggcttgtgatctacgttgcaggtgtaggtctgggtgcccaagctgctggagggcacggtcaccacgctgctgagggagtagagtcctgaggactgtaggacagccgggaaggtgtgcacgcttctggtcagggcccctgagttccacgacaccgtcaccggttcggggaagtagtccttgaccaggcagcccagggccgctgtgccctcagagacgctcctggaggagggcaccagggggaagaccgatgggcccttggtggaggctgcaagagaggtggtgccatgtgaccgcggtgtgggacagagctgggcccagggtgcagaggcccctcggttcttgtctatccgcgagggtccaggcagggtccagtgtctgggctcacgggcattgagtgtgcacctggctggtgccacctgcctcaccttagccccctccctgccccaaagccaaagtcaggcccggcctgccccagaaagcttgcaggactggtggccctgtggtgcccttctgcaggcacccctgcagcctagggggcggggctcggcagccaggtcagtgctttgtctcaaaaaaaacaaaaacaaaaacaaaaaacaaaacaaaacaaaaaacaaacaaataaaaagttgtaaaaggattgtggaaaagggatcttatgtggtcaaaggcggctgtgattggatttatttatttatttttttgagacagagtttcactcttgttgcctaagctggagtgcaatggtgtgatctcggttcactgcaacctctgcctcttgggttcaagcgattctcctgcctcagcctccagagtagctgggattacaggtgcccaccaccacgcccagctaatttttatagttttagtagagacaggggtttcaccacgttggccaggctggtctcgaactcctgacctcatgatccacccgcctaggcctcccaaagtgttgggattacaggcatgagccactgcacctggccggatttatttatttatttatttttgagacagggtcccactgtgttgcctaggcagcagtgcagtggcactcagcactgaggctgagggaggttgaggtgggagggctcaagcaatcctcccacctcagcctcccaagtagctgggactacgggcacgtgccaccatgcctggccaattttttttttgtattttttgtagagacagggcttccccatgttgcccaggctgatctcaaactcctgggcttaagtgatccaccctcctggaatgctgggactacaggtgtaagccaccttgcccagcctggatggaattatttataaggtttaattaaaattagctttaatattaacagttcatgtgaaactagaatttggtcttctctgttaaagtgacagttttctggaatattggtctgctcttcattatggcaggtttttcttttttttttttcaccttgaaaaatatatatttacaggaacaattccccattctctgggactctttagaaaaaaaaaaggtccattttggggaagcaaaacagtggagacgagtgtagcaccgtcccccaaatcaccaacccccaggtcccaaggcctgggctgggccagggctgacagggaagcccaggagtcttttgaacccactcttcctgcctagaatagagacaggacaggctttatgtcccccattcctccctcccacctccagggacattgaaagtgtcctttgtacctacctgtaggaaattggggggctgggagggagggaactgaaaatacacatttgttatcaaaaataaacatctgggggggaggcggcaggaagattccctcccaaatccctttcttcacacccaccccaccaaatataggaagagatgactccctctcccctattgaaaagccccatttaaaaatagattatactatcaaaatggcagcacgggagagacagggagacctggagtactggctggaggggcccccccagacaggaaccacccccacaaaacccctccatgggaggaaacaggcaggaccccagggagtttggcagacaaaggaatggcttctcagggggaagaagaacaaagggacattcctccctggccaaaaagttggttaaaaaaggataagctgtctgagagaaaggttggggaggtggaaatttctattccaagggtgtgattctgccttggccaagactcccaacccattaaatggtacaaattcttcctggaccccgagtatggccaggaataataaaacgaaactaacttctactcacatcctaaaatggacacagggctccctcatctccccacgggcaggccgaggaatgaagaaagaaaggtcgttctcaagtcagaccccgattgtcctgtcttggggaaaaaagcggggaggtgggggagacgtcctgaccaccctaataggttaggtcaggcgcttcccagtggccttcaaaaaataaataaataaaccgcccctaccattgaagtaggagacgtgtcagggcagccactgggggacggacagaaaagagagaaaagagagaagctgtggaagctgagtgttttctgtggaggagttaatgagagtcactcctgggagaaatccttcccaaggatccccaccccaccacaatcagagcatgagtctttcagttgaactgtgtttctccttgagagagcacggatggagggaccccagaaggggtggtggtgctggtggtggtcatggcctctgcggccctggcgagagcaccgcgggggtcgagaggccagccacgccgatggaagggatgtgcacctgggcgccgccactggacggaagctggcaggagagcttggccgggctgcggggcgcagcgggactcaggctgctccggaagtgaacgctgggaggcagcgagctgggtgtcagcagcgccggggtcaacgtgtgcgtaggaagcagggacagggtcagcgccggcctcggcgcctggaggccggagccagttcccgatcctggggtccgttcgggtcccggcgcacctagcaggctcgggctgagtggaagctctaggtcccggggcttccggcccttctgcggctgggagatctgagggctggaagccgcgtggccgcccgcctgccctgcggtgtccataaggacctcggcagccacgctggcacgccctcctgtggagggacttcaggctcggccttggcggtttctggcacgaaccctctctcccccgcgaattccagctcttcctcgggcccttccacttccacttccgggggcaaagggcggcgcaagcccggctccacattcggctcttccagtttcgggtttggggcctcgggcggggtcaggatgacctgcagagggaagccggcttcctcagcctccaggcaggcctcccaggggcttggactgcaggagctgcgttggggagcaccgctgcaggccgaggctgagggggtggctgcggctgcagagactggatggtgaaggtggaacagaggcccgagcgcatgtacttgttccggctgttgcgcgccaaaccgccagggcctgccattcctgcacccttgggtgtgcctggctttcctgaggcagtgccccctggggcggcatgtgcagcagcaggggccacaactgccatggtgaagtaaccgacacctctgggtggggcgggcagtcctcactcagtggagcaccctgcgacctcaggataggacacaaacttgtagacttaatgccatgtcaaatttgttctctatcttgagcggggatccagaatcgaatagtaaaagaacattaactccagaggccacgaaagaaattgaattagttgaagaaaaaattcagccagcacaagtaaatagaatagaccacttagccccactccgacttttgatttttgctactgcacattctccaacaggcatcattgttcaaaacacagatcttgtggagtggtccttccttcctcacagtacgattaagacttttacattgcacttggatcaaacggctacattaattagtcaggcaaaattacgaataataaaattgtgtggaattgacccagataaaatcattgttcctgtaaacaaggaacaggttagacaagcctttataaattctggtgcatggcagatgggtcttgctgattttgtgggaattattgataatcattaccccaaaacgaaaatcttccagtttttaaaattgactacttggattttacctaaaattaccagacagaaacctttaaaaaaatgctctgacggtgtttactgatggttctagcaatggaaaagtggcttacactgggccaaaagaacgagtcactgaaactcaatatcactcagctcaaagagcagagttggttgctgtcatttcagtgttataagattttaatcagcctattagcattgtatcagattctgcatatgtagtacagggtacaaaggatgttgagacagccctaattaaatatagcatggatgatcagttaaaccagctgtttaatttgttacaacaaactgtgagaaaaagaaatttcccattttatattactcaattcgagcgcatactaatttaccagggcctttaactaaagcaaatgaacaagctgacttgctagtgtcatctgccttcatggaagcacaagaacttcatgcctcaactcatgtaaatgcaacaggactaaaaaataaatttggtatcacatggaaacaggcaaaaaatattgtacagcattgcacctagtgtcaagtcctacacctgcccactcaggaggcagaagttaatcccagaggtctatgtcctaatgcgttatggcaaacggatgtcacacctgtaccttcatttggaaaattatcatttgtccatgtgacagttgatacttattcacattttgtatgggcaacctgccagacaggagaaagtacttcccatgttaaaagacatttattgtcttgttttgctgtcatgggagttccagaaaaaattagataatgggccaggatactgtagtaaaacatttcaaaaattcttaaatcagtggaaaattacacatacaacaggaatcctgtataattcccaaggacaggccataattgaaagaactaatagaacactcaaaatctcaactggtgaaacaaaaagaagaaaaagacaggagtataacgctccccagatgcaacttaacctagcaatctatactttaaattgtttaaacatttatagaaatcagaccactacttctgcagaacaacattttactggcaaaaagagcagcccacatgaaggaaaactgatgtggtggaaagacaacaaaaacaagacatgggaaatagggaaggtgataacatgggggagaagttttgcttgtatttccccaggaaaaaaccagcttccaatttagtatctacaacttacagaagaagttgccatccaccaaggaagcaaagccactgacctggggccaaatacaggagctgacacagttagctaagaaaagcctgaaaaaaacaaagtctacaggtatatcccgcagctctgaagagacagcgaccagcgagaaggggccataatgacgatggcggttttgtcaaaaggaaagggggctatgtagggaaaagaaagagagatcaaactgttactgtgtctatgtagaaaaggaacacataagaaactccattttgacctgtaccctgaacaactgctttgccctgaggtgttaatctgtaactctgccccagccactttgccccaacctggagctcacagaaacctgtgctgtatggaatcaaggtttcagggatctagggctgtgcaggacgtgccttgttaacaaagtgttcacaggcagtatgcttggtaaaagtcatcgccattctccagtctcgatgaaccaggggcacaatacactgcggaaagccgcagggacctctgccctggaaagccgggtattgtccacggtttctccccatgtgacagtctgaaatatggcctcgtgggatgagaaagacctaaccgtcccccagcccgacacccgtgaagggtctgtgctgaggtggattggtaaaagaggaaggcctcttgcagttgagatagaggaaggcctctgtctcctgcctgcccctgggaacggaatgtctcggtataaaacccgattgtacatttattctattctgagataggagaaaaaccaccctgtggtgggagacgagacatgctggcagcaatgctgccttgttattctttactccactgaaatgtttgggtggagagaaacataaatctgtcctatgtgcatgtccaggcatagtaccttcccttgaacttatttgtgacacagattcctttgctcacgttttcttgctgaccttctccccactgtcaccctgttctcctgccgcattcctcttgctgagatagtgaaaatagtaattaataaatactgagggaactcagaggccggtgccggtgcaggtcctctgtatgctgagcgccggtttcctgggcccactgtgctttctctatactttgtctctgtgtcttatttcttttctcagtctctcgtcctacctgatgagaaatacccacaggtgtggaggggctggccccttcagaattcttctagttttctctaatatcaggcaacaactctgcaaactaatttttccctcaccctctgacttggaatcagtcaaatttaaaactgcccttttcctgaagccctgtgagctgaaatgggacaagttgatgtaaacttcagagaaatcatccccacagatcctgtgcgggcagcttctgcaacacctgacctgcaaatcaggaaggcccttcagctgcctacctggctgcagctgaagatgcttcaggcccagcgtctagaaatcttctggcctggtgcccactgggctcagaaactgcatttctaagtgttaacctttgtgtttcatttattttcagagtctctcctcttcgaatgtccaactgctagcaccatgcggcgaaatgtcctcttctatccagtcccaacagaaaatccagctggttcttaatgaacgaaaggccacccaacaagaaaatggacttatattgttggagggaaacgagaatgtctcctctttccttaaacagtgtggactgacaaagattctctgcttggctaaactgcagtcgggctctggaaacttctcctaggccggcctgcacttccttgtaagaaaaaggctttaaaaagtacccggtggggcccggagcggtggctcatgcctgtaatcccagcactctgggaggctgaggtgggctgatcatctgaggtcaggagttccagaccagcctggccaacatggtgaaaccctgtctctactaaaaatacgaaaattagctgggtgtggtggcacgcgcctataatcccagctactcgggaggctgaggcaggagaattgcttgaacccaggaggcagaggttgcagtgagccaagatcgtgccactgcacgatgacacgtgccactgcctggtgacagagtgagactacgtctcaaaaaaaaaaaaaaaaagaaaaaaaaagaacccccctaaatcaggttaaagacccactcttgacatttgatcacccttgatcctgagttcctcatcttccaccatctcccaggtctgatcaccctggtctgtcttcagcaaaaatcttcctgggctaatttagccagaaccctccttccccccaatatttcctcttgggaatgtccgtcctccgagtttacccagctccctggctgtcaatccccgccagcccatgctgtgttaagaactgagccccatctctctcccgcatggccgtggtccctgctcctgcggcggtggtcctgaatcacacctgcctccgcattgaacaactatcatggaataattttttctttaacatttctaaacacactcttaggaggcgccagcagccagcgtgcggagttaagtgcctgtgccctttgtatgaaagtgtcaccgttgtcctggtcttgaggggtggctttcgggtgtaaacggccggcagaggtgagtagatgctgggaggctgctccaggcgtcttgtttgctccagggttcttgagactctcctgtctatgagaacgtgcagtggcacgggacggccgccggggggctcccgagtccggctctggagtctgtggccgcgcgagtgcacctgcctgggccggccctgacggattttttttttttttttgatagagtctcactctgtctcccaggctggagggtagtggcgcgatggcagctcactgcaacctccgcctcccgggctcaagcgattctcctgcctcagcctcccgagtagctgggaccacagacacccgccaccacgtccagctaatttttgtgtttttaatagagaccgggtttcaccatgttggcctggctggtctctccaactcctgacctcaggtgacccacccacctctgcctcgaaaagtgctgggattacagatgtgagccaccacgcccggcctccttttggatgcttctaaagtctctttgcctctggtgttggcagctccatcggcaagcgtcaaggtgtggacgtggagtttgcttttatttatcctgcttgggacttggccttgatcctgacgcgtcctgttattcagcgattttggaaaattcccagccactgcctcccccgactctgtttctcctttgggcagaagaagcccttgtgggagcctccgtccagcctccgcggggctgcgctcgggctgggtggcgtctcctgctctttcttcggtgttaccagctcccgctcctgcgtgtcctctgcgctgcctgtcccatccattcttattttagcctcatctattacggttttcaattctagaagttcttcgtaaaactctcaggtcatttcaaaatgcaatgtgcagtaatttcccattttgcagtaatatttgaatagcttctgtaagtaagtttaaaaaatctcttggccgagcgtggtggccacgctgtaatcccagtactttgggaggctgaggcaggaagatcatgaggtcaggagatcgagaccatcctggctaacacggtgaaaccccgtgtctactaaaaatccaaaaaaattagtcgggcgtggtggcgggcacctgtagtcccagctattcaggaggctgaggcaggagaatcgcttgaactcgggaggcggaggttgcagtgagccgagatcgcaccactgtactccagcctgggcgacagagcgagactccatctcaaaacaaaacaaacaaaaaaaccctctgaagcacacattgcatattctatgtctgataacgccgacattttgcttttgtttgggttcttattctatagtttcttgtttcactgattcttgtttctgcttctttagggcttttctgatttgtatgtgagctgggttcctgggatcctgatctgggcgcgtcttttaggcttgcctctgaggtccgctgtccccgcatgagcggacggcagagcgcgcctgcctgggagcccaggaggctgccgggccagggaccccgggaaccccgggaaccccgggaacctctcagcagcagaactgcagtggcacaagacggccaccagggggtcccgagccggtctctggggtccctgctggggttgaggggctgtggctgcagacgcggacctggcagggggacccgaaccccaacagggccctgaccggccccaaggctgagcctgccctgtcccaccagcgcccagaccccgatgttgggccggggccttcctttccttgtcccggccctctgaggttcgtccccggggtgtgagctgattctgagcacacggaggccttcctcctctctggggctctggagcccctgggggcctgcagggcctgggcctgggcctggctgctgtcctctgtgctcaggagggcttctcccacccacccacttccgggcacagcccccagccccacacccagccgccgggagggcatccccaggggaggaccctctgctccggagccgcgtcccttgtcctccagggacagtggccggaggctggtgcctcaagctcgtgcgcctcatgcagcatcccgtgggtccattcgcgaccatagtgaagacccgcaggccccaggcccgagccggctcccgggcaggccgcgttctggggcttccgcggggacactgggccacgccaggaggaagggtcctgaccagggtcagggagcatcggatgctgccggcagaagtggggggcgcggggccccaccgaggagcccaggccagcttccccatctgccccaggtgcagccttgcaaggcccccaggccacagcgtccccaggtcacagcgtccccacacccagggaatgcaggactttggcagaggctgggatcccagaccacagagccccacaagctgatgcctgttcgcggatgccacagccacctccgcggcaggcgctggggaggggaggggatcacagtgctggacacggaccgggccccagccctgagcccaaggcagagccgggatccggccccgagagcacgcctggccctgcccctggccctggccctgcccctgcccctgcccctgcccctgcccctgcccgtgcccctgcccctgcccctgccccgagcccgggaagcgccgcgtggtcggcggcgttcgatgctgctgtcggccacacgggggcagcagagcctcagcggctgccgcagcgggtccagtttccggccgccggggttgggctggcggtgcctgggggtcctccccagaggcccgcgtgtgaaacgtccgagtgcgctgggcgctggacacggagatgggtgcttgggccacgggcctgggggaccccacacggccggctaggcaggcccagacagcccagggtgggggttccatgggggcaggaggggagaagcctgggctgtggagcagctgggacgtccggggaagggcctgggggtcagaggggcggctcccgggacagggaggcacgtggaggggcggggtttgtggcagccccggagccgcctctgaagcttccatctgcagcctcctgtggggccgggtctgcttctcttgctgggcacccacatccacccccgaggggtgtgcgacaacccccattccagcccactcagatggtctctagcccctcccgtcacagtgaaccccggtgtcggtgcgagacgcctccgtgtattcccggacgtccctctgcaggcccatccccacctcacagacagtcacacccttccaggccttgccccatccccagtccctggcctcaccatcgcattgcagggaggcgggcatatgcaacctccatgaaataaagccctaacggagaaggccagagtgggaacttcgtttccaccagcaggtggggcagacaccctggctagccccggggaaaaccagtaaaaatactggatttaaatcccttcgaattctcctttctacaggcaagctgtttagtgagaaagaaagggccctgcaaagatcctccccaggtggacgggcagcccccaagcctgtcttgagctcccggacgctgctcctggggaagggcctgccgaggacaggggccagtgggagcccctgcctgaccacaggctgttctgcagcccaggtcaggagcgctggtgcctgccgtgtggggtggccctggtcctgaccgcctggggtcccaggtggtcccgggttgtaagagtctgtggtgcttgtgaaaagcttgcacatccttccaggggagactcgcgcgtggggcgagggcaggagcaggagctcataatcacacaggaaaacaggaagccctgaaccccgggctcgggaagcggcggggcgtcaggtttggaggggcttcgtctcccaccacctccccatttgcacccccagtccctgacccgcatctttcctcacctggtcactgtcccccaccctgtcccccaccctgtcccccaccctgtcccctgtctgccatctccctcccaggagggggctgctcctgcctagcacgcggtgcccttcctcccacgtcgcttaattatatttgaaaatacaacatttgaaacgtgcaaagaatggaggggcttttctgtgagtgcagggtgcccctcccgtgtccccccaccagggggcttccccgtccagccccggcttgtccctttcattttaacaaaacgtcctcaccacagtgcatgtgtgttttataaaagcagtattggaagttaatgcttttaatacagaagaaaaaaaaaacccgaaacaatataactgtcctaagtgatgttgagtggggagtgccgggtgggagttgaattgcgggaccacgatccctccacttccagccggtcctgggggtgtcatgtgaccccttctgaccagccctgggcaacctctggatggacgggtggggaggggccgtggaggggatctgggaccaggagagagagagcgtggccaggcagccccaggagggccctccagagcccgagtgggcctgcgtctgtggtccccaggtgcggtccctcgaggtggcgtgtgggccccccaggcccgcgccctgcggttccagcgcctccccaagcctctgtccctgcagcccccaccccccctgcactttcctctcctttgtctgtgctggtggtccctctctcactgtcccacacaacaccgcaccgccctcccccaggaaagcctccaccttttctcttagtgaaatagaagccctttcaaggtgacatgtcacctactcacagaacagtgccccaacccaggacgcagcctgaggcccctcaggagcattgtgtgcccccaggcctgtccccagtggtccccaccgtgggcccaccacagctcctgctgtcaagggcagcctgggtctgagccccgtccccctgtgcagggcacgggtctgggggctggcttgtcccctgctgggcggtgggcggcctggggtgtctcccagacacgctgcctgcggccggctggtgtggactgggcctggtgggccaggagctgccctcactatggcgacaggatcgggctgccaggctcctgtgggggctcagcaggaggggatgggagacggcaatgctcacgcctgacctgctgcccttgggggagccgtggtgccacctggccggcctgcctgagagacccccacggctggtgtgggagcctgggggagccctgggcaggtggtggggcagtgggcagaggtggctgcagagggacagggcctggccaggacgtcaccctgaggccactggagaggtcagcaggggcccaaggagatgcagggattggcagctggggagcacaggggtacccctgagccgtggtacccaaaggtcatgagctgagaggggaaaggcccagagccgctggatggtggattctgggcacctgatccgcagggcgtggtggccctctgagggacccctctgacagactgcaggcaagctgtcaagggtgtgtatgtgtgagggtgtgtgagagtgtgtgggtgtgtgagagtgagggtgtaagggtgtgtgtgagagagtgtgtgagggtatgtgtggagtgtgtgacggtgtgtgagggtgtgtgggtgtgtgagggtgtgagggtgtgtgaagttttcagactgtgagggtgtgagggtgtgtgagagtgtgtgagtgagggtgtgagagtgggggggtgtgagagtgtgggggtgtgagggagtgtgagggtgtgagggtgtgtgtggatgtgtgggatgtgtggggtgtgtgtgcatgtgtgtggatgtgagggtgtgtgtggatgtgtggggtgtggggtgtgtgtggatgtgtgggagtgtgaggatgtgtgagggtgtgtttggtgtgtggggtgtgtgtggatgtgaggatgtgtggggtgtgtggggtgtggggtgtgtgtggatgtgtggggatgtgagggtgtgtgtgcacgtgtggggtgtggggtgtgtgtggatgtgtgaaggtgtgagagtgtgagggtgtgtggatgtgtggggtgtgtgagggtgtgtgagggagtgggtgtgtggtgtgtgagggtgtgtgtatgtgtgtgaggatgtgtgtggatgtgtgtggatgtggggtgtggggatgtgtggggatgtgtgggagtgtgaggatatgtgagggtgtggggatgtgagggtgtgtgtgggtgtgtggggtgtgtgtggatgtgtggggatgtgagggtgtgtgtggatgtgtgggagtgtgaggatgtgtgagggtgtgagggtgtgtgtggggtgtggggtgtgtgtggatgtgtgggggtgtgtggggatgtgagggtgtgtgtggatgtgtgggggtgtgtggggtgtggggtgtgtgagggtgtggggatgtgagggtgtgtgtggatgtgtggggtgtgtggggtgtgtgtggatgtgtggggtgtttgaggatgtgtgtggatgtgtgggagtgtgaggatctgtgagggtgtgtggggatgtgagggtgtgagggcttgtggggatgtgtggtgtgtgtgagcggctgtgtgcactggccgagttgcctgctgctgtcctggcctggggccaggcgtgtgccagctcctgtgtttgttgtgtgcctggcgtgtgctgggtgcccgagtcgggctgggtgtgtctgggtgtggccctggggtgtccctttctggacgtgtgtctccgtgcagaacggaggtcctcgagttcccagaaggaagcccccagccccaggcgggtgcctgagaatagacctggggcctgtgggcgtggcagggctgcccctcggctgctcatggaccccccggacaccagtcccaccctgtgtctgtgatgctcactctctgagccttccctgaccccatgtgccaaagcctggcccagcaatgccacgtgtgcatgtgtgagcgtgagcttggcagcgggtgggagaatgtgtgcgtcagtgtgtgagcgtgagcacggcctgtgcttgtctggctgtgggactgggggcctctgtgacgctgtgagcccttgtggacctgagtgtgggccgtgtgagctgtgtgcacgtggctgtggctgagtgtgagcctctgagtgtgtgtgtctgtgccgtgtacctctgtgtgtctgtatgtgtctgtgtgtgcctctgactttatgtgtgtctgtatctatctctgtgtgtgtctctgcgtgtggtagcgtgtctgtgcttgtgtacctgtgtctgcgtgtgtctctgtctctgtgtgtgcctatgcgtgtctgtgtgtggtagtgtgtctgtgcttgtgtttctgtgtctgtgtgtctctgactctgtgtgtgcctatgtgtgtctgtgtgtctctgtgtgtgtggtagtgtgtctgtgcttgtgtttctgtgtctgtgtgtgtctctgtctctgtatatgtgtctatgtgtctgtgtgcctgtatgtgtgtggtagtgtgtctgtgcttgtgtgtctgtgtgtttgtgtgtgtctctgtctttgtatgtgtgtccgtgtgtgtgtgtgtgaggtatatctgtgtttgtgtgtctctgtgtctgtgtgtgtctctgtctctgtgtgtgtctatgtgtatctgtgtgtcgtgtgtgtgtggtatgtgtgcttgtgtttctgtgtgtttgtgtgtgtctgtctctgtatgtgtgtctaggtgtctgtgtgtgtgttagtgtgtctgtgtgtattgtgtgtctttatgtctctaagtctgtctatgtgtctgtgtctctgtgtgtttgtgtgttctgtgtgtctctgtggggtgtgcatgactatatttgtgggaggctgtatgtgcaggaagggccccctgagccctgtcacccgggctgcaccctgggggtcttcccagggatcctttcctcaaacttgagtcctccctggagggcttaggttccactgagggggtgggcgcaggcacagacccctcctctaggaggctggggtggggctgtcctgcctggctgggacacgggtcacaatgtccccccatgtggtccaccctgttctaggcacagggtgtcatctcccagggtctcagctgctggggtgatgggccccggacagcccctgggtgtggggtggggtcctatggaggcctctgtgtcccactgaagatgcagggctggggttgggcaggtctgttctggggtggtctcgtggggcaaccccagagggtcctgaggccggggtagggttgggcgaccccacctagggtctacgggctgaaagcgcctgggttggccaggcctgggcacaggggaggacagaggtttggtgacaggtgggctgtgaggggcccagcaggtgcacggaggaagctctgtccccaggtgacccacaaaatcctcttccgagggtgctgggggtcctgttcctgggggccatgcctgggacctccatgcaggggtctcctccctggcccagctcccctggggcaaggtccgacttgttaccccctccaccaggcagtcctctgggaagtgccctggggcctggtcactctgggcctggccacagcattggcctggacatggggtgtggctggggagtgtgaatagtcaggaatcctgcaaaccagctgcctgggtgccagccttccccccacctcccccaatgcaaatcgccatctcggaggtgggtgggggtttccacaccactgtcccacctgctctgtggttcccattttcagcatttttagaaatatttgcaagaatgtgtttgtgcctgtgtggtggggtgggggtgggagctgcggcccggtgcccatgaggtcttgtttttcagactggacgggggtgggggagggggagctgcggcccccccacctgctagtgtgtccagcctcctgagtggggcagcgagggtcctggctgggccccagggcatgacccccgatgagtgtgaggcgctgaggccgagtctggtccttggcgaggaggcccagaaggcccaggtgcccgtcctgagcgttatccagggccctgcctcaggcctcatgccggggccaagcccagggctggctggtggccacgcagaggtgagaggggcggggaagtgaggctgggttggaggaaagctgaggggcccaggcctcccactccagcccccgaggcagaccctggcccacccagggaccccctcccatgcacacaagcacacacaacacgtatatgggcatgcgtgtgcacacacactcgctgcagcccgcagcactggctggcccaggtgtcctcgggacgtggtccacgcggtgctgacacgagctggccctgagtgcgggctctgcggggtgccattcccaggccctgcaggggcacatgcggtgtcgtggggcagcaactgtgacctctgccccgcagacccggacatgccgccagagaggccaaggcgtacgctctccgagccttccctgaccccatgtgccaaagcctggcccagcaacgccatgtgtgcacgtgtgtgagcttggcaacaggtgggagaatgtgtgtgttagtgcatgagtgtgagcatgagcgtgtgagatgcaagcgtgtgtgcagtgagtggtggatgagctggaggtgtgcggttgtgcgtgatgcggacgggtgtgtagtgtggacaggtgtgtggggtggacaggtgtgtggggtggacaggtgtgtggggtggacaggtgtgtggtgtggacaagtgtgcagtgggcctggctcattgtcaccgccaggacaaggcctttgtccgcactgatagggctgagcaggtggtccaggctgtggtcaggcagcaatgtcctggcgtggagcaacaggggaggcaggttcatgacacggggcaggacagtggccaggggctgcaagcgtgacctgcgggagggggtgcctgtgtgcgggcatgtctgtgtgtgtctttatgtgtctgtgtgtgtgtgtgtctctatgtgtgtcggtgtgtgtctgtgcatccacgtgcatgtgtgtctgtatgtgtgtgtgcatatccgtgtgtctgtgtctttatgtgtctgtgtgtgtatgtgtttgcctgtgtgtgtctctgtgtgtctgtgcatccatgtggatgtgtgtctatatgtgtgtctctgtgcacatatgtgtgtgtctgtgcatgtccgtgtgtgtctgtgcatttctgtgcgtgtgtgtctctgtgcatgtctgtgtgtctgtgtgtgtgtgtgtctgtgcatgtctgtgcatgactctgtgtgtgtgtctctgtgcatgtctgtgtgtgtctgtgcgtttctgtgtgtgcatgtctgtgtgtctgtgcgtttctgtgtgtgcatgtctgtgtgtctgtgcgtatgtgtatgtgtctgtgcacgtctctgcgtgtctgagtgtcaggggatggcctgtgcttggttcgcagtgcaggcgggtttgctcacacctcccccgcagggctgagcctccagactcccagccccatacaggccccagcccaggggggagccgggcggcgcttggggcctggagccctgacccggggagtcggggcaggactagcgtggaggctctggtgactcagcctcctcgtatgtgtgcactgcagtttgtcctccgtgcatcccttggtggacacttgtggggcttcctgggaggcggccccagacttggacagattctaggacccagagggatggggcagaggcagggatgacagagacagacacaaagcagagagacggaggcagagggagacatgcagagtcacggagacatccgggctcaggccccgactctcaggggccacccccagggaggacacgcagtgcacccccacacccacacctcacacacacactcacacccacatacccccatccacacacacccagagacacacagacacccacagccacacactcacactcacgaacttatccagtcacctttccagcgaggcagggatgacagagacagacacaaagcagagagacggaggcagagggagacatgcagagtcacggagacatccgggctcaggccccgactctcaggggccacccccagggaggacacgcagtgcacccccacacccacacctcacacacacactcacacccacatacccccatccacacacacccagagacacacagacacccacagccacacactcacactcacgaacttatccagtcacgtcccacacactcccacccaacccatacaccacacacctacacaactcatacaccacacactcacactcacaaactatataccacacactcacacacccatataccaaacacgcacaacccatacaccacacactcacactcacaaactatgtaccacacagtcacacaccaaccatacacctatatacactcacacacccatataccacacacacacagctcatacaccacacactcacactcacaaactatataccacacactcacatacccatataccacatacacacaacccatacatcagacactcacacacaacccatacacctatacacactcacacaacccatacacctatacacactcacacccatataccacatacaacccatacaccacacacacacaacccatacacctatacgcacacacccacacaccacacacacagcccatacagtacacactcacaccacaaactatgtagcacacactcacacataacccatacacatatacacacacatatataacacacacacacacagcgcgcgcacatatacactcacacacctatttcccacatacaacacataccacacacacaacccatacatatatacacacacacacatacaccacacacagcgcatacactatatacacaccacactatatataccacactcacatatataacacatacacatatacacacacacccatgtcccacacacacaccccgtgtacatacatacacacccatacacaaaacactcacaacccctacccctatatatacacacacacaccccccatacacacacagagcatacacttacacacactcatagagcacacacacacaacccatataccacactctcacacagcccatatacctatacacactcacacgcccatacaccacacattcacacaactacaccacatacacccacaaactatatgctacacactcacacacagaccatacacctatatacactctcacagccatataccacacacaacccatataccacactctcacaaactttatgccacacactcacacaaactatataccacactcacacacaacccatacacctatacacaatcacacaacccatacaccacacacaacccatacaccacagacacattcacaatctatataccacacaaacccatacatttatacacactcacacacccatataccacacactcacacacagcccatataccacacgctcacacacaaatgatacacctatacacacacccatatgccacacacacaacccatacaccacacacacaaactcatacaccacacacacaacccatagaccacaaacacacacaagccataaccacacacacacacagcccatatgcctatacacattcacacacacaacccatacactgcacacacaacacatacacctatacacactcacactcacaattcatacaccacacactcacacacaacccatacatctatacataaactcacacacaatccatataccacaaacacacacaaccaaacacctatacacacacacacaactcatacagcacacacacaacccacagaccataaacacacacaagccataaccacacacacaacccatacacctatacacacactcataaacaagccgtacacccccccccacacaacccatacaccacacactcacacacaacccatacacttatatacacatacaacccatataccacaaactcacactcaacccgtacacctatatacacacacaacttatacaccacacactcatacacaacccacagaccacatacacaaaccatacccacacactcacaacccatacacctgtatacacactcataaacaagccacacacctacacacactcatacacaacccatacaccacacattcacacacaacccatacgcctgtacacacactcacacacataacccatataccacaaactcacacacaacctatacacctatacacacatacaacccatacaccacacactcacacacacatataccacaccacacacacaacacatacacgaaacactcatacacacacgcatacaccacccacacatacaacccatacaccacacacacaacccatacacctatacacacacacaaactcatgtaccacaaaaacacacaacacatatacctatacacacatacaacccatacaccacacattcatacacaacccatacaccacacacacaacccatagacctatacacacacaacacatgcaactatcacacactcacaacacatacacctcctatacacacacacaacacgcacacttcctatacacacaacccacacgcctatacacactcacaccctcactcacactcaccctcacattcatatactcactaacacacttccacactcacaccctcacccacacttacacccccacccacactcaaaccccgacgctaagtcactgtcacatttgtacccatgctcacacgctcccaccctcacacgctcaccccccaccagctccagggctcactggtgtgtgcccacgaaaccctgcctcgggggtcccctcggtaagctgacagcgctctgctcatcggtggcctggggaaacagggcccacccaaagcctggctcaggaaaggctccaaacacacatgcacatggcccagaaacagatgggcagagctcagcctgcagctgggagcggcggagcgggtgctgggccagagtcggggcctgtctgtgggtggggggcacggcagcacgggcccacctgcacaccccaggcctggcccccgaggtcactgggccaccacccagccctcgccctgttccccgtctgtgctggccggggcaggactctgagcctcggggaaacccacagatacacacgggaccccgaacatcgggctggggaggttggggtgggtaacagcatgccagaggcaggagcaggaggtccaggaccctgcgcactgcgaccccagccctgggggctgaagcccaggacagcctcaggtctcccaggagggactggacagtgggggatggtcagagaacaggacagccagcagggtgcagcctgaggacagggatggacgctgggaggtcaacaggacaggggcaggggctgtggagtgtgagaaggtcctggagggcctggagaacctgtgggtcagtgtctgtgggaaggaggccaggagcagccctgagtggccaggctggcaggggtgaggaggtgggggcagtgaggttagggtgaccgagacagtgaggcctctggccagggaggggaccttggctgggctctgactgaacccagggctcctggagaaggggccccaggcggggatgaggatgtgggcatctgactccatcaacaatggggcttccgacacgcacagcctgggcctcggagacctgggccctgacccgcctccccctggcactgggccgggtgccgtgtgtggtccccagtccccgcagcacctcccccacactggtcacgttccagggcccctctgaagcacctgctgtgaggggatgtggggaggggacagggacttgggcctgagctgccgggtcgggggggagtcggggacccaggctcagcgtgtggctggggaccagacagatggggatggaggaggacacgccctgtacccactgcctgccaaggggctggacccacgcccagtctaggccatgtcccccgaggcctgtgaaccttcaccctgagccactaaaacattcaggagctttgaaagcagcccccgtccttgtcactatgcgatgactctgagcatcacgctgtccctgctggatccaccctccagccccagcgagggaggctgggccccgggcagcaggtggtgagggcagcgggcacagccacgctacagcacacacagggtctcagggacgcgtccaccacagcccgtgcacaggctcctcacggcactgagttcacccggggcgcgggccgtttgtcctcaggagtccggctgtgccctccgcccccagccctgtcctgctgaggctgcagctgggtcccggggcacagggcggccctgagcaccttgtcatgttggtccctgtcgggtgggctgctggctgtctgtggagctggcagagccgcggttcagccttggaggccggtcctggggcccagcagccgtggggagcactgcccagtcccgtgcccacagggaatcacctgggctgaggaagggcccacacgccgacgggatcggggtcaggcagcgcacgcctggcaccgagatcccacgtcccgaagtggggacacggcccaggggcactgttccgggagggtctcaagatggggtctcctatttcaatcttcactccttctgcacctgttagctgggaaccttctagaaggaggggtgtcctcaatcatggggtggttgtgagctgagcacagatcatgcaggaaggtacatggcttctccttcaccaggaaaacagtgcagagagacagagacacagagacagagacagagtaacagagaaagacagacgagagagagacacagagacacagacagagtaacagagaaagagagacagagagacacagagacagagacagagtaacagatagagtcacagagagacagagagagagacagagtaacggagaaagacagagacagagagagacacagagacagagacagagtaacagagaaagacagagagacagagacacagagacagagacagagtaacagagaaagacagagagacagagagagacagagacagagtaacagagaaagagagacagagagagacacagagacagagacagagtaacagagaaagacagagagacagagacacagagacagagacagagtaacagagaaagacagagagacagagagagacagagacagagtaacagagaaagagagacagagagagacacagagacagagacagagtaacagagaaagacagagagacagagagagacacagagacagagacagagtaacagagaaagacagacagagagacacagagacagagacagagtaacagagagagacagagagagacagagacagagtaacagagaaagacagagaggcagagagagacacacagagacagagacagagtaacagagaaagacagagagacagagacagagagagaaagagagacagagaaatagagacacagagatacagacagagacaaagacacagagacagagacagagaaacagagagacagagacagagagaaacagagacacagaaagagacatgcagacacaaatagagacagagatgaggagttacagagagacagagacacagagacagaaacagagtaacagagaaagagagagacagagacagagagagacagagaaatagaaacacagagatacagacagagacagagagaaagacacagagacagagaaacaaagagacagaaacagagagagaaacagagacacagaaagagacatgcagacacaaatagagacagagatgagttacagagagacagatagatagagacagagatggagagacagagacagagagaaagaaacacagatccagaaagagacattgacagagacagagagagaaaaataggcagagagagagagagagaaaaacagagacacagagacagacacacagacacagagacagaaaaagacagagataaagttacagagagacagagatacacagagacagagagacagataaagagagacagagatataggcagagacagacagagaaaaacagagatagaaacagagagacagagataaagttacagagagacagagaccaagacagagataaagaaagacagagacagagtgagagaaacagaggcagtaagagataaagagagttacagagacagagatacagagagatacagagagacagaaagagagatagagacagagatagagatgagagagacagagatagagacagagcaatagagataagagaaagacagatacagagagtgagagacagagagagatagagacagagataagaagagagactgagatagagacagagagacagagaaagagagttagaaaggcagagaaagacagagacaaagagagacagagagggctgaagagaaacagagacagacagcaacagaaagacagagatatatagaggggaagagacagagacagagagacagagaaagacaaaaagagacagagaaagaaacagagagagagaaagagaggtataaggagagacagagagagggagagctacagagaggaagagacacagacagagagacatagagaaacacacacaaaatgacacagaggcagagacagagatgaagagacagagagagagagacagaggcagagagacagagagacacacacaggaagagacagatgagagagacagatatagacagagatacagaaagagaccgagagagacatacacagggacacgaacagacagacagagatacagaggcagagagacagagatatagacagaggcatggaaagacagagaagagagagacacacacacagggacacaaagaggctgagatatagacagagatacagaaagacagagatagaagcagagagacagagagagacacacagggacacgaagagacagacagagagacagaggcaaagaaagggacacagcaaagggacaggcacagagggagggatagacgggaagagagacggagggatagagacagacacgggggagagatggatggagaaaggaggcaccgacggagacacacagaaagagagagaggccaagacaggcaagatggcgggacaaagcccagcagacgggcttgacagagatgagtcagagacaccgacaatgggacagagacagagattcgggcagggagataccttcagagaggcagagagacagggagacagaagggtagccagagacagggacagcgggaaagatggagctggaggctcagatggagacgggtgtgacagagctgggagcagggaggccacagcccacgcagtccgggtgctgcacccaccacggcccccaggcccggagacccagcccccatcaccatgtaacctcaggccatgtccctggccctgctgagcctcagtgttctctctgtacagtggggaccaccaggccatgagggtgggggaggtgcgggcctgcaccagaccggccctgtaccaatcgggctgcctgtgcccaggccaccagggccacctccgctcagcctccttggggcttctggggtgggggttggctgggggccctgccagcgttggctcccctgcccttcctgccaacctgggggctgcccctgggtcctggtcccaaagatggcaacaagttcagaaccactgaattcaataaagttgacgtttgcagggtggtcccagtgtcagtaacccaagtgggcctgtcctgggggagggggcgggtgtccccgaatctggaggcctgagccagcctggccacgctgggggagggggcggggggtgtccccgaatctggaggcctgggccagcctggccacactgggtgggtggcggctgcagctgcaggtggagaatcgtgcaagctatttctggaaacagcctcagagggcaagaaacatgttttcggtgtggaacaaacaaccatttgcatgtgccctgagggccaagtctgcccagaatgagtcactcaaggagaaacagatcagagccctcacacctgcctgggggaggggtgggcgccgctccagggacctgctgttgggcccagagatgccgaaaactcagcccacccggccgccatggcaggacccactttcctcaccagcttgcccctaggtgggacccacaggacccctgggaagccctcagcagcccttgggcaggtcccaccctgcagagaacgcgaaggctcaaaggcccactcgggctgagaccgcagggagccctgggccgcttggatgcagagccctgaggcccgaggctaggctgtgggagggagcagcagtgagacccccactggccctcagggctcacaggtgccccggtgagggtgcagggagcgggggtgcctgccaagcaggaaggcggagggcccaggctgccgtggcaccatcggggcacactatgtgtcactggcccaaggagactcgcccatgaggagctgctgctggtggacgcaggggtgccctccagcctccttggggggctaggaagggagggcagggccaggcagaccctagggtgaggtaggaggactggcaaaaggccagtatggccaagggagagccacatgggggctgggagggcgcaaggttcgggcccggccaaagcgtgggtgccaggtatggtgcccaccaggaccgcgcggcgtgtactccagaaagaccctggggcgcaggacgggcttgccatgctgaggtctggaaagtaaagagaggcacttcacggcagcacgccagcctgcatgatctgtgctcacactcacccactacgagcaatgccctccttctagaagtttcctcactaacacgtgcacaaggaatgaagggaatggggtctcccgtctcacagccctccatgtaatggtgccctcaaccgaccgactgctcccgaccggccgcagccctcggccccgcggcccacctctgcctgaccccggccctgctctcctcctggcagctcagggattcgccactgcctgggctcagccggagcaaagcccgtgtcccccggcaccccacacagccgagtcacccctccctcacggcccccacctcctcgcccctgccggcccagccacgctgagctgctcctgggcccccttcccagagacatcggagccctgcaggttctccaggccctctgcccactccactacccctgcccgctcccagctgcaggctgagctctgcccctttgctcctgggccatgtgtgtttgaggccttccctgagccaggccttgggtgggccctgtttcccccaggccagccatgaacagagcggagggcatgtgcccagctcatagaggggacccccaaggcggggtgtggtgggcacacaccggtgagccaggggctggtggcccagaggcttagacaggccgtaggccccatcggaagtgacagggcctgagggaagctcagtgtgtgtgtgagagtgtgtgtgagtgtgtgagtgtgtttgtgagtgtgtgtgtgactgtgtgtgtgtgactgtgtgtgagtgtaagtgactgtgagtgtgagagtgtgtgtgagtgtgaggtgagtgtgtgagtgtgtgagcaggtgagcgtgggtatgaatgtgacagtgactatctatctctgtctctctctgtttctgtgtatctttcttatctctgtgcctgcctctgtctctatctctctctctgtctctctatctctgttactctgtctctgtctctttctgtctctctgttactctgtctctgtctctgtctctctgtctttctctgttactctgtctctgtgtctctctctgtctctctatctctgttactctgtctctgtctctgtgtctctctgtctatctctgttactctgtctctgtctctgtgtctctctctgtctctctttctctgttactctgtctctgtctctgtgtctctgtctctctgcactgttttcctggtgaaggagaagccatgtaccttcctgcatgatctgtgctcagctcacaaccaccccatgattgaggacacccctccttctagaaggttcccagctaacaggtgcagaaggagtgaagattgaaataggagaccccatcttgagaccctcccggaacagtgcccctgggccgtgtccccacttcgggacgtgggatctcggtgccaggcgtgcgctgcctgaccccgatcccgtcggcgtgtgggcccttcctcagcccaggtgattccctgtgggcacgggactgggcagtgctccccacggctgctgggccccaggaccggcctccaaggctgaaccgcggctctgccagctccacagacagccagcagcccacccgacagggaccaagatgacaaagtgctcagggccgccctgtgccccgggacccagctgcagcctcagcaggacagggctgggggcggagggtacagcgggactcctgaggacaaacggcccgcgccccgggtgaactcagtgccgtgaggagcctgtgcacgggctgtggtggacgcgtccctgagaccctgtgtgtgctgtagggtggctgtgcccgctgccctcaccacctgctgcccggggcccagcctccctcgctggggctggagggtggatccagcagggacagcgtgatgctcagagtcatcgcatagtgacaaggacgggggctgctttcaaagctcctgaatgttttagtggctcagagtgaaggttcacaggcctcgggggacatggcctagactgggcgtgggtccagccccttggcaggcagtgggtacagggcgtgtcctcctccatccccatctgtctggtccccagccacacgctgagcctgggtccccgactcccccccgacccggcagctcaggcccaagtccctgtcccctccccacatcccctcacagcaggtgcttcagaggggccctggaacgtgaccagtgtgggggaggtgctgcggggactggggaccacacacggcacccggcccagtgccagggggaggcgggtcagggcccaggtctccgaggcccaggctgtgcgtgttggaagccccattgttgatggagtcagatgcccacatcctcatccccgcctggggccccttctccaggagccctgggttcagtcagagcccagccaaggtcccctccctggccagaggcctcactggctcggtcaccctcacctcactgcccccacctcctcacccctgccagcctggccactctgggctgctcctggcctccttcccacaaacacggacccacaggttctctaggccctccaggaccttcgcccactccacggcccctgcccctgtcctgttgacctcccagcgtccatccctgtcctcgggctgcaccctgctggctctcctgttctctgaccatcccccactgtccagtccctcctgggagacctgaggctgtcctgggcttcagcccccagggctggggtcgcagtgcgcagggtcctgggacctcctgctcccgcctctcccatgttgttacccaccccagcccgatgttccgggtcctgtgtggatctgcaggtttcctggaggctcagagtcctgccccggccagcacagacggggaacagggcgagggctgggtggtggcccagtgacctcgggggccaggccttgtaggtgcaggtgggcccgtgctgccgtgccccccacccacagacaggccccgactctggcccagcgcccgctcggccgctcccagctgcaggctgaggtctccccatttgctcctgggccatgtgtgtttgggtgtgagtgtgggtatggatgtgacagtgacttagtgtgtggctgtgagcgtgggtatgtttctgtgtgtttgtgtgtgaatgttgtataatagtcgtggtgtgtgtttgtgagagtgactgtgtgagaggggcttgcagctgagttcctgggcccatcttgctgcctctttctctccctgtgtgttctctgcctctgttgtgttctctctgcatgtctgtctccatgtctctttttccctgttcccatctcctctctttttctcccatctctgtctccgtttcttcttatctctctcatctcatctctctctctttctgtctcttgtaactctgtctctgtcactggcctcgcctctgtccctccctgtccctgtctcttatctctctccatccccatctctctctctgtgtctgtctttgtctctcctttcctgtctctcttgtctctccccatccctgtctctctctctctctatgtctctgtgtctcttgtctctcccctcagatagaccatggttgaccctggctgacctctgcctaaccctggacctggaaagccctagctgaccctgggctggttggggctgggcctacctgtggctgcagcccctcgctcaggccccaggcacacctggccaggtctcggttttggggcatgtttctcagaacagcagttctctggctggaacacctgacctgggctgtgttcacaatgactcagccaccccacagggctattttgggtatttctgcaggtctattcaagaggcttcaggagagagagaaaagcaagagaatacaaacggcatggcctcccctcaccttcctgtccccactcctgtactgtaccccctccccagtgctaagtcgagacctggcgaccccttaggggctggggctgggtgtagctcacagggcctgggctggtcttctcgccaccaagtcctcctggggcctacacacccctctgagcctggaaaaatggagcaagtcattggggtcatttcttcatctaccagtgagtacatgcactgagagggtctcggctcccctggaggcctccctccaccactgcaggtcacttactcatgagggccaaggctcagaaatcagacaggactcagtgtctagtcagactgatacatgctcagaaaaggaatcagatttcaaaatgaatatgcataattaaagaaccagagatcagtgatcaggaacagggatccgcggtctggtccagggctcagtggtcaggaacagggcccagtgatcaggatcagggctcagtaatcaggaccagggcccagtgatcaagaccagggcccagtgatctggtccagggctcagtgatttggtccagggctcagtgatcaggaacaggggtcattgactgggtccagggctcagtaatcaggaccagggctcagtgatcaggaataggggttagtgatcaggaacagggctcagtgatcaggtccagggctcagcaatcgggaacaagggtcagtgatcaggtccaggggccagtgatcaggaccaggggccagtgatctggtccagggctcagtgattaggaacagaggtcagtggtcaggatcagagctcagttaccagaaatagggcccaacgatcaggatcagggctcagtgataaatactagggttcagtgatcaaaaggaggtctgagtgattagaatcagggcccagtgatcaggaccaggactggatgatcagcaccaggactcagaagtcaagagcagagcccattgatcaggaccaggagtcagggaccagaaccaggggccattggtcagaaccagagcccagtgattaggaacaagacccagtgatgagggccagggctcagtgatcaggaccaagattcagggataagaacaggacccagtgatcaggaccaggacccagtgatcaggaccagggctcagtgattgactattgactaggaccagagctcagttattgactgttgactgggacaagggctcagtggtcaggaccagagcatagttagcaggaccagggcccagtgatcagggccagggctcattgatccagaacatggcccagtgatcaggatcaagactcagcgatccagaccaggactgagttaggaccagagcctagtgatccagatcagggctcagtgatcacgaccagggcccactgatgaggactggaattgagtgatcaagtctaggactcagggatcaggaccaagactcagtaatcaggaccagagttcaggggtaaggaccagaacacagcatgaccagggcccagtgatcaggagcaaagccctttgatcagggccagggttcattgatcaggagcagggttcagtgattaggatcagggcccagtgcccagtgcccagtgactagcatcaggatctaataatcaggaccagagctgagtgatcaggaccagggctgagtgatctggaccaggactgagtgatcaggaccagggctgggtgatcaggaccagggctgagtgatgaggactaggatggagtgatcaggaccagggctgtgtgatctggaccaggactgagtgatcaggaccagggctgggtgatcaggaccagggctgagtgatgaggaccagggctgagtgatgaggtccagggctgagtgatgaggaccagggctgagtgaccaggaccagggctgagtgacgaggtccagggctaagtgaggaggtccagggctgagtgatgaggtccagggctgagtgaggaggtccagggctgagtgatgaggtccagggctgagtgatgaggaccagggctgagtgacgaggtccagggctgagtgacgaggtccagggctgagtgacgaggtccagggctgagtgaccaggaccagggctgagtgatgaggtccagggctgagtgaggaggtccagggctgagtgatgaggaccagggctgagtgatgaggtccagggctgagtgatgaggaccagggctgagtgaggaggtccagggctgagtgaggaggtccagggctgagtgaggaggtccagggctcagtgacgaggaccagggctgagtgaccaggaccggggctgagtgatgaggaccagggctgagtgatgaggtccagggccaaaaacaggagtaggactcagtgatcaggactaaggctcagtgatcaaggctagaattaagtgatcaggaacagggaccaagtagtaggaccagagctcagtgatcggtaaacgggcccactggtcaggaccagggccctgtgatcaggatgaggacccagtgaggaggaccagggctgtctaggttatgaggaacagggatcccatgtagttcttaggagcaggcttctttgccatggtctctggtgaatccagcattcatccttgggcctcagcctcattcaagatcaggtcatttcttgattttgggaccaggggtaccctctgtccatgcccaccatgaccaccatgacacccagggggactttgaagcaggcgttctccagtctaaagccaccaccctttccctgacccccgtctcctcattcagagtctgtgaacattttccttggggccactttattgcacctggaaggcatgtgagtaagggcgggtcggtgatgtctgaaagggctgagttctggcaagcatagctggcttctccaagaggttcctccacacttcctccctgcaaagacagaggggtcacagcctgaaggagcagcatccttgccaacgccctctgtctcagccctggcctggctcatgggagcctggacggaatcctcgttactgcactggagggaagctcagccctgaccctgggcctgcgcgtgtcctcagtgtctgtgaagggccccccaggagagcacgtccccccacagtgggagcaggtggtgctctcctcttagccaagcactgcagcccacctcatctactgtgggctcatccccctcctgggctcccacctgtgccttgccggctcctgctcagtactgggggccctccctgttgccagatgggccccggacgctggtcacggtcagtgctgtgctatagaacaggctcagcaggaagagggtgaggaaggtgatggtggtgggccacaggttggcgccgggggtctcctcctccagggtctcctgcggcaagtccagcaccacatagggaggcggcatctgccaatctgcaacacagcaagagcctgccaggcccagactcgtgtgaacagcggctatgcttccttggggtctggggacagtggggtctgggtccccatctaaggcctgagactcccccagggaggatgaggaggcagagtcccaggtgaggggctgggaccttctgtctttgacattcttagggcacttcagggagagacttggcagggcagaaagtggacaccatctgcttctccaagggaagcttgagcccgaggtaccctcccgcccctcccaccccaccccgtctcagtcccagccacgtattcagtgactgggtcccggggccagagaggaccagacacacccaccctcaaggagatctgggtccaagacagagacctgggtctgacactcagtgtgccaaaggttgaatgggcaagaccagaggcctctgttgccttcccagggaatgtggctgaggggttacaagcgagggccaggtgagggccaccagcacgggcatcctcattttcctcagggtctcagggcatagacctcccatgtacagctgtacctgcttgtcatatgctgatacatccagtcattcacctgtctttctatccttccatccatctatccatccatccatctataaagctattatccgtatatccacccctccatcagtaacactcctacccactcacccaaccattcatcctccattcatctattaatgtaaggctatcacttaaatatccacccatatatctataaagctattttccatccattcatccttcttccatctatccatccatccattcacccatccatctataaagctattttccatctcttcattcatccattcataaagcaattctccatccaattatcttccatacacctatcctccatagatctacccacccacccaccccagtatcctcaatcctccgtcagtccacccatcctccattcacccctccatctatcttccatcctccatccacccttccatcctccatccgcctacccatccatccatcatccatccatccatccatccatcatccatcagtccatccacccatccatccatccatcttccatccttcattcatccactcatccatcctccatccacccgtccttcatccatccatcatatatccatctgtccatcctccatccagccatttacccacccatccatcctccgtctaccaatcctccatccacccatccattcattatatgtcctaggatctacccatgtgtctgcctgatctctgtctgctggttcagcccctcatctgttgattctccctctttccccctctctttaaaagcccctcccctgggccaggtcctgggtcccatgggctggagggcttctctgtggcagggcttccccgagtgacctgttgctctcaattaccctctggtgactggaccctcaggggtgacagtggcctccacctcaccttggccctgagagcagagggaggcagccagaaggcggggggccctggggaggcccggaagatgtctaaggcacgagcaggggccccactgcccccttgtgggagtctgggtgccaggtgtccccacagtggttgtgggactgttcttacactcctgggagccccaggcagaagccagaggcatgcagagggccctgggcaggccctgtctcactggcctgcttctgatgccaccccacgtggcccctccctgtctatgctttgggtcctagttgggcttaggaagggatgggagacttggccaggcagggagcaggggctgcctgggaggggtctgtggagttggtgcctgatctgtgcacagtggaaacacagggaagccagaggggcctaggggagcaggctgagcttgggggcttgggaggggactcccctggcttttctggaactgggtctgggctgtgaacgttccgctcctgcagggctcaggcgtatatgtgagtgtgagtgtgcacctgtgcccacgtgccccgtacagagcagtgtggttaaggggaggtgccccttcctgcatgcgtcagtgggacgtcctgaggcccacccactagggtggtggggccctcctggagcttgtcctcccagtggggccctggagtccagcccctcactccctcgccgctcctgccactacctgcgcctttcttggctagcctgctccttttaccctccctattccctcccagctacagccagaggcggctctctcagggacaaacggccatgccactgctcactcagaactgtccggggcatgtgcatctctcagaacccatcctgggctgtgcctgccttggcagacctaagatctcacaccagcgaggcctcctgcaccacacactctcacactcacaactcacactcacaccagggtggaaaggctcaggggggtgccaggggccccccgaggctgagggcagggggtattcttccctgtccatgccctggccctttcccaagtgctgagaccctgaggatggacagacaggcgccggatggaagcgtggggctgcttgggggagcatggagtttattcaggggtggggacaggcgggcggctcagtagcaggtgccgtccacctccgccatgacaacagacacattgacatgggtgggtttacccgccaagcggtcgatggtcttctgtgtgaaggccagcggcagggcctcgtggcccaccatgcaggagaaggtgtcccccttcttccagtcctcggctgccacgcgcagtatgctggtcacagcgaaggtggtggtgccctggctgggctcctgccgggatgcccaagtcaggtacttctcgcggggcagctcctgtgacccctgcagccagcgaaccagcacatccttggggctgaagccgcgtgccaggcacgtcagcgtcaccagctcgttcagggccagctcctccgacggcggcggcagcaggtggacctcgggccggaatgtgtttcctggagggtagagagccaggtcagggggctgggcaggggatgagagagcccctctgctctggtgggcaccctgggctgtgtcctggcccctcagcctgcctcagtttccctctgtacttggcatgagcactggagcccaggattgggagggaggaggcaggccaggaatatgctttgcaaaccagagcactgagcagggccccgagcagggtctggacccaccggattttgagagggtggcggttagcggggtcttggactcggggtaggcagcagtgcaagtgaaggtcttcccatggttccatggctcggcacagcccggcaggacactggacacgctgtagcagccacagaggtcacgctcaggtggtccttgaacagcgctcttcccacttgagggcgtccaggtgaaggtgacacctgaggcatctctcaggccggtcagtgtgcacgtgaggttcgcttctgaacctaagagcaggtcctcgagggccggtcggtgcagtgacagtcgggggtggcagcatgagggagatggggtaggtggagttgagggagatggggtaggtggagttgagggaactggagtggagagatggcctgagctggtcagcacatacttccccatgcccccgcctcgcccctcctggcctgtccaccaccacctcctggggctcggcccgcggtccactctggtgtgagtgaaggggcggctccctgtggggaacacgggtgcaggcgcagtgtcagggcacgacggggtggccccgccccactccccagcctgccctctgacctgggcagggcacagtcacatcctggctgggattcgtgtagtgcttcacgtggcatgtcacggacttgccggctaggcactgtgtggccggcagggtcagctggctgctcgtggtgtacaggtccccggaggcatcctggctgggtgggaagtttctggcggtcacgccctgtccgctttcgctccaggtcacactgagtggctcctgggggaagaagccctggaccaggcaggcgatgaccacgttcccatctggctgggtgctgcagaggctcagcgggaagaccttggggctggtcggggatgctggaacacagaatgcactgtgaggacgcggccctctcctctatactgcctctcctctatactggaggaacccagcacagagaggcctggtgacagccccatggtcacacagctcctgcaccacaggcctgcagttggaccctgctgtctgatcccagcaacatggtttctgaacatgctccttagatagggtctctgattcaggccatcccagacacaagttgtattaaacagggctctgccatggagtggctgagtcccctgagctccctgaccgcagcccctgctctgggtgggggacatgtcttgctctatcccctgcccctagagaggattttggtgggggctcttaggagagggtctgggctctgagtgctgtgtgcatggggtaggggtggagtggcttggctgtgaccccatccccctgtccctggtcagagtctcagtccaacacccaccactccatgagccccaccccaggcccaaacaagccacagtggacccctgtggcctatgaggtctcgggactagaggccaacaggctaagccatgtccctgccaggccctccaggacagggcctgctatacaggggagctctgggcccagcccactccaaatttccttcaggcagtgggcaagagagaagacagaatcatggtgcaacagagctgcgtggccctcagaacccctaagaacacagctgggctcagggctctgcaggtggaatcacactcaacccacggcctctttcccacattagcagccacctcagcccatcccgcccagcccagcccaggccagtccagctcagtccagcccagcccagctcagcccaggccagtccagctcagtcccgcccagtccagcccaagtcatcctagcccatcccatcccagcccaggtcagcccagcttagtccagctcagcccaggtcaacccagcccaggccagctcagtacagctcagcccagcccaggccagcttagtacagctcagcccagcccagctcagcctggcccaggccagctcagtacagctcagctcagctcagcccagcccagcccagcccagcccagtccagcccagtccagcccagttcagctcagcccaacccagctcagctccgcccagcctagcttagcctagcccagctcaacacagctcagtccatgtcaaccaaacccagctcagctcagcctagctcagcccagctcagcccaccccagctcagcctagctcagcccaccccagctcagcccagctcagcccagtctagctcagttcggcccagcccagtccagctcagctcagcccagcccagctcagtccacctaagctcacccagctcagctcagtctagctcagctcagtccagctcagcccagcctagtccagcccagcccagcacaggtcagcccagcttagcttagcccaggtcagtccagctcagctcagtccacttaagctcacccaggtcagctccgtccagctcagcccagcctagcccagcttagcccagcccagcccaacacaggtcagcccagctcagcctagcccagcccagctcagcacaggtcagaccagctcagtacagctcaggtcagcccagaccagtccaacccagcccagcgcagtccaacccagcccagctcagctcatccaagcctagctcagctcagcccagcccaggtcagcctagcccagccgaacccagctcagcccaggtcaacccaattcagctcagctcagcccaggtcaacccaaccaagctcagctcagcctagcccagtccagctcagcccagctcagctcagcccagtccagctcaatccacctaagctcacccagctcagcccagtctggctcagcttaggtcagcccagcccagcctagcccagatcagtccagcttagcccagcccaggtcagcccagcccaggtcagcccagctcagctcagcccagcccagctcagcccagcccagcccagcccagctcagcgcagcccagcctagctcaccccagccaggtccagcttagcccagctcagcccagcccaactcagctcagcccagctcagcccaactcagctcagcccagctcagcccaactcagcccagcccagttcagcccaacccagcccagcccagtccagcttagcccagctcagcccagcccagcccagcccagtctagctcagcccaacccagcccagcccagctcaccccagcccagctcagctcagctcagctcaacccagggcagcccagctcgtccaagcccagcccagcccagcccagcctagcccagcccagctcaggccagcccagctcagctcagctcagctcagctcaacccaggccagcccagctcgtcccagcccagcccagcccagcccgtcccagcccagcccagcccagcccagcccagcccatcccatcccggcccagcccggcccagcccaacccggcccagcccagcccagcctagctcaccccagcctggtctagctcaacccagctcagctcagcccaccctagctcagctcagcccagcccagctcatcccagcccagcccagcccagctcgtcccagcccagcccagcccagcttgtcccagcccagcccagcacagctcagcccagcccagcccagcccagcacagctcagcccagcccagcccagcccagcccagcctggcctagctcacccgagcctggtctagctcagcccagctcagctcagcccagctcagacccgctcagcccggcccggcccggctcggcccggcccagtccggcccggcccggcccaatccggcccggcccagctcagcccggcccagtccagctcagcccagctcagctcagcccagtctagctcagcccaacccagcccagcccagcccagcccagcccagcccagcccagctcatcccagcccagcccagctcagctcagctcagcccagcccagctcagcccagctcagcccagcccagcccagctcatcccagcccagtccagctcatcccagcccagtccagcccagctcagctcagcccagcccagctcagctcagcccagcccagctcagcacagcacagcccagtccagcttagcccagctcagcccagcacagctcagcccagtccagcttagcccagctcagcccagcccagcccagcccagctcagccaagtctagctcagcccagcccagtccagctcagcccagcccagtccagcttagcccagcccagctcagcccagctcagcccagcccagcccagcccagcccagctcagcccagctcagctcagctcagctcaacccagcccagcccagctcgtccaagcccagcccagcccagctcagcccagcccagtccagctcagcccagactagctcagcccagcctagctcagcccagctcagcccagcccagtccagctcagcccagcccagtccagctcagcccagcccagtccagctcagcccagactagctcagcccagcccagctcagcccagcctagctcagcccagctcagcccagaccagttcagctcagcccagttcagcctagccttgctcagcccagcccagcccagggcagctcagggcagcccacatggacgtgtatcagctggctccacgtcatcttctttgccctctggctcggctcagcctaggcctcagctcagccatgaaacctgttcaccttgtatcccaggaagggccgggtcatccctggttaggcctggccagcctggctcagcccccagtgcccagatccttcctgcctggttaggaagccctgccctgtggttccggagtccctgtggtgacctcttttgtccttccctcttgtcttggtgcctgttctccaccttttgcttccagaaggggccaggaccagcctggctggactcctcaatgtgcagaggaggagacggaggcctggagacctccaagacccacctggtcaggctgctggagggcccgcagtgctgagtgggcggcctccggcgtgcaggccctcatggcaggtccaccctcacgggcgtctggctgcctgccaagagggctgctgtggggagggagccctggcccggcccaggccctgccttgatggccgtctgtccttagcagagccctgctctgcctcgctggctgtgtccacagatgtggctggatgctgaggggctggaggggagggcctgcatgcccgtacgtctggcctacagacagggtcactcgcccacttcctgccccagcagacacggccgcgcggctccacgtcatgtctggcctgtggtctggctgtggtggggccaggtgtgtgtggccagggctctgtgaccccaccggccgtggagcctcatggctccacatggctccacagggcggggtgggggccacgatgcagggaaacaggaacagacacagttagaggctcagagaccccgagacagagatggcaaaggggagacacagggccagagagggtccccgaccacccgcaggggaagggtgcctgtgagtggactcccgttgagggggccttggggccacagggcgggcatcaggctggggagagtgagtcttgcgctgctgggttggagccactccggcctggcctccctcggtctgccccatgggccgctgggggccccagactgcagcccagggtgggggcatgggggcaccccgtctcctagcctgcagccctgcgggtcagggtggccaaggtgcctgctctaccctgtccagcgctgcccaggtggcactcctactgtgggtcaccagagagctggccgttgcgttggagagatcccgccagcgatgctggccctggagtcgggggaggccagctatgtctgggggctcgggtggcaccggcaatgggaggccagaggcgcttcacagaggagctgctgcagcggagtcctggaaagcgtgggcgtgaatggaagatgccctggccatggggccgggccaccccggcggaggctgtcgggtgaaatccagggagtgacagtgaggccggatcagggcaggtggggtcagaggaggagggaggtagcctggggctgccccagggtcctgggaagacacacctggcggttcagggaagctctggagcttttgttatgaaccttgggatgcccccggccctcgccagggggacgtggctgctgcatcttagtcatttctggctgcaataacaaaaataccatagactggtgggttcagcagcaacattcatttctcacggttctcgaagctggaagttcaaggtcaggatggcagcagggtcaagttccaggaagggtcgattcctggttcacagacccccatcttttcactgcgtcctcacgtggtggaaagagggcagggctgctctctggggtcccttttctttagggtctctagtgagattagggaccgaatcacatttttgagggttccccctcaggccctaaccacctccctgaggccccagctctgcatgctctcactctgggatgacggctgtcacacaggagtttcgggcagacacagaccctcagaccatagcaccacccctgtctgcctctgcctctccccatccctgtgtctcctcgtctgtctccagctaggacacttgtccttggacctagccccctcgataatccagggtgtccttcaccttgaaatccttgacaatccagggcgccctcaccttgaaatccttgacaatccagggtgccctcacctcgaaatccttgacaatccagggttccctcacctcgaaatccttgacaatccagggtgccctcacctcgaaatccttgacaatccagggtgccctcacctcgaaatccttgacaatccagggttccctcacctcgaaatccttgacaatccagggttccctcacctcgaaatccttgacaatccagggtgccctcacctcgaaatccttgacaatccagggtgccctcacctcgaaatccttgacaatccagggttccctcatctcgaaatccttgacaatccaggtttccctcacctcgaaatccttgacaatccaggtttccctcacctcgaaatccttgacaatccagggtgccctcacctcgaaatccttgacaatccagggttccttcacctcgaaatccttgacaatccagggttccctcacctcgaaatccttgacaatccagggtgccctcacctcgaaatccttgacaatccagggtgccctcacctcgaaatccttgacaatccagggttccctcatctcgaaatccttgacaatccaggtttccctcacctcgaaatccttgacaatccaggtttccctcacctcgaaatccttgacaatccagggtgccctcacctcgaaatccttgacaatccagggttccttcacctcgaaatccttgacaatccagggttccttcacctcgaaatccttgacaatccagggtgccctcacctcgaaatccttgacaatccagggttccttcacctcgaaatccttgacaatccagggcgccctcacctcgaaatccttgacaatccagggttccttcacctcgaaatccttgacaatccagggtgccctcacctcgaaatccttgacaatccagggttccctcatctcgaaatccttgacaatccagggttccctcacctcgaaatccttgacaatccaggtttccctcacctcgaaatccttgacaatccagggtgccctcaccttgaaatccttgacaatccagggttccttcacctcgaaatccttgacaatccagggttccttcacctcgaaatccttgacaatccagggtgccctcacctcgaaatccttgacaatccagggttccttcacctcgaaatccttgacaatccagggcgccctcacctcgaaatccttgacaatccagggttccttcacctcgaaatccttgacaatccagggttccttcacctcgaaatccttgacaatccagggtgccctcacctcgaaatccttatcttgatgggatctgcaaaggcccttttgacaaataacgccgcactcaatggccccaggggctaggatgtggctctatcttttgggggccatggttgtacccacgggtgggttaataggggaatgaagagggggatggagaggccctgagacggcatcctcttgctcccgggaggccaggccatgtggaaggcaggggcgctgttccgagcctgggtgtgaatccgggcctctgcccctccccacgggccccgtctgtctcctctacgtgggtgctcatctggtcttcctctcaggcctttgaggcgatggaattttctgtgcgtgaggacgcctgccacacagtggggcagtgagctgactccttgcccttgctctggggccatggaggtctcatgatctagggtgcggggcagagaaagtcactgagctctgtcccccgggggggctcccggtccggggcaccttggctgcggagggccggtctgttgtaggagatgtgggtttgcgacaccctgggctggtgatggggtggatggagggcctggcttcctgagactgtgtgtgtgttggtatgagcgtgcccgagcgtgtcagcctgtgtgagtgcatgattggtgtgtgtgagtgcaaatgtgtatgagaggttgagtctgtgtgtgtgaacctgtgtgtttttgcatgtgcgagtgtgtgcccgcgtgtgtgtctgtgaatgagggagtgtgtgaggggagctgggcagcggctgtggccttggccctgtcctgcgacgccccctcctctgatgttgtttggacccagtcagcctcagcgctgcccgctttggggttttctaccccgtagggagccgtcgctcctcaccttctcccccgtgcccggctgctccgaggtcgcagcagaggacagggcggagggcccaggtgccgctgtcagactgaggcaggcttgcttcattccgctttgtgccagactccatgtgacgtggctctcctggcacagagcgaggctctccctgtggggccatcactgtgagaggactctcctgcattggggcattttgccaactggccctaaaaagtggtcttaatgatttacgtgccctcagtcagggccaagaagcacctccacccccttcatcccctcctccttcctttcacttttctcattgttaaaatggtttctttatattatcggccactgggtttttcctttccatgaagaacctattgctcacctttcttcttagtgatctctgagtgctctttgtatatgagggaaccctgccctttgtcatgcctatcatgcgttctctcccatttttaggatgttgtggagacccttgtaagcaggcctctccagccagggaggctgcacatttgccctgaggactggtgtgggtcaagcccacctgtggccccgatggctctggggccccagcctgctcctgggtcacctctcagctcttcaggaggtccaggctggtgggcggctgtgggctggggagtcagctttgtctgtgctcagtgggtgctggatcagggtgtgtggccagtggtcctgggggcccccaccagcctccaccttggtgactgtgcagctgcattcttggggcctcctgtgctgaccacagcatgggcctcttctggttttgcccacaaaggggtcgatgttgattgttgctttgactttacctgagaaggaggcatgagtctgggctggagaccagcagaccaggtatgacagcgctgagctggggagtctctggggtgctgaggggtgattgatgggaaccactgcttgggcactttggctctcaggaccccagaatggcccctgcccttccttcccctctggctcctcctgcacgtcctcaggggtcctgcctcccaccagccactccagggccacacacacctcctacagagccctccggagacgtggggtttgtgaaaaggatctttactaagaaactcagagagaaagaagtatgactgctgaagccagacactggacgaggtcatagggacgaggtcggcagctgctgtccctgcaggaaaccccttctctggctgtgggagcccctctacccactccaggggcccgaagccctcaaccgtcctgtggcctggcctcagagggcttccctgtgccttcaggctgcagaaatgggggctgaggatagatggcaggaggggtgggtgaagggatgggggctgaggatagatggcaggaggggtgggtgaagggatgggggctgaggatagatggcaggaggggtgggtgaagggatgggggctgaggtggatggcaggaggggtgggtgaagggatgggggctgtggatagatggcaggaggggtgggtgaagggatgggggctgaggatagatggcaggaggggtgggtgaagggatgggggctgaggatagatggcaggaggggtgggtgaagggatgggggctgaggatagatggcaggaggggtgggtgaagggatgggggctgaggtggatggcaggaggggtgggtgaagggatgggggctttggatgggtggcaggaggggtgggtgaagggatgggggctgaggatagatggcaggaggggtgggtgaagggatgggggctgtggatggatggcaggaggggtgggtgaagggatgggggctgaggatagatggcaggaggggtgggtgaagggatgggggctgtggatggatggcaggaggggtgggtgaagggatgggggctgaggatagatggcaggaggggtgggtgaagggatgggggctgtggatggatggcaggaggggtgggtgaagggatgggggctgaggatagatggcaggaggggtgggtgaagggatgggggctgtggatggatggcaggaggggtgggtgaagggatgggggctgaggatagatggcaggaggggtgggtgaagggatgggggctgtggatggatggcaggaggggtgggtgaagggatgggggctgaggatagatggcaggaggggtgggtgaagggatgggggctgtggatggatggcaggaggggtgggtgaagggatgggggctgaggatagatggcaggaggggtgggtgaagggatgggggctgtggatggatggcaggaggggtgggtgaagggatgggggctgaggatagatggcaggaggggtgggtgaagggatgggggctgtggatgggtggcaggaggggtgggtgaagggaaagaaggtctgggtgaggcttgggggacggggatgccaggcacttggatctcagggctagaagggtcagaccgaggctggggagtgaggccgtgggctggtgttgggctggacgcagactcagctgtgtcctgggctgggtgctgggccctccttggcttttggtgattgtacagtcagaatgggagtgacccggagacccaggggcctgggatgagctcagaacggctagcagccacccctcctcgatgactctgttgaagggacagacacggttttcgggtgggggctgcgactggtggttctctcggcgcctttaaccttgcggctgagccggccccctctgggctcaggttcactggccatcagcccacagtagtgaccttgtgcccccttttcttgtctgcttcccttttcccacccagggcagggcgcagcccgagggaggctcaggcgctggcagagaaaaagctgggcctggtggagcgtgagtggcccgcggcctaggcgtggggctggaggacgttggtgtagtcgagggaggtctggggcctcccctgccgcgtggctgagaggaaccgctgcacctgaggggagggcgtgggtcagggcgctctgctggctctgcccaaccccctgccctggccgggcccctggaggtgggtgcccaccatgaggagcgtgatggcggcgctgtagctcacgctgagcaggaagagtgcggcgaagatgcagaggccggtccacgtccacggcgcctcgccctcggcctcctccacgcacacgtccagctctgggggacctggccagtcagccctcccggctccacagtggcagcgggggtgggggacagagccccctgctgctctcggcagtccctgctgctgtccggagtggcagagcaccctatccggggccctctgggactgcgcggagccgccagccagccctgagggtgggcacccaggtcccgagtcagtcaacggcccagagccaggccgaccactcctgacctctcgtccctgggcccccactctggccccattttccctctgttccttacggcttctctcctgacctctggttacctccactccgcctctctagaccccacgccctccccagagaaggacccaacccctcggcacaggagtggccgcctcactcagggccctcggaaggatgcgtgagctctgcggcctggctcccaagacctgggactcactgcatgggtgctctgaggggctgtcctggtgtggactatgagcccaggcctgtgggtgtccagagctgcctcctggccctaccccggcccggccccgcccaccagcctggtccctctggctcctgccctgagtcccctccactcccttccccaacaccgtgagctgcctgctggtcccgggtcatcagcaggtgcaggtccggcctcgggccctcacacctctttctgctgctccaggcccagagctgggtgcaggtgggctgggacgtgagagtgaagctgaatgtatggctgtgacggtgtgcagggactgtcttcagacatggaggggctttgtgctcatggggtgcccggtgcccgtgtttccgtgtggatttggtgggtgctgtgcccttggtgtgcatgaccggggggagcgtttggatctggggtgtcagatgcacatgtgggtttgaggtctgtgaggggcacgtagcctgctctggggttccggtgtgggtgagtgggggatggagcccacgcatccatcctgtgtttggctgtggggtgctgctgacagggtgacagggagggttggactggaggacaccacgtgagggcctctccatttctctctgggatccagcggcccaggtatggctcagaggaagggcttggcagtagcctcgctggaggcagggtgggaggcggagtgtgggccacgtgtgaccacgtgtggggtgtctatggcgccctggtggtggtacagggtgctgtggagttgctatggggcctagtgtgtgcacagctgtgccttgagtgaggcgtgagtgggcgagactgggtgtgtgaggctggcgatcccctggaggccgattcaggatggaccaaggggcggtggggggcagtaggagagggggcctggctgctgacctgggcctggtgtgcccacagggcggggtggcggaggctgcggggtgtgagtgggctcggctccactggccccggtgctggggccaggactcggcaaggtgggacagggcagagaggcgaacgccagtggcacagacttgggcgagggctgtcgggtcgtgtgtgtctgtgtgggggtttcacttagggctgtttttctacctggaggggcctgtgtgcccatctatacctgggggtgcaggggctcctgtccaggggggtagaagccaagcccccaagagagagggctgtcggggctcccttgccccttccctgaggacctcccctgggtctttggactccttggagggggtagaccgagagtgggggcagagagggcccggggtagctgtgatgagtccctgcagatacgctgtttgacaaataaccctgacacgaaggcagatggatgagtggcacctcagccctgcccacctcctcccaccacctctcctggggggactcagccctgcccacctcctcccactgcccctcctggggggcccattcctctgtgccaagatgcacctgcccacagccctgcccgctcccaagaacgggtgtaccctgggctctgagcaggcactgtttattgggggtagcttcctggggtcgttgcaacagtggacagaaggtctggccagccctccccactgcacagctggacggagccctgggagggagggaggcaggagtacgtcatttaccgggatttacagacaccgctcgctggacggtctgtgaggggctcgctgcctcatggactgcacggcagatgaactcatctttctgctcccactcggccctggtcacctccaggcggctgaagatgaagaagccggagcccttggtcttgcggggctgcgtcgtgctgtgccgggcgtccgggagctgcacctcgttgtgcagccactgcaccgagatgtcctcaggcatgaagttctggatcaggcaggtgagggtgcgcttgtcccggctccccagccactccggcgtcgcaaacgcatagacttccggggcagcacgcgggcctgtggccagacgtggggtcagcccaggccccgctcactcgctccctccctccccccacgaccccggcctgcccgtggctcaccgctggtcttggtcgtggaccgcacgagggccctgggcaggtgggggtgggtcaccctgcactggtaggtctccccttcgatccagtctcgggtgcccaccggcagggtggacgtgacggttaacgtgccattgcgctgcttctcctcctttctggtggagtggttcacaggcttcccactggcccgggaccaggtcaggttcacggtccacttgctgggtgccaggtccaccaccagacaggtgatcgtgggcgacttgcggatgaacaggtcgaacgggctgggccggcttaggtaggcgctcacccctctcgggttgaacccagtgtagtgtcagctgaacccagtgtagtctagccgagcccagctcagctgaacccagttgagaccaacccagctgagtccactcaggcgagcctagtttagcccagttcacgtgggcacagttcagcccagcccagctcatcccagctaaattcagatcaccccagcccaatttagttcaataatttaaggcctgctcactccagcttttaaccctgtccgtcgtcaggtctctcccccagcctagccctcctcagctcaatcccatttagctcagcccagcttactcagcccaaccagctaagcttggctcaggtctgtccagctcagcgcagccctgctgaactcaggccaggtcaggtaagctcagcaggtaataccccagcttggtctccttcagcccggatagtccacgagcacccattttatcctaagtagagaactgtagcttgtccctactcctgtgtcggcccagcttatttcaaccaagtccagtcaagtccaggtcagcctaattcagcttaactcaatcctggaccacccagggcaggccacctcagctcagcctgactttgccctgctccccagataagtccagctcagcccagctcagtccaccttagggcttaggataacccagctcaagcctagctcagctgagcctagctcatttccctctacccagtccactcactcaactcagctaaacccgcctggcccgggccagccccgatcgccctggctcaggacagcccagcttggccacctgtcctctaagggacagggtagccctctcagcccacccagctcgcctcagctcagtctgttaggcccgtctcagtctagtccactcagccaagcccccctcagtccacccagctcggacttgccaagatcagccagttgcgcagtggagctcaggacagctccctgctgccgcctccccaccctccctcccggctctgggttggctgtccctgtcctgggggtgacaggcagtctgcacccagcctagccctgcccagcatggggcctctgaccttcttagtcttgggcccagccaagattcccagccccctgccttctccaggtcggcgttaggctgtttctagctttcctgtgtccccatgcagggaagggacgtctggagtccatgcagtaactaagaagcttggttgatgctgtgagggtggcccaggagtcccctcgctgtcagggacccaggcagcctctccctcactgctgcctgggccggccccttgattggggctcccggtgggctgggatacctgaagcgccgggtcgtccatttggtgcctgtggctggtgtggcccgtccggctccctgtcgggttcctggacagctcccagatgatcagtaaccgtggttgttatttctgtgtcgggcagtggagcctgggtggggggagctctgcctcagtgctttcagctaaaaatggagtgggaacccctggaggcccgggccaccctggaagttcccttttctctctgttcttgggaattcgattgagcaacagcgggggctcaggtgaggctccttcactaccgatgcacaccgagtgctgggggaggttctcttctctctcaggccccagtgttggaggtgggcctggtgggaggtgattagatcatggggctggacccctcatgaatggcctagcaccatctcccaggtgatgagtgagttctccctcagttagtccctgtgacagctcgttgtttacaattctgggacgtgccacttcttttctcttgctccctcttgccatgtgacatgcctgctcccccttcgccttctgccatgattgcaatctccctgaggcctcaccagaagcagatgccagggccgtgtttcccttctgctcttctgctctcccccgcccttcccttcttcttgtcttttcaagacaagttctcactatgttgcccaggctggtctcaaacttctgagctcaagtgatcctcctgcttctgcctcccaaaatgctaggatgacaggtatgagccacagtgcctggcctaaacaccttttctttataaattactagcctcatgtatttttttttctagtaacacaaactaacacagaacattggtattgaggagtggaacattgctataaagatacctgaaaatgtggaagcagctttggaattaggtaacaggcagagaggttagaagaatttggaggactcagaagaagacaggaagatgagggaaagtttggaatttcttagagactattaaatggttgtcaccaaaatgctgatagacatatgcactgtgaaagccaggctgatgaaatctcagatggaaatgaggaacttattgggaactggagtaaaggtcacgcttgttaaatcctaagatacaacttggctgcattgtgttcatgccctagggatctgtggaagtttgaccttaagagtgatgacttagggcatctggggaagacatttctaagcagacgtttctaaggtgtgacctggttgcttctaacagtctagggtaagatatgggagcaaagaaatgacttaaagttggaacttatatttaaaagttgcaaatgaaaaaataaaatgctaatccaaggggattccaaagaaacctggaaaaccagttcaggccatgacaggaaggggagggtggtttggactccctcactataccctctccctgttggagcttaggctcagctgaccagtgttaacattaaaacagggagcttaagactgacaaagcagactctttgtagcaataaggtatcaaatcccaacctgactctggtatagcatcacatgacaggtggcaggcatggaaggaaattaaagtattttatcccagaatatgtttctctgacacattttggaagggccctgcaaagccgtctcttgtggaggaaatgtatattctgttgagaatctttttccctttccaggtctcttcctgattcaggagagatttatccaagagtctggcaccttttaggttctgataagagacattgaccatctcttctctctggaacgtggaggcttcgtctacataacaagaaccttggcttccacaacccccttatcttaagcattgcttttcgctgacttcaactttttagataatttaactttttcagccaatcgccaatcagaaaatcttcaaatccacctatgatttggaattccccactttgaattgtcctgcttttccaaaccaaaccaaaccaatgtatactttacatgtattgattgatgtctcatgtctccctaaaacataaaaccaggccgcaacccaagcaccttgcacacatgttctcaggaccttttgaggctgtgccacagttcatggctctcatatttggctcagaatcaatttttcaagtgttttatggagtttggcttttttcatcaacaaagggaagcagagcattaaaaatgtggaaaattcacagcctggccatatggtagaaaagaaaaggtattttcaggagacaaatataagtaggctatggagcagccagttgctagagagattagcataactaaaagagagctaagtgctcatatccagaacaaagggaagaaggccttgaaggcattttggaaatctctgaggtggtctttcccatcacaggcccagaggccaagagggaaaggatggttttgtgggccatggccatggccactgctgcctgtgcagccttgggacactgctctccacatcctggttcctctggctccagccttggctcaaagggccccaagtatagcttaggctgcttctttggagagtgcaagccactataagccttggtgacttccatctggtgttaagcctgtaggcccccagaatacaggagtgaaggaagcttggcatcttccctctagatttcagaaatgtatgagaaagcctaggtgcccagacagaagcctcctgccagcatggagccctcacagagaacctctactagagcagtgccaaagagaatgtggggttgaacccccatataatgtccccaccagggcactgcctagtggagctgtgggaagggggccactgtcctccagaccccagaatggtggatccactggcagtttgcaccctgaatctggaaaagccacaggcactcaactctatcatgtgagagaagccacaggggcaacatcctccaaagccacaagggtagagttttccaaggccttgggagcccaccccctgcaccaatgtgccctggatatgggacatgaagtcaaaggagattaccttggagctttaagatttaatgactgccctgctggatttctgacatatatggggcatgtagatcctttctttttgccaacttctcccttgtggaatgggaatgtttacccaatgtctgcactctcattgtattttgggagtcaataatttgtctttgatttcataggctgataggtggaagggagtcatcttcagatgagacttgggacttgggaaatttgggttgattctggaatgaggtaagactttgggggactgttgagaaggcatgattgtattttgcaacatgagatttgggggaccaggggtggaaggatatggtttatatatttctcccctccaaatctcatgttgtaatatgattcccagtgttggaagtggggcctggtaggaggtgattagatcaagggggaagatccctcatgaatgatttagaatcatccccttggtgatgagtgaattctcccccagtcagctcacacacagtctagttgtttaagtctggggccccccctcagcctcttgctcccattcttgccatgtggcatacctgctctcccttcaccttctgctatgactgtaagtttcctgaggtcctcgccagaagcagatgctggtgccatacttcctatacagcctgcagaactgtgagccaattgaacctctttccttcataagttactcagcctcaggtatttctttacagtaatgcaaatggacaaacacaggtggctcctgacacacccctcatcttctcctttgtcatcatatggcttacctccatgtgtgtctgtgtcctctcctcttatgaggacaccagtgtttggacttgggatccatccaaaatttagtatgatatcatctcaagtccttaacctaatttgtaaagaccccatttccaaataaggtcacattctgaggttccaggtgggcatacatttggccagggagatgccatcagcccaccacaccagcctacgcaggtacatttgcatatagcttagggttgacgtttctcatggaagtattacatccccctctggactccagttttgcatgttttagaatgcttcgccttctccagcaggatgaatctcttttcattttttagtatttttctctttcttctttggattggattaaaaagaattgatatactctattgatgcatctttaagttttctgttccttcttatgtcttgtccaatctgttattaaacttgggtaatgtttttctctttcttttcttttttaataaaatagagatggggtttcaccatgttgcccaggctggtctccaactcctgaggtcaagtgatccttccttgttggccttccaaagtgctaggattacaggtatgagccactgggcctggtcaaatgatgtttttcatttccgaatcatacttttagttctagaattttcattcgcttcttgtaactattttcagttttttatagagatacctcatctagtcactcatgataaccatattttcctttaagtctttgaacatatttaacataacttctttaaagtccttgtctgataactgtatctgcatctaggtcatcttggagttgatctccattgatccctttttcttttgactttggatcacattttcatgtttctttgcatacatagtaattttggatgtgtgcctgatgttgttgataacatgtggtacaggctatggggtttgcattctttcttagcagagcattaattgtttttttcaatgttagcaagcagttagcttgagttgactcaaactcccaagtctgcctgcctggcagttggcagtagctggaatctcagttctcttgaccttacaggtgttgctttctgctggaccctttggagttttccctacccatgcacacctaaggaatcggccagaggtttcactggagtttacttgcagattgtggggtttcccttcggtgaccttctcctttacggatatcttctcttcatttccagctgctctgaaaatgcagccctgcatcccactcctcaccaggagggctgcagtttcctgcttaaactctagctgcacccattacctgcactggggtgtgacttcagacgaatatttcacggaataatccttactagtgtttgcctacttctggtcatgtcccagtgcctgcaattggtgtgtgtgggtgttgtgtgtgcttacagcatttccagtgtttataattgccttctgccaaagggctggtctgatattagctgctccagcattattggaatcagaactactttctctcacgtggtttttcattttcatttccctgttgactagtgtggttcaacatgttttcatatgtttagtggctatttggatatcttctgtaaaacatctgttcaattctcttgcctattcctcattagattatttgatttttttttctcattggtttacaggggtcttctttatattatggatctgtttgtgtcagtcagttatatatgtttataggaaacattgagaaaaactgaaatggaccaaatgattacttggtgccttccatggaaagcaaggcatcgtcttgtagactcttccaagttattttattctatggagctctgcatcttttatttcctttgaactattttacacctctataagccaggggtccccaacccctgggtcatgcactggaaccagttcatggcctgttaggaactgggacacagagcaggaggtgaggggtgtgtgagcattcctgccggagctccacctcccgtcaggtcagtggcagcattagattctcataggagcgaaccctattgcgagctgcacattcccgggatctaagttgcatgctccttatgacaccctaatgcctaatgatctgaggtggaacagctttgtccccaaaccatcccccgatcctggtctgtggaaacattgtcttccatggaactggttcctggtgccaaaaatgttggggaccacggctctaagttgtacataattgatagcaatgcaaaaactctttgagttggtagaaatccaagttctcatctttgaaaggacaatgaattgctcctcctctgccagggaaaaggccagttttgcatctatctatgaactccttttagtattcctgaatcaattatgtaagtgtagtacttagaattccactttgaactggttgcaacaccttaattaatgagataaagagcatctctgaaatgtgtcgtcatatgtttatgtgagtcctgatcataatacttttaaaaaatgatctcttaactcgtgatttcttctccctcatggccccacccagccgcagtatccagggagcttagttttctgtggcccgggagggcaggagaaccggtgttgatggggagatctgaggttggccccaacttttccccacagctctgcttcaaggagtgccgtgggaaggcctcccaaccccacacctgtcctgttggccaaggcgagctccatgccatgtggcatctctgccgctggccacctggtgagtatctgttgaatagagaaatgtgcagcatctccacagagcctccagggcttctgtgctctccaaacatctctgggctcctggcaccctctcagggtatgatgtgttggtgtctgggttgggcccctgtccctgagggtaggactcaggcaaggacaaagctctggactcaaagaggtggtgtgggggtgagtgaaaagaacaggagctttgaggtcagaaatgcgggtttcagcctgcattgtccccatgagcaggggctgcagactcgccaagacctcagtttctaccatggtgagagagtgtcagagactgcagcacgtatttcaagtgtccagggacagcaggggtctgggttggaccagctctcctgaatactgagggtgcgatcttgaccattgtgaaaggaaaataaaatctcaggactccaaactcactatgccaaaatgaaccgttgaggtgggaagctgagtcatgaaaaaaaaaaaaagtcatgcgtttccttttgtttccaaactgatagcagcagcagataggccaggtctacccaggtggcctccctcaccctgagaatataaattaacagctggtcttcatgacatgggacaaaatgagacaagaaatcgtccctcctacccctgagacgaatgcatatttgacttcttcctctactctgtttatttgcttataaagtgtagatttagtgagcacaaggcgaatgcgtaattgctccctccacccctccttttcatgcaacgtggggggctcagtgagatgtaatcaaagcctcagaagaatgtgaccctcccctcttgcttttttctctttcatctttaccctcctccagcttttccccctttcaatattgaagcaggacgtagtgtgactgcatctgaggtcaggtgtggggtggtccatgtggacagtgaggaaggtggtccctgcccgtggtggtccgggtttcctgggagatggccagacgtgggtgctgaggggaagaggccggtgcagtcactggatggtagagagcatgtccattgtgctgagtgggctgggagggatccacagagaagacagtgtggctcaatagctagcaccggggacgggaacgtgggtgaagagcctggcacatggagtagctcaaggtgtgaggttgtgacccgcccagggagcctgtgcctgagtgtgctgggtgggtgctggggttgcaaacattcgtgtgcctgtgaggcccgtgtgtgtatgtgtgtgtcacgtgtccccatgcatggcaggcatcgtcgcgtgtcccccacgcgtggcaggcattgttgtgtggccactatgcatggcaggcattgtcgtgtgtcccccgtgcgtggcagcattgtcgcgtggcccccgttcgtggcaggcatgtgcagcctgagtaccatgccggatggggtgttctgtcttctccaggcccggccctgccgtgtgagcagggagcttccccatgggactgatgttctgtctcctccaggcctggccctgtcctgccatgttagcagcgagcttggccatgggagtggtgggcacaggcgtggctgtgccgggcctcactggctggactcggtggggacaccataccccttgctgagtgtgggtagcagaggggtcgaggtgccttctgggaggtggtcgggcagaggcagggttgggagtgtgtggggagatgggtgttcagctaggctccttccctgtggaggggctcagctgaaacctgggctctcactcccctcacccctgcctccccagcatcctccctctgcccgtctcttcagcctgcctcggacgccgaggtcacagcctcgctctgtctcctcacaaggccacgtggtggcaggtccttcctcctgtctaaccagagtcctgcttgctgctctgcaagcccacttgggtcacgtggggcaggggcacctggaagggtgggcttcgtggactcaagggccaccaattcctccaggtcaacatgctcagatggttccattctcccccttcccttggccacagagacctctgtatcctggggtgaccacaaatgtcacaacacaagaatcacaccaggaacgtcacaccatgtcacactggggaaaagaaagatcagactgttactgtgcctatgtagaaaaggaacacataagaaactccattttgatctgtacaaagaaaaattgttctgctttgagacgctgttaacctgtaactttagccccaacactgtgctcacagaaacctgtgctgcatggaatcaaggtttaaggggtttagggctgcgcaggacgtgcctggttcacgatacgtttgcaggcagtgtgcttggtagaagtcatcgccattctccattctctgttaactaggcacagaatacgctgcggaaagctgaagggacctctgccggagaaagcctaggtattgtcccagtttctcctcactgagacagcctgagatatggcctcatggcaagggaaagacctgactgtcccccagcctgacacctgtaaagggtctgtgctgaggaggattggtaaaagaggaaggcctctttacggttgagataagaagaaggcctctgtttcctgcacgtccctgggaatggaatgtctgggctttacacccaccattcattctattctgaggtaggagaaaaccgccctaaggctggagacaagatatgctagcggtgatacggctctgttactcttcactacactgagatgtttgggtaaagagaaacataaatctagtctatgtgtacatcccagcacggtaccttccctgggagttatttatgatgcagattcctttactcacatgttttcctgctgaccttctccccatcatcaccctgttcacgctgttctcctgccgcactccccgtatggagatagtgaaaatagtcatcaataaatactgagggaacccagagaccggtgccggtgcaggtcctcgcgtgctgagtgtgccggtcccctgggctcactgttctttctctgcactttgtctctgtgtcttatttcttttctcagtctcgtgtttccacctgatgagaaatacccacagctgtggagggcgaggccctcttcatcacaccacatcacactatgtcacactagggatgtcacacatcacaccattaactcatcacactggggatgtcgtaccgggtcacaccccatcatgccacatcacaccgtgtcacaccgcatcacatcacagcaaggatgtggcaccctgacacagcacgtcacaggtcacatcatgtcacaccacacctcatcacaccccacaccaccacacccgtcaaacgacatcataccccattaccccaaggatgttacgccacatcacatcatgtcacaccataccacataatctcataccgcatcataccagggatgtcatacccatcacactctgtcacaccacatcacatcatgtccaacaccacctcacaccagggacattataccatgtcacaacacctcacaccatgtcataccacctcacaccagggacattacaccatgtcacaacacctcacaccatgtcacaccacatctcaccagggatgtcacactcggtcacaccacatcacactatgtccaaccatgtagtccaacaccacatcacacaaaggacatcacgccacatcacaccacatcacaccagggatgtcaccctgtcataggacatcacaccacatcacatgatgtcatgctacatcacagcatgggctgctgggggcgtgcaggggcagccttgctggagagttgagggagggtcctggggctgggcatggtgttcccgcaggagggctgaccctctggaggatgctcggtcccaggtagaaagtgggaggtgggccccgggtggctcagggaggggcccaatttccccaggggaacctggtccaggcgccaggccctgcaggggcaggagctgcaggaagcatctgcttcttcccaactcagcctgctcagtgcacggaatgacccggagcccggcaccgtcctgggtctcctttccttatcctggccaggccgtccatcctcagacagtggactggagcccaccccaccagggcacccggaggcccgtagggccccttgaagggcagagggtggagagctgtccagcagggtccctgagggctggcaccttctctggacaaagctctcctgcatctctgggacgccatccttgggcttgggatagagccggtgatgcagcagctgcccgccctgcaccccaggtgctgtctccctcaccccccgcggggctgcagcagcgtgtcctgagagttaaagggctgggcttcagcacccagttcaggccaggccccctggagcccaccctccagcagcgagccttcccacggcatggcagggtccgggctctggggatttcatccccaactctgtgtttggtgaagctccagctgctcgatgccacacaaacgaatccaaccactcctccttcctgggtgagatggtctctctcctgccacaggcaactccgacggcatttcgcagccaccgcagccaccgcagccactgcagtaacaagaccctgtccttgactgagttccagccaggctcctcggagcctctccactcggcctcaaccttggcttgtaaagacttgagcagacactaacagtttctaacagcttctggccgtacccctaggccgacccctgccccgtcaacacctgcctgagaaagctccgtgcaccagaactcaccgtttggaccaaccccgacctccctttctcagggtatctgctgagagggccgcaaccacacgaccttctatccgttcctgatgtctgtgcatttcctgtgacccaggagggtctttctcgggacctgagagccactccctgaagtgtcccctttgtgaaggatggggcctgtgtctccaggctctgggaggacagaatcctgacctcaacagtggccggcacggacacagcgggtcccatcccggggacgctgaccagcgctgggaaacttttcccttccccaacgactgagccccgagcacccaccctgctccccctaccacctccctttacaaggctgtggcctctgcacagatgaaggtgagtccaggtcatgccggactctttcttccgttgcaatagttatttctgttgagaatccgtccttgctacatgacctagtgcccagggggatgctgagacaggatgaatgtgttttgcatgtgagaagaacatgaattttgggggccagagtctggactgtgatgggttaaatcgtggcccctacaaattcatatattcaagtcttaatccctggcctcacaatgtgactatttggagatggggtctttacagaggtcattaagttcatagggggtcactaatctaatccgatgtgtgttctaagaagagaagcttaggacacgggcacacagaggtatggccatgtgaggaccagggaggagacggtgtctacaagccaaggagagagggcttgagagaaaccagccctgcctgcatcctgatctcagattcctggtctctaggcctgggaggatccatgtctgccgtgggagctgccccgctgtggtcctgagctgacgcacacagatctgacacccacctctcgcttcggaccatggttggttctggaaggccctccctgtggctctgcctggccagcctgagccagctcccagcctcgacccagctttccctggaggccctgtcccccgcagagtgaccagggcaggcagcaccgtgcccagcaggaggagaaactgcatccatgtagaaaagaggagaagccccgggggtccatgtagtgacaggggccagggagggtcgctcgggcaatgcgtgtggctgcaggaggcggggggcgtatgcagggagcccccgaggtgcagctggaccagcctcctcctgaccgtgttttccaccgggggcaggaggcgcgtggacacaggaaggcggctcccatcacgaagtacaagacttaaaaaggatattttattgtcatcacaaaagaaacatcaaagacaattaatgagctttagaaaatttaaaagaagaagaaaagctaccaaagctgaaatggtggcacctccttcgagtgagcccaggagtcctccctgacggccgaggcaggcgctggccgcactcccgctcgagtctcccttcctgtctgcagattctgcgtgacagtcacggaacggcgtgatgggggcagcagagcgtgggggcctctgtccagcactcgtggccagcagccctgctttcgcaagaacacgggcaccctctttgtcgtcttgcctctccacctggtgcccccagagtggctgcttgttcctgctgcacgtgacccggggctggacgccagcctctgtgatgagttctggctgtgtccacgctcctggctctcccggtgtccctccacctctctccccgatgctcctgggcctcctctgtcctcaggccccaccaaggctgagtcttgcccgcctgggacctggtcaccagccttctctgggaggcctgtctgggcagatgcccagcccttccttgggctatcctcacccttgcactgtggggctcctgcagcggccacatggcccaggctcttctctgagtgatctcggtggactggagtgggtgggaggtggcagtgtcctgggcctggccccttctctccccagtgcggactctggggctggctgtccctgcgggtccagttccacccgagaatccagcagtgtgggcaggcagccaaggggtggtgctggcactgagactgttcccaggagccagagagcagcgttctttgcttgaaatcagaacaacctcattcctcatgtcaggagttcacgggagtgcccggaatggaggctggctggctgcgggctgggaggaaggccgtctgagtgagccttcgcagctctcggaagcctccccaacagggcctgatggtgctgtggcttccctaccttggcggctgacgctcccactcaccatctggaaaccacgcctgtgttcaggaggctggcgtggacggggttggctccagggcgaggtcctgcctgggtgggggcctgggataccggtcactgcctccttttgtgtgagcaccttgtggtccggagggcaaggacgtcctgctgaggggacacctggcccccagtgccctgcatgcaccaagcagcggaggtctggggtagacctgctatgcacagggtctggaaggggggcgtgtcaggtgtgtcagggtcagagggcaactgcgaggccagagagtcatggggttgagggcggtgaggtcgggggcaggtgtggcctgggtggtggctgagcatggcccatggctggtgtgtggggtctgggcggccctggacaccccgcagagggtggccctaggccccctgtccgatcatgttcctgtagtcggggatgatggtctgcttcaggtccaccaccgaggagaagatccacttcacctgtaggcaaggcacagcacaggggtgagcgaggccacagccctgcccccgagccccacccacccctcagggcactgaggccacctctctgcccccaaggcccacccacccgtcagtccacgcaggccacagccctgcccctgaggcccatccggcccctcatgccacccaggtgccatggcctcaccactgcctgctctgaggcttggtgatagagagcagagccagggcaccaacagcatgtggacagcacagaagacagcgtcagggacaggtggggacagcgtgggggacagtgtcagacacaggtgaggacagtgtgggggacagtgtcagggacaggtggagacagagtgtggaagagtgttggggacagttaaggacagcatggaggagagtgttggggagagatggggacagtgtcagggagaggtggggactgtgtggaggacagcatcagggacaggtggggacagcatgggggacagtggtgcatacaggaggggacggtgtgggggacagtgtcagggattataggggacagagtgggagacagtgtcagggaccggtggagaccatgtgggggacaggtggggacagcatgggggacagtgtcagggataggaggggacaggaaacagtggggacattgtcagggacaggggagatagcatgggggacagtgttggggacatgggggacagcatggaggacagtgttggggactggtggggacagcatgggggacagtgtaggagacaggttgggacaggatggaggatagtgttggggacaggtggggacagtgtgggggacagtgtcagggacaggaggggagagcgtggagaacagtgtccgggacaggtggggacagcatgggggacagtatcagggacaggtggggagagtgtgggggacagtgttggactggtaggtacagcccgggggacagcatcggggacaggtggggactgcatgggggacaatatcagggacaggtggggacatggaggagagtgttggggacaggtggggacagcatgggggactgtgttgaggacaggtggggacagcttgggggacagtggtgcatacgggaggggacggcgtgggggacagtgtcagggattataggggacagagtgggagacagtgtcagggacaggtggggacagcatggcggacagtgtcagggataggagggaacaggaggaaacagtggggacattgtcggggacaggggggatagcgtgggggacagtgttggggacaggtggggacagtgtggaggaaagttttggggactggtggggacagcatgggggacagtgtaggggacaggtggggacaggaggggacagcatggaggatagtgttggggacaggtggggacagtgtgggggacagtgtcggggacaggaggggacagcgtgggggacagtgtcagggacaggtggggacagcatgggggacagtgttgtactggtaggtacagcctgggggacagcattggggacaggtggagactgcatgggggacaatatcagggacaggtggggacagcatggaggagagtgttggggacaggtggggacagcatgggggacagtgttgaggacaggtggggacaacgtggggtacagtgtcggagatgggtggggacagcatggaggaaagtgtcgggtttaggtaagaacaacgtggaggagagtgtcggggacaggtggggacagtgtgggggatattgtcacggacaggtggggacagcatgtgggacagggtttcatacaggaggggacagcatgggggacagtgccaggtactgtaggggacagcgtgggggacagggccaggaactataggggacagagtgggggatggtgtcagggacaggtggggaaagcatgggggacagtgtcagggacaggtggaaactgtgggggacagtgttggggacaaagggggacagggtgggggacagtgttggggacagatggggacagcatgggggacagtgtcggggacatgtggggagagcctgggggacactgttggacaggtgggggcagcattggggacaatgtcagggacagtttgtgagagcatgggggacagcgtcagggacaggtggggacagcctgtgggacagtgtcagagacagtttgtgacagcatgggggacaatgtcaaggacagctggggacaacgtgcggccgaccttgaagaaggtgacggtggcactgtagcacacgcttaacaggaagagtgtgatgaagatggtgatggtcgtccacagcccgtccagctccccgtcctgcgcctccgcacagctctcctccagttgcagctctggacaggaagggggtggtcagtgctgtgtccccctgggcttgggcctctgggggtgattccctctgtggcaggacccaggatgtagggcccggccgggatgggccaacaatgtcctgaggtcagctccccacagctgcccgccctgggcaccagctttggccccggggctcagccagacacccggccctagatagcgacctggccctcagcaggacccgctccccgtctcccgtgtccctccctgaggcccagagggcaggaggatggtgaagcccacacctcatgtgaccccagctgcagggaagggcggcactgggaagtgggccagggccagggacgtgacgtggtgtgtgatcccctgtgtgtgtgtggcggctgcaggggcaccttgtgagaggagggctgggtttgtctgagcaggtcagcatgtggagaagctgccgagcggctcgtgggccttgaggtgccgcgtggggctcgtgggggcctgtgtccgaggagtgttcacgtgtgcgaggaccttgctctggtctgggtgctgtgcggttcgcccgggtgaggctccgtgtgtgaggcgtgcacgtgtgtgtgtggtggccgtgtggccggccaacctcagtgcggggtttgttgaacgggtctgggctgagtgtgtgtgtgggcatctggaccagtctctccacagggcccgagagtgcatgtccccggagtcggttgtgtccccatgcgggtgcgaggctgggcagggctgccaggggttagtgccgtgggggtagatgggtgagggagggcctgtccctacgcacatggactaggcatgcccccgagtgggcatgcgggtcggaggacagggcgctcacagaacaggacagtctcctacagaggcaggggctgtgtgtctgtccccaggggctcctagggcttctcgtggcccagcccagggcagctgctgctggagggagggccacgctggcaaatcccccaccctgccgagggcagcccctggctgagccccaccctaggcggcccaggcacacctgcacagcctgggccagtgtggggacagtgggacccactctgcctccctcatgccactcaggcctcagactcggcctgacccgtggaaagaaccatcacagtctcgcaggggcccagggaagcgctgggtgctttatttccatgctgggtgcctgggaagtatgtacacggggtacgtgccaagcatcctcgcgcgaccccgagagcctggggagcgggggcttgccggccgtggcactcatttacccggagacagggagaggctcttctgtgtgtagtggttgtgcagagcctcatgcatcacggagcatgagaagacgttcccctgctgccacctgctcttgtccacggtgagcttgctgtagaggaagaaggagccgtcggagtccagcacgggaggcgtggtcttgtagttgttctccggctgcccattgctctcccactccacggcgatgtcgctgggatagaagcctttgaccaggcaggtcaggctgacctggttcttggtcagctcatcccgggatgggggcagggtgtacacctgtggttctcggggctgccctgtagggacagaggttggtacagcggtcactctcagggcagagggtgggccgagccggcctctgtccatgtggccctcgcaccccacgggtcccacctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccgggagatcatgagggtgtccttgggttttggggggaagaggaagactgacggtccccccaggagttcaggtgctgaggaagagatggaggtggacgtgtcagcacccggctggggcctgtccctggatgcaggctactctagggcacctgtcccgccttgagctggagggcgaggcctgggctggcttacctgggcacggtgggcatgtgtgagttttgtcacaagatttgggctctgcagagagaagattgggagttactggaatctgggaggagagaaggtgtccgagctgagggagtggagagtttggcctttggggtgggcttaggtcaggggcagggtcctcccggatatggctcttggcaggtctgagcccagcacctgcccctttgtgtgcagggcctgggttaggggcacctagcctgtgcctgcccagagcctggggaaaaagccagaagaccctctccctgagcatgagtggggcgggcagaggcctccgggtgaagaggcagacggggcctgccttgctgccctggactggggctgcatagccgggatgcgtccaggcaggagcgctgagcctggcttccagcagacaccctccctccctgtgctggcctctcaccaactttcttgtccaccttggtgttgctgggcttgtgattcacgttgcagatgtaggtctgggtgcccaagctgctggagggcacggtcaccacgctgctgagggagtagagtcctgaggactgtaggacagccgggaaggtgtgcacgccgctggtcagggcgcctgagttccacgacaccgtcaccggttcggggaagtagtccttgaccaggcagcccagggctgctgtgcccccagaggtgctcttggaggagggtgccagggggaagaccgatgggcccttggtggaggctgcaagagaggtggtgccatgtgaccgcggtgtgggacagagctgggcccagggcgcagaggcccctgggttcttaactgtccgcgaggttcagcgtccagtgtctgggctcacgggcattgggtgtgcgcctggctggcgccacctgcgtcaccttagcccaccccctgccccaaagccaaggtcaggcccggcctgccccagaaagcttgcaggaccggtggccctgtggtgcccttctgcaggcacccctgcagcctaggaggcggggctcggcagccaggtcagcgctctgtgtctgccgggagtcagcacagtccagggcctctagcttggcctcagctctggccatcggtgccacctcagggacggctcatgcccattggccccactccagccttttatgggtgcctggcttgaccagtggacactgttctcagatggcttctcgtgggtcccccgagccccctgaagcccctgaccctgccgccccagcgtggccctcccctagtgagttggcctgacttgcccagggccctggtcatagcctgccctctgccctccaaggcccttttcttctgtgcagcagaggggccagacactgcatagggtcggcgcccttcagccccagggccccggaaccccctgccttggaatagcctcctggagcctcctcctcagcctctcccctcctttccccttagccccagtgtgcagcagcccaggtcagggccctgagtgcctggatgccccctgcctcccagtgtcctgcattacttctggaggctcagtcaccacaccgtcaccctcccagccctggcctggccttctcggccaccagcccacctcctccctctctccagagcttcccccggcaaggtccctgctgggctcaacccaggccccccagcacaggtaggagccttgcacctgcccttggccctccccaccctgcatggtgccaggacccccaggccacagggaggccccatttctctctgccgctggcccagtggccctggagtcccactgcaggtggggtgtgcccctgacctctgaggaggctaagcgccctgccctcagccaggccatcccctctgctcagccccagggccccgctcaccaccccttcccctcacctgcaccacaggctctggctgactctgcccaggccctgaatgggcccctctggctgccctctgctgctacactgccctgcaccacctccactcagcttcattgtgctggtggccctggctcctggcagcccatcttgctccttctggggcgccagcctcagaggccttcctgcccagggtccgctgggaccagccgtgggaccctcctggtctcaagcacacgttccccctgcagccacacctgcccctgcctgagagctcagccctgagccctggaacgccttcccttctccatcccagctcgcccttgccaactgctcagtgggatggactcacactcccttcccggcaccaggaggctgcactgcactttcaccagccctcagctgtctgttgccagcaactacccagctcctgccaaagtctaggagctgagtgatgcctcccaccagccctgctcacctgtggctgccttgccctgagctctagtgcctgtcccctgctcgtcctgcctcccaccggccctgctgacctgcggctgctctgccctggtcccctgagctccagtgcctgccccctgctcctcctgccccccacctgcccctgctcacctgcggctgctctgccctggtcccctgagctccagtgcctgccccctgctcctcctgccccccacctgcccctgctcacctgcggctgctctgccctggtcccctgagctccagtgcctgccccctgctcctcctgccccccacctgcccctgctcacctgcggctgctctgccctggtcccctgagctccagtgcctgacccctgctcctcctgccccccacctgcacctgctcacctgcggctgctctgccctggtcccctgagctccaggagctgccccctgctcctcctgccccccacctgcccctgttcacctgcgactgctctgccctggtcccctgagctccaggagctgccccttgctactcctgccccccacctgcccctgttcacctgcgactgctctgccctggtcccctgagctccagtgcctgccccctgctcctcctgcaccccacctgcccctgctcacctgcggctgctctgccctggtcccctgagctccaggagctgccccctgctcctcctgccccccacctgcacctgctcacctgcggctgctctgccctggtcccctgagctccaggagctgccccttgctcctcctgcccctgttcacctgcgactgctctgccctggtcccctgagctccaggagctgctccttgctcctcctgccccccacctgcccctgttcacctgcgactgctctgccctggtcccctgagctccaggagctgccccttgctcctcctgcttcccaccagcccctgctcacctgcggatgatcttccctggctctctgagctccaggggctgcccacctgctcctcctgcttcccaccggccctgctcacctgcagctgctctgccctggctccctgaggctgagcctcagtcctgctcaccttctgatgctctccccttgtcccctgagctccaggggctgacccctgatctttctgcttcctacctgcccctgctcacctgtggctgctctgccctgatcccctgagctccaggagctgcctcctgctcttcctgcctcccacctgcccctgctcacctgcagatctgccctggctctctgaggtccaggggctgccccctgctcgcccacctcccaccagccatgctgacgttgtgatgctctgccctggtctcctgaggtccaggggctgtcccctgcttattctgcctcccacctgccccttctcacctgaggctcttctgccctggtgctctgagctccaaaagctgcccacttgctcctcctgcttcctaccagcccctgctctcctgtggatgatctgccctggctctctgagctccaggggctgcccacctgctccccatgcttcccacctgcccctgctgacctgcggctgctctgccttggctccctgagctccaggagcttccccctgctcatcctgccccccactggcccctgttcaccttcagatgccctccctggtcccctgaagtccaggagctgccccctgttcctcccgcctcccaccagcccgtgctcacctgcggctgctctgccctggtcccctgagttccaggggctgccccctgctcgcccacctcccactagccatgctcacctcctgatgctctgtcctggtcccctgagctccaggggctgccccctgcttgcccatctcccactagccatgctcaccttctgatgctctgccctggtcccctgagctccagggtcttccccctgctcatcctgccgcccaccagcccctgctcacctgaggctgctctgccctggtcccctgagctccaggaggtgccccctgctccttctgcccccacctgccctgctcacctgtggctgcttggtcctggtccctgagctccaatgcctgctccctgctcactctgccctccctcaacccgggcagcaatgtcactcaggtcactgttgcccccctgcctgtcctggcaccctctgtccaggtttgggctgtttttctgccctcatttttgattttgcagcacttggcgtgttccctatgctgtggagcagccccagtgtccagtcaggtctccccaacagagccccttgcccttgcccatgtgcccctcctgaatgagctcccggatcctcctgtccctgcactgctcctgctctggaagcctctctggaacctcagctcctcagtggcctctgctctgctgggtcagttccctgaacgcacggagcctcagcccttcccctcgccccaggcctgctgcactctgggcctttctgggcctccctggactcttcccttctcccgcccgtgcactcagcacagctctcccctcctctccactgctgaccacagccctgctccccgccagcaggtgccccaaccccatcagctggctctgagcccagcccctgtgcctcccctgtccctgcctctgcctctgggctccttggcttccaccctcctgtcctgctgccacactcaccctccctgctctgctcccggctcacctgctgtccttggtcctggctgagaggagggccccacggccagcactgctgaccctgccctgggctccggtgatgctgccggcctggacaagcccctccgttcacctggggcctctcctcctccctcgctctgctgcctcctgagctcaggtcggtcgtgcccatcctggcatcaccccacggccggctctgccgcatccagtcatgttcctcgtgctcccagcccggtcgtcctggaggcctcagtcagcctctggtgtgtcctgccctgttggcttggaagcccctgcccacggtccccgtcgtctcgcactgggtgggcatcggtgcctgaaggctgcccacctcccccgtgctggctccgcttgggcctccatgtggggccggcctcgaccccatgtctccccagcctcttggagcctgttcagcatctcaggtccaggagcgcccacggctgcccccaggctctgtcctcctcccgagcctgtgcccctgccctgtgctgaccccactcaccgaggtgggggtctcagcccttcctgttctggcgaggtacatgtgggcagccccgcccctgccgtcagccgctatttgtcttcctaggaaatcacagctcggcccccaggtccccaggtgtgtgaactccacgctgcaaagactaagaacaggattgaaaccggcggcaccacttacttcctgaagttcccttttcttctggtggtttctgggtcagagggcgagggggagtccagacacagccgaggctgcctcatgggtgtgtggggatgggggtggtggctgcccccatactcccccgtactcacgggagaaggtggggagcccagaccttgtgtgctgctcttttctctgtctctgagtccctggggctggactgatactggcagcgattatgaccattctgcccgtgatctcagcctctcaatacctgggcctctcatctgaagcttctggcccccactaggccctggtggctgctttggcctgggcgtgtctccagctggctctgactcatggtgcagggaggggagtgtgagttcatcctgctgagcagctggcaaaggcgagctgggatggagatgggaaggcattccaaggctcagggctgagctcacaggcaggggcaggtctggctgcagggagaacgtgtgtgcttgagaccaggagggtcccagggctggccaagtggaccctgcacaggaaggcctctgaggctggtgctccagaaggaacaagatgggctgccaggagccagggccaccagctgtgctcctgggggccgaggggacttgggacaggtggatgaacacactgaagctgagtggaggtggtgcagggcagtgtagcagcagaggggagccagaggggcccattcagggcctgggcagagttggccagagcctgtggtgcaggtgaggggaaggggttgggggcagggccctggggctgagcagacgggatagcctggctagggacaggacacttaacttcctcagaggtcaggggcacacccgagttgcagtgggactccagggccactggactacaagcagagagagaaatggggcctccctggggaccgggggatgctggcaccatgcagggtggggaggtccaagggcaggtgctaggctcctacctgtgctgggggagcctggactgagatcaggagggaccttgccaggccgaagctctagagagagggaggagctgggcaaggacgattgtggaggtgggaggtagcagggaacgggatgaggatagagggactgggcagacagaaaacccaaggaggtgtcgcacaggaagtgtccagaatggaataggaattgtgcggaatggaaaaggaagcatccagcatggaacaggaagcatccagaatggaactggaagcatccagagtcaaacaaaaaacatccagcatggaacaggaagcatccaggatgtaacagaaagcatccagcatggaacaggaaatgtccagcatggaacaggaagcatccagaatggaataggaagcatccagagtggaacaagaaacatccaacatggaacaggaagcatccagaatggaaaaggaagcatccagcatggaacaggaagcatgcagagtggaacaggaaacgtccaccatggaacaggaagcatccagagtggaacaggaagcatgcagagtggaacaggaaatgtccagcatggaacaggaagcatccagcatggaacaggaagcatccagcatggaacagggagcatccagagtggaacaggaaatgtccagcatggaacaggaagcatccaggatggaacaggaagcatccagtgtggaacaggaagcatccagagtgtaacaggaaacatccagcgtggaacaggaagcatccagtgtggaacaggaagcatccagcgtggaagaggaagcgtccagcatggaacgggaagcgtccagaatgggcactttgaagggaaatcatgtccctcccactaaatgtgctctccacaaggacccggcctgcccttgtgaccctgctggatccctgagctggcaccagccctgccctcagagagaatgtccaggagacaggtggaggtgcacgtgtgggtccctggggaaatccatcctccagccgcaggctcccagtcggctcccagcctctcgttccagcttcaccccatggagctcataatgggctcaacctcccaggctgggggaggacggagtgaggggtccccgcactgcccatggcacacccagggggctggggagtctgcactgggctggggcagggaggcctcgtgcagcctgtggggctggcagctcaggacaacactcgtatccgttaactgtggccctggcaacacagcaccccagactgcgtggcttaaacaacagacgtttattccgtcctggttctggaggccgggcatctgggatggaggcctcggtggggctggcacctctgtgtcatgggagactctgtcccaggctctctccctgctgctgggctttgccggccgtctctgctgctcttggcttatggaagcagcaccatcttcacagggcgttctccccacgtgctgtctgtgcccagattcccccttttcatgaggacagcagtcatattggatcagaggcttgcgctactccagggtgacctcatctgaacttgattgcagctgcaaagactgtttccaaacaaggtcacattctgtggtcctgggggttaggacttcaacacatgaatttataggggacacattttaacccatgacagtttgccctccgctccccccataatcatgtccttctcacacgcaaaatccctgcaccccatagcaacatctccaagatggctaaccccttccagcaccaactcttagtccacaatgtcagagaaacatcacctgcatcaagtgtggcagaaacccagggtgagattaggagagaaaccacagcggggtggcgagcctcctgccccctccggcccaggtgaggccgtgtgcactgtgtgggtgtgcctggggctccacttgcccctcccatgtacctgctcattttccccaggctgtgggcatttggggcaggggcctcagtgcctggtcggctctctcccggttctatccaatgccccaagctgtgctgggctggaggggccgggcagggtgggcccccaggaaggaggatggcatcccaggtggggctccatctctggcctctgccagccttgagatccccggtcgtctgtgtctccctcctggggcccagcaggcctgctcagctctgagccccatgtccgttctcaccctgctctgcttttccttggggtgctggccctgccctggcctccagaaatggcccctgcccccaccccttcctcaggggctgggctgttcctctcctgccaggcgtgtgcccacctaggcccaataggcacagtgcctacggcccctcctgccctcttctggccttcacgcccagccatgccggcagcccgcctcagtggcctgggccttcgccagcgcctggctctgtgtccagctgccactcctgtggccccgtggtgctgcccctttccctcagtgacgggggctggactgcctgggaatgggctgtgtctcagctgcacacacctgtgtgtgtcagtgtgcgcatgggagtgtgtgtgtgtgctgggggtatgtgcaggaatgcttgtgtctgggggcagggggagcatctgccttcctgccccaggcctggaatggccatgccagggtgggtgggagcagcgcgtgcgaggacagtgctgctttgacgtctgcgtgtggctggtgggggtgggaggacgtggtgtggcacgagtctcgggctccccatctccatccagctgatcccggatggctgcgctcctgagggtttagagcagcccagggggtcaggaggctgttgggacgctggaggcaagcgctggcagggatgcgggtgggctggccaggcagcgtggccagggggcttcgagccggggcagtgaaccatcccccaactttttaaagttttaaaagtcatatttacgcaagtgtagtttacattcagtataatccatcctgtgacatgtgagtttcaacaaatgcacactcatgcaaccaccaccgtaatccagatgaacagttgcaagaagatgtagaatctctccaaatattccaccaggcccctttgcaatcaacgcctccctgatggccaggaatccattgatctgcattctgtcagaagattcagagtttatcattaaaatgatctattatggaaaatattataagcatacaaaacacaaaaccaagttttaaaaagtgaggtatttcttaaaagtttagtatacaaacaaaatgaaggtaccttcacattttactacagatgtgcagatagttttcttgttgcacagagataaggcagaattaagtcagaataatgttctaaaactgacctccggaagaacttgtcttagtcatttctttgcagagtatgtgaaccaagattcgggtttggtctttggtgttagcactgtgtcaaggatcagatagaaagtacaaatggaggggcccctttctgaggccaggccccactgtcggggcatgtggggtgaccaggggccaataccagctgaggctaagaggctgctctcagaagggtaggtttccaggtgtctcttgaaccctttgttcagaaccaggacatgtgtggctgggcagcagccttcagaccccccacaggctggtgcccggtgcccacagccctctgttgggttgtcaggcccctgcacccgtggtggggtgttgggctccagagttccctgggaccagctgatctcttgtccttggttttggcccaaatgcaagcccctggtctcctccaagtaacttcctttccccagggctgtccaggccccaccgctgcctgttccttcccagggcctcccgcaagtcccgatgctgacgcctctctgcccacctagtttgtggccgccgcctccagctctgtgtctgcctcccagcgagggagccgtggttgattatctcgtgagtgtctgcccttctgaagggtacagtgtgaagtctcatcagtctcacttcaatgcctaagcacctcttcagaaaccagggagtcatccgggtttctccatctttaaccatgttttctaaaggttttcttggcaatttcctggccatttgcaagacaggattttttggttgccaacttccaattagctttaaacttgccacgatctcccaggtcatcccgtccatcgatgatgcttattacattcttcctgatttccatgtggccaaattcaatagttatttaccccaggcttgtattttggaggctaaagaactctgttaccagctatatccgtgctgtggctgccgtaacaaaatatcacaaatgtggcttaaaacaacaaaaattttttcagagttctgggagtcagaaatctgagatcaaggtgttggtggctgtctctgagtgctccaggggaggaccgtccacctcttccagcttcctgtggtgcaatagtttggatgtgcgtctctccaaatttcatgttgagatgtgattcccagtgttggaggtgggcctggtgggaggtgattagatcatggggctggacccctcatgaatggcctagcaccatctcccaggtgatgagcgagttctccctcagttagtccctgtgacagctggttgtttaaaagtctgggacgtgccactttcttctcttgctccctcttgccatgtgacatgcctgctcccccttcgccttctgctgtgattgcaatctccctgaggcctcgccagaagcagatgccagggccgtgtttccagaacggcctgcagaaatatgaactaattaaacctcccttccttccttctcttctgccttccctgcccttcccttctgccctgcccttctgcccttctgctcttccccacccttcccttcttcttgtcttttcaagacaagttctcactatgttgcccaggttggtctcaaacttctgagctcaagtgatcctcctgcctctgcctcccaaaatgctaggatgacaggtatgagccacagtgcctggcctaaacctcttttctttataaattactagcctcatgtatttttttttctagtaacacaaactaacacagaaatttggtattgaggagtggaacattgctataaagatacctgaaaatttggaagcagctttggaatcaggtaacaggcagagaagttagaagaatttggaggactcagaagaagacaggaagatgagggaaagtttggaatttcttagagactgattaaatggttgtcaccaaaatgctgatagacatatggactgtgaaagccaggctgatgaaatctcagatggaaatgaggaacttattgggaactggagtaaaggtcacgcttgttaaatcctaagaaacaacttggctgcattgtattcatgccctagggatctgtggaagtttgaccttaagagtgatgacttaggacatctggtggaagatacttctaagcagacatttctaaggtgtgacctggttgcttctaacagtctatggtaagatatgggagcaaaggaatgacttaaagttggaactgatatttaaaaggtgcaaatgaaaaaataaaatgctaatgcaaggggattccaaagaaacctggaaaaccagttcaggccatgacaggaaggggagggtggtttggactccctcactataccctctccctgttggagtttaggctcagctgaccggtgttaacattaaaacagggagcttaagactgacaaagcagactctttgtagcaataagatatcaaattccaacctgactctggtatagcatcacatgacagttggcaggcatggaaggaaattaaagtattttatgccagaatatatttctctgacacattttggaatggccctgcaaagccgtctcttgtggaggaaatgtatattctgtcgagaatctttttccctttccaggtctcttcctgattcaggagagatttatccaagagtctggcaccttttaggttctgataagagacattgaccatctcttctctctggaacgtggaggcttcatctacataacaagaaccttggcttccacaacctgctttatcttaagcattgctttttgctgacttcaactttttagataatttaaatttttcagccaattgccaatcagaaaatcttcaaatccacctatgatttggaattccccactttgaattgtcctgccattccaaaccaaacgaatgtatactttacatgtattgattgatgtctcatgtctccctaaaacataaaaccaggccgcaacccaagcaccttgcacacatgttctcaggaccttttgaggctgtgccacagttcatggctctcacatgtggctcagaatcaatctcgtcaagtgttttatagagtttggcttttttcatcaacaaagggaagcagagcataaaaaatttggaaaattcatggcctggccatatggtagaaaagaaaaggtattttcaggagacaaatataagtaggctatggagcagccagttgctagagagattagcataactaaaagggagctaagtgctcatatccagaacaaagggaagaaggccttgaaggcattttggaaatctctgaggtggtctttcccatcacaggcccagaggccaagagggaaaggatggttttgtgggccatggccatggccactgctgcctgtgcagccttgggacactgctctccacatcctggttcctctggctccagccttggctcaaagggccccaagtatagcttaggctgcttctttggagagtgcaagccactataagccttggtgacttccatctggtgttaagcctgtaggcccccagaatacacgagtgaaggaagcttggcatcttccctctagatttcagaaatgtatgagaaagcctaggtgcccagacagaagcctcctgccagcatggagccctcacagagaacctctactagagcagtgccaaagagaatgtggggttgaacccccatataatgtccccaccagggcactgcctagtggagctgtgggaagggggccactgtcctccagaccccagaatggtggatccactggcagtttgcaccctgaatctggaaaagccacaggcactcaactctatcatgtgagagaagccacaggggcaacatcctccaaagccacaagggtagagttttccaaggccttgggagcccaccccctgcaccaatgtgccctggatatgggacatgaagtcaaaggagattaccttggagctttaagatttaatgactgccctgctggatttctgacatatatggggcatgtagatcctttctttttgccaacttctcccttgtggaatgggaatgtttacgcaatgtctgcactctcattgtattttgggagtcaataatttgtgtttgatttcataggctgataggtggaagggactcatcttcagatgagacttgggacttgggaaatttgggttgatgctggaatgaggtaagactttgggggactgttgagaaggcatgattgtattttgcaacatgagatttgggggaccaggggtggaaggatatggtttatatatttgtcccctccaaatctcatgttgtaatatgattcccagtgttggaagtggggcctggtaggaggtgattagatcaagggggaagatccctcatgaatgatttagaatcatccccttggtgatgagtgaattctgccccagtcagctcacacacagtctagttgtttaagtctggggccccccctcagcctcttgctcccattcttgccatgtggcatacctgctctcccttcaccttctgctatgactgtaagtttcctgaggtcctcgccagaagcagatgctggtgccatacttcctatacagcctgcagaactgtgagccaattgaacctctttccttcataagttactcagcctcaggtatttctttacagtaatgcaaatggacaaacacaggtggctcctgacacaccgctcatcttctcctttgtcatcatatggcttacctccatgtatgtctttgtcctctcctcttatgaggacaccagtgtttggacttgggatccatccaaaatttagtatgatatcatctcaagtccttaacctaatttgtaaagaccccatttccaaataaggtcacattctgaggttccaggtgggcatacatttggccagggagatgccatcagcccaccacaccagcctacgcaggtacatttgcatatagcttagggttgacctttcccatggaagtattacatccccctctggactccagtttcacatgttttagaatgcttcaccttgtccagcaggatgagtctcttttcattttttagtatttttctctctcttctttggattggattaaaaagaattgacatattctattgatgcatctttaagttttcagttccttcttatgtcttgtccaatctgttattaaacttgggtaatgtttttctctttcttttcttctttaataaaatagagatggggtttcaccatgttgcccagggtggtctcaaactcctgagatcaagtgatccttccatgtttggcctcccagagtgctaggattacaggtatgagccactgggcctggtcaaatgatgtttttcatttccgaatcatactcttagttctagaattttcatttgcttcttgtaactattttcagttttttatagagatacctcatctagtcactcatgataaccatattttcctttaagtctttgaacatatttaacataacttctttaaagtccttgtctgataactgtatctgcatctaggtcatcttggagttgatctccattgatccctttttcttttaactatggatcacattttcatatttctttgcatacctggtaattttggatgtgcacctgatgttgttaacatgtgtacaggctatggggtttgcattcttccttagcagaacattaattgtttttttcaatgttagcaagcagttagcttgagttgactcaaactccccagtctgtctgcctggcagttggcagtagctggaatctcagttctcttgaccttacacgtgttgctttctgctgggccctttggagttttccctacccatgcacacctaagggatcagccagaggtttcagtggagtttacttgcagattgtggggtttcccttcggtgaccttctcctttatggacatcttctcttcatttccagctgctctgaaaatgtagcccggcatcccactcctcaccaggagggctgcagtttcctgcttgaactctagctgtacccattacatgccctggagtgtgacttcagacgaatatttaacggaataatccttactagtgtttgcctacttctggtcatgttccagtgcctgcaattggtgtgtgtgggtgttgtgtgtgcttacagcgtttctagtgtttataattgccatctgccaaagggctagtctgatattagctgctccagaattattggaatcagaactactttctctcatgtggtttttcattttcatttccctgttgactagtgtggttcaacatcttttcatatgtttagtggctatttggatatcttctgtaaaacatctgttcaattctcttgcctattccttgttggattatttgattttttttctcattggtttacagtggtcttctttatattatggatctgtttgtgtcagtcagttatatatgtttataggaagcattaagaagaactgaaatggaccaaaagattagtaggtgccttccatggaaagcaaggcatcgtcttgtacactcttccaagttatttcattctatggagctctgcatcttttatttcctttgaactattttacacctctataagccaggggtccccaacccctgggtcatgcactggaatctgctcatggcctgttaggaactgggccacagagcaggaggtgaggggtgtgtgagcattcctgcctgagctccacctcccgtcagatcagtggcagcattagattctcataggagcgaaccctattgcgagctgcacattcccagatctaagttgcacactcctcgtgaaatcctaatgcctaatgatctgaggtagaacagctttgtccccaagccatcccccgatcctggtctgtggaaaaattgtcttccatggaactggttcctggtgccaaaaatgttggggactactgctctaagttgtacataattgatagcaatgcaaaagctctttgagttggtagaaattcaagttctcacctttggaaggacaatgaattgctcctcatcttccagggaaaaggccagttttgcatctatctatgaactccttttagcattcctgaatcaattatgtaagtgtagtacttagaattccactttgaactggttacgacaccttaattaatgagataaagagcatctctgaaatgtgtcgtcatatgtttatgtgagtcctgatcataacagttttagaaaatgatcttttaactcgttgtgatttcttctccctcatggccccacccagccgcagtatccagggagcttagttttctgtggcccaggagggcaggagaaccggtgttgatgaggagatctgaggttggccccaacttttccccacagctctgcttcaaggagtgccctgggaaggcctcccaaccccacacctgtcctgttggccaaggcgagctccatgccatgtggcatctctgccgctggccacctggtgagtatctgttgaatagagaaatgtgcagcatctccacagagcctccagggcttctgtgctctccaaacatctctgggctcctggcaccctctcagggtatgatgtgttggtgtctgggttgggcccctgtccctgagggtaggactcaggcaaggacaaagctctggactcaaagagctggtgtgggggtgagtgaaaggaacaggagctttggggtcagaaatgcgggtttcagcctgcattgtccccatgagcaggggcttgcaggctcaccaagacctcagtttctaccatggtgagagagtgtcagagactgcagcacgtatttgaaaagcgtccagggacggcaggggtctgggttggaccagctctcctgaatactgagggtgcgaccttgaccattgtgaaaggaaaataaaatctcaggactccaaactcactatgccaaaatgaacagttgaggtgggaagctgagtcatgaaaaaaaaaaaaagtcatgcctttccttttgtttccaaagtgatagcagcagcagataggccaggtctacccaggtggcctccctcaccctgagaatataaattaacaggccggtcttcatgacatgggacaaaatgagacaagaaatcgttcctcctacccctgagacgaatgcatatttgacttcttcctctactctgtttatttgcttataaagtgcagatttactgagcacaaggcgaatgcgtaattgctccctccacccctccttttcatgcaacgtgggggctcagtgaactctaatcaaagcctcacaagaatgtgaccctcccctcttgcttttttctctttcatctttcccctcctccagcttttccccttttcaatattgaagcaggtcgtagtgtgactctgcctggggtcaggtgtggggtggtccacatggacagtgagaaggtggtccctgcccgtggtggtccgggtttcctgggagatggccagacgtggattctgaggggaagaggccagtgcagttgctggactggagagagcatgtccattgtgctgagcgggctgggagggatccacagagaagacggtgtggctcaacagctggcaccggggacgggaatgtgggtgaagggcctggcacatggagtagctcaaggcgtgagactgtgacccacctggggagcccgtgcatgagtgcactgggtgggtgctggggttgcaagtgcgtgtgtccctgtgtgaggaccgtgtgagtacccgtgtgtgccacatggcccccgtgcgtggcaggcatgtgcagcctgagtaccataccagacggggcgttctgtctcctccaggcccggccctgccatgtgagcagggagcttccccatgggactgatgttctgtctcctccaggcctggctctgtcctaccatgttagcagggagcttggccatgggagtggtcggcacaggcatggctgtgccgggcctcactggctggactcggtggggacaccataccccttgctgagtgtgggtagcagagtttgaggtgccttctgggaggtgttcgggcagaggcagggttgggagtgtgtggggagatgggtgttcagctagcctccttccctgtgcaggggctcagctgaaacctgggctctcactcccctcacccctgcctccccagcatcctccctctgcccctctcttcagcctgccttgggccttgctctgagaccgctgctgagaggacaggaggagcttcagcagcaccctgtgctgggtggacgctgaggtcactgccttgctctgtgtctcctcacaaggccacgtggtggcaggtccttcttgcagtctaaccagagtcctgcttgctgctctgcaagcccacttgggtcacgtggggcaggggcacctggcagggtgggcttcgtggactcaagggccaccaattcctccaggtcaacatgctcagatggttctattctcccccttcccttggctacagggacctctgtatcctggggtggccacaaatgtcagaacacaggagtcacaccaggaatgccacaccatgtcacaccacatctcattatgtcacgccagggatgtcacgccacatcataccatgaaacttatcatcacactagggatgtcgtaccctgccacaccccatcataccacatcacaccacctcacaccagggacattataccatgtcacaccacatcccaccatgtcacgccacctcacaccacatcacattatatcacaccacgtcacactatgtcacagcctgttacgcttcatcacaccacatcacaccagggatgtcacactgtgtcacaccacatcccagcatgtccaacgccacctcacaccagggacattacaccatgtcacaccacatcacatcacccctcggatatcacaccgtcataccacatcatacaacatcacaccatgtcctgtcgcatcatgccacatgacatccacgtcacaccagagacatcacaccacgtcacaccatgtcatgttacatcacagcatggactgctggggtatgtgcaggggccgcccacagtgcagccttgctggagagttgagggagggtcctggggctgggcatggtgttccctcaggagggctgaccctctggaggatgctcggtcccaggtggaaagggggcggtgggccccgggtggctcagggaggggcccaatttccccaggggaacctggtccaggcgccaggccctgcaggggcaggagctgcaggaagcatctgcttcttcccaactcagcctgctcagtgcacggaatgacccggagcccggcaccgtcctgggtttcctttccttatcctggccaggccgtccatcctcagacagtggactggagcccaccccaccagggcacccggaagcccgtagggccccttgaagggcagagggtggagatctctccagcagggtccctgagggctggcaccttctctggacaaagctctcctgcatctctgggacgccatccttgggcttgggatagagccggtgatgcagcagctgcccgccctgcaccccaggtgctgtctccctcaccccccgcggggctgcagcagcgtgtcctgagagttaaagggctgggcttcagcacccagttcaggccaggccccctggagcccaccctccagtggcgagccttcccacggcatggcagggcctggagtctggggatttagtccccaactctgtgtttggtgaagctccagctgctcgatgccacacaaacgaatccaaccactcctccttcctgggtgagatggtctctctcctgccacaggcaactccgacggcattttccagccaccgcagccaccgcagccactgcagtaacaagaccctgtccttgactgagttccagccaggctcctcggagcctctccactcggcctcaaccttggcttgtaaagacttgagcagacactaacagtttctaacagcttctggccgtacccctaggccgacccctgccccgtcaacacctgcctgagaaagctccgtgcaccagaactcaccgtttggaccaaccccgacctccctttctcagggtatctgctgagagggccgcaaccacacgtccttctgtctgttcccgatgtctgtgcatttcctgtgacccaggagggtctttctcgggacctgagagccgctccctgaagtgtccccattgggaaggatggggcctgtgtctccaggctctgggaggacagaatcctgacctcaacagtggccggcacggacacagcgggtcccatcccggggacgctgaccagcgctgggcaacttttcccttccccgacgactgagccccgagcacccaccctgctccccctaccacctccctttacaaggctgtggcctctgcacagatgaaggtgagtccaggtcatgccggactctttcttctgttgcaatagttatttctgttgaaaatccgtccttgctacatgacctagtgcccagggggatgctgagacaggatgaatgtattctgcatgtgagaagaacatgaattttgggggccagagtctggactgtgatgggttaaatcgtggcccctacaaattcatatattcaagtcttaatccctggcctcacaatgtgactatttggagatggggtctttacagaggtcattaagttcatagggggtcactaatctaatctgatgtgtgttcttataagaagagaagcttaggacacgggcacacagagggatggccacgtgaggaccagggaggagacggtgtctacaagccaaggagagagggcttgagagaaaccagccctgcctgcatcctgatctcagattcctggtctctaggcctgggaggatccatgtctgctgtgggagccgccccgctgtggtcctgagctgacgcacacagatctgacacccacctctcgcttcggaccatggttggttctggaaggccctccctgtggctctgcctggccagcctgagccagctcccagcctcgacccagctttccctggaggccctgtcccccgcagagtgaccagggcaggcagcaccgtgcccagcaggaggagaaactgcatccatgtagaaaagaggagaagccccgggggtccatgtagcgacaggggccagggagggtcgctcgggcaatgcgtgtggctgcaggaggcggggggcgtatgcagggagcccccgaggtgcagctggaccagcctcctcctgaatgtgcttcccaccgggggcaggaggcgcgtggacacaggaaggcggctcccatcacgaagtacaagacttaaaaaggatattttattgtcatcacaaaagaaacatcaaagacaattaatgagctttagaaaatttaaaagaagaagaaaagctaccaaagctgaaatggtggcacctccttcgagtgagcccgggagtcctccctgacggccgaggcaggcgctggccgcagtcccgctcgagcctcccttcctgtctgcggattctgcgtgacagtcacggaacggcgtgatgggggcagcagagcgtgggggcctctgtccagcactcgtggccagcagccccgctttcgcaagaacacgggcaccctctttggcatcttgcctctccacctggtgcccccagagtggctgcttgttcctgctgcacgtgacccggggctggacgccagcctctgtgatgagttctggctgtgtccacgctcctggctctcccggtgtccctccacctctctccccgatgctcctgggcctcctctgtcctcaggccccaccaaggctgagtcttgcccgcctgggacctggtcaccagccttctctgggaggcctgtctgggcagatgcccagcccttccttgggctatcctcactcttgcactgtggggctcctgcagtggccacatggcccaggctcttctctgagtgatctcggtggactggagtgggtgggaggtggcagtgtcctgggcctggccccttctctccccagtgcggactctggggctggctgtccctgcgggtccagttccacccgagaatccagcagtgtaggcaggcagccaaggggtggtgctggcaccgagactgttcccaggagccagagagcagcgttctttgcttgaaatcagaacaacctcattcctcatgtcaggagttcacgggagtgcccggaatggaggctggctggctgcgggctgggaggaaggccgtctgagtgagccttcgcagctctcggaagcctccccaacagggcctgatggtgctgtggcttccctaccttggcggctgatgctcccactcaccatctggaaaccacgcctgtgttcaggaggctggcgtggacggggttggctccagggccagctcctgcctgggtgggggcctcggatgctggtcactgcctccttttgtgtgagcatctggcggtctggagggcagggacatcctgctgaggggacacctggtccccagctccctgcatgcaccaagcagcggaggtctggggtagacctgctatgcacagggtctggaaggggggcgtgtcagggctcagagggcgactgcaaagacagagagccatggggttgagggcggtgaggtcgggggcagttgtggcctgggtggtggctgagcatggcccacggctcgtgtgtgggatctgggtggccctggacaccccgcagagggtggccctaggccccctgcccaatcatgttcctatagtcggggatgatggtctgcttcaggtccaccaccgaggagaagatccacttcacctgtaggcaaggcacagcacaggggtgagcgaggccacagccctgcccccgaggcctgctcacccctcaggccacccaggccacagccctgcccctgaggcctatccggcccctcatgccacccatgtgccagggcctcaccactgcctgctctgaggcctggacatggagagcagagccagggcagcaacagcatgtggacagcacagaagatagtgtcaggtggggacagcacgggggacagtgtcagagacaggtgaggacagcatgggggacagtgtcagggacaggtgaggacagcatgggggacagtgtcagggacaggttgagacagtgtggggggagagtgttggggacaggtgaggacagtgtggaggagagtgttggggacaggtgaggacagcatgggggacagtgtcagggataggtggggacagcgtggaggacagtgtcagggacaggtggagacagtgtgggggagagtgttggggacaggtgagaacagcgtggaggagagtgtcaggggcaggtggggacagcatgggtgacagtgtcagggagaggtggggacatcatggaggacagcatcagggacaggtggggacagtatgtgtacagtgtcagagatgggtgaggacagcatgggggacagtgtcagggacaggtggagactgtgtgggggacagtgttggagacacgtgggaacagcatgggagaaagtgtcggggacaggtagggacagtgtgggggacagtgttaggaaccggtggggacagcataggggacagtgtcagggaggagtggggacagtgtgggggacagcatcagggacaggtggagacagcgtaggggatagtgttggctacaggtggggacagagtgggggacagtgtcagggaaaggaggaaacagagtggcggacagtgttggggacaggaggaaacagcatgggggacattgttggggacaggaggggacagcatgggggacagtgttggggacaggtgggaaaagcatggtgtacagtgttggggactggtggggacagcatgggggaaagtgttggggacaggaggggacagtgtgtgggacagtgttagggagaggtggggacagtgtgggggacagtgtcagggggaggtggggacagtgtgggggacagcgtcagggacaggtggggacagtgtgggggacagcatcagggacagctggggacaccatagggacattgtcgggacagatggggatggcatgggggacagtgtcagggacaggtggggacagtgtgggggacagcatcagggacaagtggggaccacgtgggggacagcgtcagggagaggtggggacagtgtgggggacagcatcagggacagctggggacaccctggggacattgtcgggacagatggggatggcatgggggacagtgtcagggacaggtggggacagcgtgggggagagtggtggggacagattgggacagtgtgggggacagcatcagggacaggtggggacagcatgggggacattgttgaggacaagtggggacagcgtggggtacagtgtcgcagatgagtggggacagcatgagagacagtgtcagggacagtgtcagggacaggtggggatagcatgggggacagtgtcagtgacagtttgtgacagcatgggggacagtgtgagggacagtttgtgagagcgtgggggacagtgtcagggacaggtggggacagcctggggacagtgtcagggacagtgtgtgacagcatggaggacaatgtcaaggacagctggggacaacgtgcggccgaccttgaagaaggtgacggtggcactgtagcacacgcttaacaggaagagtgtgatgaagatggtgatggtcgtccacagcccgtccagctccccgtcctgcgcctccgcacagctctcctccagttgcagctctggacaggaagagggtggtcagtgctgtgtcctgctgggctcgggcctctgggggtgattccctctgtggcaggacccaggatgtagggcccggccgggatgggccaacagtgtcctgaggtcagctccccacagctgcccgccctgggcaccagctttggccccgggactcagccacacacccggccctagatagcgacctggccctcagcaggacccactccccgtctcccgtgtccctccctgaggcccagagggcaggaggatggtgaagcccacacctcatgtgaccccagctgcagggaagggctgtattgggaagtgggccagtgccagggacgcgacgtggcgtgtgttcccctgtgtgtgggggcctgtgtgtgtgtggcggctgcaggggcaccttgtgagaggagggctgggtttgtctgagctggtcagcatgtggagaagctgccgagcggctcgtgggccttgaggtgccgcgtggggctcgtgggggcctgtgtccgaggagtgttcacgtgtgcgaggaccttgctctggtctgggtgctgtgcggttcgcccgggtgaggctccgtgtgtgaggcgtgcacgtgtgtgtgtggtggccgtgtggccggccaacctcagtgcggggtttgttgaacgggtctgggctgagtgtgtgtgtgggcatctggaccagtctctccacagggcccgagagtgcatgtccccggagtcggttgtgtccccatgcgggtgcgaggctgggcagggctgccaggggttagtgccgtgggggtagatgggtgagggagggcctgtccctacgcacatggactaggcatgcccccgagtgggcatgcgggtcggaggacagggcgctcacaggacaggacagtctcctacagaggcaggggctgtgtgtctgtccccaggggctcctagggcttcccgtggcccagcccagggcagctgctgctggagggagggccacgctggcaaatcccccaccctgccgagggcagcccctggctgagccccaccctaggcggcccaggcacacctgcacagcctgggccagtgtggggacagtgggacccgctctgcctccctcatgccactcaggcctcagactcggcctgacccgtggaaagaaccatcacagtctcgcaggggcccagggcagcgctgggtgctttatttccatgctgggtgcccgggaagtatgtacacggggtacgtgccaagcatcctcgcgcgaccccgagagcccggggagcgggggcttgccggccgtcgcactcatttacccggagacagggagaggctcttctgcgtgaagcggttgtgcagagcctcatgcatcacggagcatgagaagatgttcccctgctgccacctgctcttgtccacggtgagcttgctgtagaggaagaaggagccgtcggagtccagcatgggaggcgtggtgttgtagttgttctccggctgcccgctgctctcccactccacggcgatgtcgctggggtagaagcctttgaccaggcaggtcaggctgacctggttcttggtcatctcctcccgggatgggggcagggtgtacacctgtggttctcggggctgtcctgtagggacagaggttggcacagcggtcactcccagggcagagggtgggtcaagctggcctctgtccatgtggccctcataccccgcgggtcccacctttggttttggagatggttttctcgatgggggctgggagggctttgttggagaccttgcacttgtactccttgccgttcagccagtcctggtgcaggacggtgaggacgctgaccacacggaacgtgctgttgtactgctcctcccgcggctttgtcttggcattatgcacctccacgccgtccacgtaccacttgaactggacctcggggtcttcgtggctcacgtccaccaccacgcacgtgacctcaggggtccgggaaatcataagggtatccttgggttttggggggaagaggaagactgacggtcctcccaggagttcaggtgctgaggaagagatggaggcagatgtgtcagcacccgactgggacctgtccctggatgcaggccactctagggcacctgtcctgccttgagctggagggcgaggcctgggctggcttacctgggcaccttgggcacgggggaggtgtgtcacaagatttgggctctgcagagagaagattgggagttacggggatctgggatggaggtggatgcgtcagcaccctgctggggcctgtccctggactcaggccactctagggctcttgtcccgccttgagctggagggcgaggcctgggctggcttacctgggcaccgtgggcatgggggaggtgtgtcacaagatttgggctctgcagagagaagattgggagttacggggatctgggatggaggtggacgcgtcagcaccctgctggggcctgtccctggactcaggccactctagggctcttgtcctgccttgagctggagggcgaggcctgggctggcttacctgggcaccgtgggcacgggggaggtgtgtcacaagatttgggctctgcagagagaagattgggagttacggggatctgggatggaggtggatgcgtcagcaccctgctggggcctgtccctggactcaggccactctagggctcttgtcccgccttgagctggagggcgaggcctgggctggcttacctgggcaccgtgggcatgtgtgagttgtgtcaccaagtggggttttgagctctgcagagagaagattgggagttactcagatctgggaagagagaaggtatctgagctgagtgagtagagagtttggcctttggggtgggcttaggtcaggggcagggtcctcctggatatggctcttggcagctctgagcgcagcacctgcccctgtgtgtgaagggcctggggtaggggcatccagcctgtgcctgcccggagcctggtggaaaaagccagaagaccctctccctgagcatgagtggggcgggcagaggcctccgggtgaggagtcagacggggcctgccttggtgccctgggctgggactgcacagccgggatgcgtccaggcaggagggctgagcctggcttccagcagacaccctccctccctgcgctggcctctcaccaactctcttgtccaccttggtgttgctgggcttgtgattcacgttgcaggtgtaggtctgggtgcccaagctgctggagggcacggtcaccacgctgctgagggagtagagtcctgaggactgtaggacagccgggaaggtgtgcacgccgctggtcagggcgcctgagttccacgacaccgtcaccggttctgggaagtagtccttgaccaggcagcccagggccgctgtgcccccagaggtgctcctggagcagggcgccagggggaagaccgatgggcccttggtggaagctgcaagagagatggcgccatgtgactgcggtgtgggacagagctgggcccagggcgcagaggcccctcggttcttgtctatccacgagggtccaggcagggtccagtgtctgggctcacgggcattgggtgtgcgcctggctggcgccacctgcctcaccttagccccctccctgccccaaagccaaggtcaggcccggcccgccccagaaagcttgcaggaccggtggccctgtggtgcccttctgcaggcacccctgcagcctaggaggcggggctcggcagccaggtcagcgctctgtgtctgccgggagtcagcacagtccagggcctctagcttggcctcagctctggccatcggtgccacctcagggacggctcatgcccattggccccactccagccttttatgggtgcctggcttgaccagtggacactgttctcagatggcttctcgtgggtcccctgagtcccctgaagctcctgaccctgccgccccagcgtggccctccgctagtgagtgggcctgacttgcccagggccctggtcatagcctgccctctgccctccaaggcccttttcttctgtgcagcagaggggccagacactgcatagggtcggcgcccttcagccccagggccccggaaccccctgccttggaatatcgccccgggagcctcctcctcagcctctcccctcctttccccttagccccagtgtgcagcagcccaggtcagggccctgagtgcctggatgccccctgcctcccagtgtcctgcattacttctggaggctcagtcaccacaccgtcaccctcccagccctggcctggccttctcagccaccagcccacctcctccctctctccagagcttcccccggcaaggtccctgctgggctcaacccaggccccccagcacaggtaggagccttgcacctgcccttggccctccccaccctgcgtggtgccaggacccccaggccacagggaggccccatttctctctgctgctggcccagtggccctggagtcccactgcaggtggggtgtgcccctgacctctgaggaagctaagcgccctgccctcagccaggccatcccctctgctcagccccagggccccgctcaccaccccttcccctcacctgcaccacaggctctggctgactctgcccaggccctgaatgggcccctctggctgccctctgctgctacactgccctgcaccacctccactcagcttcattgtgctgatggtcctggctcctggcagcccatcttgctccttctggggcaccagcctcagaggccttcctgcccagggtccgctggggccagccctgggaccctcctggtctcaagcacacgttccccctgcagccacacctgcccctgcctgagagctcagccccgagccctggaacgccttcccttctccatcccagctcgcccttgccaactgctcagtgggatggactcacactcccttcccggcaccaggaggctgcactgcactttcaccagccctcagctgtctgctgccggcaactacccagctcctgccaaagtctaggagctgcgtgctgcctcccaccgtccctgctcacctgtggctgctctgccctggtgctctgagctccaggagatgccccctgctcctcctgccccccacctgcccctgctcacctgcagcggctctgccctggtcccctgagctccaagagctgccccctgctcctcctgtcccctgaccctgctcctgtttgcctatggctgctctgcccttgtcccctgagctccaggagctgcccctgctcattctgccgcccacctgcccctgttcacctgtggctgctcttccctggtcctctgagctccatgagctgccccttgctcctcctgctttccaccagcccctgctcacctaccgatgatcttccccggctctctgagctccaggggctgcccacctgctacccctgcttcccaccagccctgcttacctgcagctgctctgccctggctggcagagctgcagaagctgccccctgctctgcaacctcccaccggcccttctcatcttctgatgttctcccctgttccctgagctccaggagctgccccctactcgttctacctcccaccaacccgtgctcacctgcgactgctctgccctggtcccctgagctccaggggctgccccctgctcgcccacctcccaccagccatgctcaccttctgatgctctgccctgatcccctgagctccaggactgccccctgctcgtcctgcccctcacctgcccctgctcacctgaggctgctctgccctggtcccctgagctaaaggggctgccccttactcatcctgcctcccaccagcccctgctcaccttctgatgccctcccctggtcccctgagctccaggggctgccccctgctcgtcctgcctcccaccagcccctgctcacctgcagctacactgccctggttccctgagctccaggagctgccacctgcttgtcctgccttccaccagcccctgctcacctgcagctacactgccctggttccctgagctccgggagctgccgcctgcttgtcctgcctcccaccagcccctgctcacctgtggctacactgccctggtgccctgagctccaggagctgccccctgcttgcccatcttccactgagccctgctcacctgcaactgctctgccctggctctatgagctccaggggctgccccctgctggtcctgcctcccacctgccctgcgcacctgtggctgcctcctcacctgtggctgctctgccctggtcccctgagctccagggtcttcctcctgctcatcctgcccctccaccggctcctgttcaccttcagatgctctcccgtggtcccctgagctccaggagctgccccctgttcttcctgcctcccacctgccctgtgcacctgtggctgcttggtcctggtcccctgaactccaatgcctgccccctgctcactctgccctccctcaacctggggcagcaacgtcactcggtccactgttgcccccctgcctgtcctggcaccctctgtccaggtttaggctgtttttcttgcctcatttttgtttttgcagcacttggcgtgttccctatgctgtggagcagccccagtgtccagtcaggtctccccaacagagccccttgcccttgcccatgtgcccctcctggatgagctcccggatcctcccgtccctgcactgctcctgctctggaagcctctccagaacctcagctcctcagtggcctctgctctgctgggtcagttccctgaacgcacggagcctcagcccctcccctcgccccaggcctgctgcactctgggcctttctgggcctccctggactcttccctcctcccgcccgtgcactcagcacagctctcccctcctctccgctgctgaccacagccctgctcccggccagcaggtgccccaaccccatcagctggctctgagcccagcccctgtgcctcccctgtccctgcctctgcctctgggctccttggcttccaccctcctgtcctgctgccacactcaccctccctgctctgctcccagctcacctgctgtccttggtcctggctgagaggagggccctacggccagctctgctgaccctgccctgggctccggtgatgctgccggcctggacaagcccctcggttcacctggggcctctcctcctccctctctctgctgcctcctgagctcaggtcggtcatgcccatcctggcatcaccccatggctggctctgccccatcccgtcatgttcctcacactcccagcccggtcgtcctggaggcctcagtcagcctctggtgtgtcctgccctgttggcttggaagcccctgcccacggtccctgtcgtctcgcactgggtgggcatcggtgcctgaaggctgcccacctcccctgtgctggctccgcttaggcttccatgtggggctggcctcgccccagcctctccccagcctcttgcagcctgttcagcagctcaggtccagaagcgccgatggctgcgcccaggctctgtccttctcctgagcctgtgctcctgccctgtgctgaccccactcaccgaggtgggggtctcagcccttcctgttgtggcgaggtacatgtgggcagccttgcccacgctgtcagctgccacttgtcttcctaggaaatcacagctcggcccccaggtccccaggggtgtgaactccacgctgcaaacactaagaacaggattgaaaccggcggcaccacttacttcctgaagttcccttttcttctggtggtttctgtgtcagagggcgagggggagtccagacacagctgaggctgcctcatgggtgtgtggggatgggggtggtggctgcccccatactcccccgtactcacgggagaaggtggggagcccggaccttgtgtgctgctcttttctctgtctctgagtccctggggctggactgagactggcaacgattatgaccattctgcccgtggtctcagcctctcaatacctgggcctctcatctgaagcttctggcccccactgggccctggtggctgcttttgcctgggcatctctccagctgactctcactcatggtgcagggaggggagtgtgagttcatcctgctgagcagctggcaaaggcgagctgggatggagaagggaaggcgttccaaggctcaggtctgagctcacaggcaggggcaggtctggctgcagggagaatgtgtgtgcttgagaccaggagggtcccagggctggccgagtggaccctgcacaggaaggcctctgaggctggtgctccagaaggaacaagatgggctgcgaggagccagggccaccagctgtgctcctgggggccgaggggacgtgggacaggcggatgaacacactgaggctgagtggaggtggtgcagggcagtgtagcagcagaggggagccagaggggcccattcagggcctgggcagagttggccagagcctgtggtgcaggtgaggggaaggggtagggggcagggccctggggctgagcaggggggatagcctgtctgagggcagggtacttagcttcctcagagttcaggggcacaccccacctgcagtgggactccagggccactggactaccagcagagagagaaatggggcctccctggggcctggggatgctggcatcatgcagggtggggaggtccaagggcatgtgcaaggctcctacctgtgctgggggagcctggactgatctcagcagggaccttgccaggcagaagctctggatagagggaagagctgggcaaggacgtacgtggaagtgggaggtagcagggaacggaatgaggccagagggcctcgggaaagcccgaggaggtgtcgcacaggaagtgtccagaatggaagaggaagcgtccagcaaggaacaggaagaatggacacttgtgaggggaaatcatgtccctcccactaaatgtgctctccacaaggacccggcccgcccttctgtccctgctggatccctgagctggcaccagccctgccctcagagagaacgtccaggagacaggtggaggtgcacgtgtgggtccctggggaaatccatcctccagccgcgggctcccagtcggctcccagcctctcgctccagcttcaccccatggagctcataatgggctcaacctcccagcctgggggaggacggagtgatgggccccacactgcccatggcacacccagggggctggggagactgcacttggctggggcagggaggccttgtgcagtctgtggggctggcagctcaggacaacactcgtatccgttaagtgcggccctggcaacactgcaccccagactgcgtggcttaaacaacagacgtttattccgtcctggttctggaggccggtcatctgggatggaggtctcggtggggctggctcctctgtgtcatggagactctgttccaggctctctccttgctgctgggctttgccggccgtctctgctgctcttggcttgtggaagcagcaccatcttcacagggcgttctccacacgtgcgtctgtgcccagattcccccttttcatgaggacagcagtcatattggatcagaggcttgccctactccagggtgacctcatccgaacttgattgcagctgcaaagactgtttccaaacaaggtcacattctgtggtcctgggggttaggacttcaacacatgaatttataggggacacattttaacccatgacagtttgccctccgctccccccataatcatgtccttctcacaggcaaaatccctgcatcccatagcaacatctccacgatggctaaccccttccagcaccaactcttagtccacaatctcagcgacatatcacctgcatcaagtgtgggagaaatgcagggtgattcattctggggtgaaattcctctccatctgtggacctttgtaacttgacaagaagttatctgcttccaaagtacaatgatggggcaggcataggatggacattcctattccaaaagggatacattggaagggagagaggagccatgggtcctaagcaagcccaaaacctagtagggaaaactgcattagattttttttgaagaaaacaatatacttttattttagctgtttaaaagttttatgattgtttttaattgacacataataattgtatatattttggggtacattgtgatatttggatacatatatacaatgggtgatgatcaaatcaggataattagtattgggggaacctgcccccaatatttcaatgtaggttctttctgttttccataattgttggccagctgagaaataaagagagacagtataaagagaggattttacagctgggcagccgggggtgacatcacatatcagtaggactgtgatgaccgcctgagcctcaaaccagcaggttttttgttaagggtttcaaaaagggagggggtgtaagcacagggagtgggtacaaagatcacatgcttcaaaggcaaaaagcagaactactaataagggtctaacaaagatcacatgcttctgagggaacaggacaaagggcaaaagcagaaccactgataagggtccaacaaagatcacaaggcaaagggcaaaaacagaactactgataagggtctatgttcagcagtgcatatattatcttgataaacatcttaaacaacagaaaacagagtttgagagcagagaaccagtgtgaccacaaatttaccagggtggagtttttcacccccctaataagctgagggtactgcaggagaccagggcgtatctcagtccttatctcagtccttatctcaaccacataagacagacattcccagagcggccgtttatagacctcccccagggatgcattcctttcccagggtattagtattaatattccttgctaggaaaataatttagcgatatcttccctacttgcacgttcatttataggctttctgcaagaagaaaaatatggctctttttgcccaacccctcaggcagtcagaccttatggttgtcttcccttattccctaaaaatcgctgttattctgtctttttcaaggtgcactgatttcatattgttcaaacacatatgttttacaatcaatttgtacagttaacacaattatcccagtggtcctgaggtgacgtacatcctcagcttatgaagataacaggattatgagattaaagtaaagacaggcataagaaattataaaagtattatttgggaactgataaatgtccatgaaatcttcacaatttatgttcctctgccatggctccagctggtccctccattcggggtccctgacttcctgcaacaattagcatatccatcacctcaaacatttatcacttctttgtgctgggaacaatcaaaatttgctcttctagccgtatgaaaatatacaataaattgttgttagttatagtcaccctatggtgttagagaacaccggggcctattcctcctacctgactgtaattttttatttattaatcgacttctagctatcctatcccctcccattcccagcctctggttaccactattctactccctatttctatgagatcaacttatttggcttccatatatgagtgagaacatgtgatatttggctgtctgtgtctagctttatttcacttaacatgtcctccaagctcatccatgttacctcagatgacaagatttcattctttttcatggcagaatagaattcctctctctctctctctctgtgtgtgtttgtgtataaacactacattttctttatgcattcatctgttgatggacacgtaggttgattccaacactggcattgtgaatagtgctgcaatgaacatgtagtgtagatgtctctttgacatagatttcctttggataaatacccggtagaggatggtgggatcatggggcagtactcatttccattttttgaggaagctctttattgtttttcaatggctgtgctaattccaaagacaagatttcaaccaataatgcattaaagctcccctttctctgaatctttgacagcaattgttttttgccttttttaataatagccattttaactggggtgagattatatcttattgtggtttcaatttgcattttccttatgattagtaatgttgagcattttctcatatgtctgttggccattcgtatatcttccttttagagacgtctattcagttccttttttggttttaaaaacttttaaatattttttcatttgcctatttttaataaaaaaatttgttttcttttctgtttagttgtttgagtttccaatgtattctaaatattagtcccttgttggatggagagtttgcaaatattttctaacattctgtagattgtcttttcactctgttgattgtttcctttgttgggctcaagtgatcctcctgccttggcctcccaaagtgctagaattagaggcatgagccactacatctggcctgatatcattggcttgttccagattttagagaaaagctttcaactcttgcatgttcagtatgatgttggctgtgggtttgtcacatatagctcttattgtgttgaggtatattcctttcatacctaacttgctgagaatttttatgaagggatgttggattttatcaaatactttttctgtgtctgttatgatgataatacggtttttgtccttcattctgttgatgtgatttgcatatgttgaaccatccttgcattcctgggataaatctcacttgatcatgataaataatgtttttaatatgctgctggattcaatttgctagtatttggttgaaggttttcatctattatcttcatcagagtatttagcctatagtttgctttttttgttgtgtccttgtctggttttggaatcataataataatcacataatcataatcataatcataattaccataatagtggcctcatacaaggaatttagaagaattccctcctcttcaattttcgggaagattttcagaagaataggtattagtttttttagtgtttggtagaattccccactgaagccattggattactgtagaattggcattttgataggaatgtcattggtatttcaacaggaatttctttgggctttcctttgatgggagactttttgttacagattcaatctcaatgctcatgactggtttgtgcaggctttctatttcttctgggttcagtcttggtaggttgtattgtccagaaatatacctgtttctgctaggttttctaatctgttggtgtatggtctctaattatcctttgtgtttctgtgatatgagttgtaatgtttctgttttcatttctgatttcattcttttgggtcttttttgtttagtctagctaattatttgtcatttttgtttatcttttgaaaaattcaatttttcattttgttgatcttttttttttttagtctgaatttcatttatttctgctctgatctttattatttctttctttctactaattttgggtttggtttattcttgatttcctagttccttgacatgcattttcaaggatgagatttatttgaaatctctctgcttttttgatgtaggtatttattgccataaacttccatcttaatgctgctttttgctatatcttataaattctagtacgttgcatttctattttcattttctttgttgacattctaaaattcccttcttaattcctattggtcactcaggagtacattatttaatttcccatgtctttgtacagtcttaaaagttcctcttattgatttcgagttttattgtggtcataaatgatatttgatataattttaattctttcaaatttgttgagacttgttttgtgacttactgtatggtttatcctggagaatattccatgtgctgatgaaaagaatgtgtatttcacagctgttggatgaaatgttgtgtaaatatctgttagatgcatttggtctaaagtgctttttaaattgaatgcttctttgttgactttctgtctggattatctgtccagtgctgagagtggtgttgaagttatcaactattattgtattgggatctatctcttcctttcttctgcttcatcatatctgctgttgaagctcattactgtattttttaattttattcattgaattcttcacctgcagaattttagtttgcttcttttttatttctatctctgttgaaattttcattcatactgtaaattactttcctgaattcattgaattgtttatctgttttcttgtatcttattgagttatcttaagatcattattttgaattccttttccagcaatacattgatttctttttccattgaggtctattaatgagagttatgttcctttggtggtgtcatatttccttgctttctcatgtttattgtgttcctgcattgatgtctgtgcatctggcgaaatagtcacctcttccaaactttcaagagtgggttttttagagaaacaatttcacctgcagttgggtttagtgttttggttgggaaagtgtgatgactctgtttctgaataggtgcagtggcatagcttccatgcgtcttcttcaactgcattcaacctcagcaataactgtgggcacctcagtggactaggctgtagaagtttgtggatgtagtggtggcacaggttaatgtactcagtgtcaagggcttttgtagtcctcctcttcttgtttccccacaatgaggagatttagtcaaggggctctctcttggtagcaggtctaatgtggccaacgtgcagctgcaatggtgctggattccaggtgcagaaaattagagtagctgtgcaactggagtcctagtctcctggtttcaagaatctactgtggcatctgggtcttggggtgtaggttcagtttctgtggcaggtttggattaggtggctcacagtgctaggatctgtgactctgaggtaccctttaacaggttttgctcaaggggccaggttgtagctgtgagtctattcctggggggtgcagcatttgtccaactctggggaagaaggggtgttctggaggtgtggacctggggagtatggtatggctgcaatttgggaagctgagccaatagggcacaatggaaactttggtcccaggggatgaggcactgtatggtattgactctagaccctaggatggtagggctcagcaggatcccagactatgtgagaccaggtacagtgtcagcaagtatcccaagatggcagagcatagctgtaatttgggccttggtggggagtaggcagggaacagcacagtgctgattctacttcccagggagagggtgcctcagcagctcagaccctaggggcctaggcaagctccagggaagcagggcactacagttgtttggcctgtaggctgagatgtctcagcttagccactgctctgttttcctggggcatagggtactatatcagctcagccttgggatgtgctgctgctcagcttaagccagggcactgattccctagaaggtgatgtgttgcttcagctcaggccttctctgctgtaaggaaagtcctgcatttatgtatcagagggtgtgattgttctgagtggcccaggcaccatttctgtaggatacaggttgctgcttcagcctaagcactgcagtgtgtgaccttctgggtggccaaggcattagttcctggaatgcagggtgctgcttcaacgtagacactagaaaggcatggccaaagtcctgttttgctaggaggcaagaaactgctttagcttggactcaaagggtcagggggaggagtgggtagagctgatccacttggctctgtggggaagggtttaatagatgcccatagcttgacttggggacgtgggaccactagtctgggttgttcagtggcagcttagcctcagagatgaaggggagctgtgactactcactccttgggtaagacacactccagccatagttcctattccagtgtggtgaagcactagccatgtgggagtggggtacggtgtcagcaccttttttggagagcacagctatgtggcctccaggcaactccctccagtgcaaactgcaggggaccccagtggcgaggtctgcaggtgtccgaggtgttagtgggtgccactgggatcctcttgcttacctcctcatgtcagaaattcctcctgattcccagataatcctggttgggggatggagtggtggaggccgtgtgtttccttctgttttctatgtggccagcccacatttctgtgcttatcagggtttctgttactcctctgatgcactcagtgctctccctcagttattttcgttaaaatatagttgtctattgacttttctggctttctttatgaggatgatgagcactaggggcttctagttggccctttattagatttaagtctcaagattcatcctcctcggttaatgctccatcttccaggcccactggggtggccccacactctgggcccaaggtggcaacagcagccccaacagcctcctcacctgtggctctgatctcaaagtcattcttccttcattttatctggtctcatgtatttatttatttatttatttatttatttgcatgataggctttacttttaaatgattagtagtacaccgagtaataacatgtaacaagttcttgaattctatcatctagttattttgattaagaagctgaaacaattatactagtaatattcactgttctaattattagcagcaatggactactttaaggctggctgatgcttcacacaggttacagaaactactactttttcatagataaagcccctgaccttcaaaaaagcattaaggaaaaaatgatttaattccttccttttttcaaaggattgttttgctttttcttttaaacttgatacaagaaagaaaacatcaacagtgatatatatatatgtatatatattgcttgagccaaaaggcataataaaatagacaatatttacccattatattcctaagaaacatgaggtaaaaagatgaaatctttaagttttttttttttgagacagggtctcactctagcacccaggctggagtgcagtggcacaatcttggctcactataacctctgccttccgggcccaagtgatcctcctgcctcactcttccaagtaggtaggactataagcatgtaccaccatatctggctaatttttatatttccttgtagagacacagtctcactgtgttgttcaggcaggtctcaaactcctgagctcaagccatctgcccgccttggcccccgaaaatgctgggattacaggcgtgaaccaccatgcccagcctagataaattctaagtctgtacaaagaaactggatttgcttctctccgaaaagtgaatgggcctactctataatatacagagataagttaatgtcttcttataagaatataactagagcttcttattccatgagggcatctaaagtgccagtccatttaacaggtgcttctctcttttaatatctacttatgcgatagttttcagggatttctggctggatgctgcagacaaaggccaaaaggttatctaagacttcttccctgttctgctggaagtaggtctggaggatggttatcctgggtctgcgagatcctagtgctgcagcttccttggccttgaactctttctccttctgcaggcagtgctgttcaatttcagcctaagctgctcctttgggctgcttcagcctctggttcttttgcttgtgggccccagacaccttcttggcatcctgcttctcggcctgcagcagctgctggatcacctgtgactgaccggccatggccgtggtgattctgagaccaaggtgagcagcctaaatcagcttgaagggcccttgggtcagctgacccagccacctcagcacttccctcttcagctgatctctctcttctcatattttactgtaagcagcaaggagaaatcaagaatgccttcaacaattttcttaggaacttcgtcagctaaacatccaagttcatcatgtataatttctactttccacaaaacggaacacagttcagccaagtgctttgccactgtatgacaagggtcaccttcgttttcaataacaccttccttatttctgtctggagcctcagcagaggcatctttaacattcacgtttctagcaacattctgttcgtgacaatttatgtattctccaagatgacaggagttttctctatagctctcctctttctttctgagcccccaccaggatcacctttaatgtccaaatttctaacatagtcttcaaggaaacctaggctttttctaacacacacctcaaaactcttccagcctctaccccttactgaattccacattttgctacttatgacccctgggctcactgaaaacttactgcccacttctgatccttcagtttctcctttggcaacatgcacaaagtggcctgatcttgttcaacccagttctaggtctgctaccttctaataccagggcagactcagccaagtcctgggctgagctggtgtgattgggcctcccagccctgtaccctgagggtgcttgggcttcactgggagaacctgaccaagtatcgttcagtaccatgcatgtcactcaatatcacccctagagatttgggggttagcagtaccatggagttcctgatatgatttagatgtttgtcccctccaaatttcacattgaaatatgatccccagtgttggaggtgaggcctggtgggaggtattggggtcataaggccagatctctcatgaatggtttggtgccatccccttggtgatgggtgatttctcactctattagttcacacaagagctggttgtttaaaaaaacctgacacttccttcttatctctctttctccctctcaccattctcaccatgtgacatgctggctccttttttttttttttttttgagatggagtttcactcttgttgcccaggctggagtgcaatggtgtgatctcggctcactcactgcaacctctgtctcctgggttcaagcaattctcctgcctcagcctccctagtagctgggactacaggtgtgcaccaccatacccggataattttgtatttttagtagagatggggtttcaccatgttggtcaggctggtctcgaactcctgacctcaagtgatccacctgccttggcctcccaaagtgctgggattacaggcatgagccaccatgcctgtcctatgctggctccttttttgccttctgccttgattgtaaacttccagaggcctcaccagaagcagatactggcattatgcttcttgtacagcttgtagtgagccaaataaacttccttttctttacaaattatccagcctcaggtattcttttatagcaatgcaaaatggatgaaaacagaaaattggtagcaaggagtgcggtgttgctataaagatacctgaaaatgtggaagtggctttggaactgggtaatgggcagaggttggaagagtttggagggcccaggaagaagacaggaagatgaggggaaatttggaactttttagagactggttacatagttgtgatcaaagtgctgatagaaatatggacagtaaaggccaggccgatgaggtctcaggtagaaatgaggaatttattaggaactggagtaaaggtgatgcttgttatgcccccagcaaggagcttggctgtattgtgtccatgttccagggctttctgaaaggctgagattgacagtgatgacctaaggtatctggtggaagaaatttcaaagcagcagagcatccaagaagtaacctggctgctttgaatggcctaaatcaaatatgggagcaaaaaaaatgacttaaaattagaatttataattaaaaggtaagcagaacataaacatttggaaaatttgcaggctggccatgaggttgagaagaaaagagccttttcaggcaaggaacccaaatgccttatggagcaaccacttgctagagagattagcataactaaaaggcaactaaatgctaatagcaaagacaatgagaaaaaggtcttaaaggcatttcagaagtctttgggacagtctctcccatcacaggcccagaggcctaggaggatgaaattgttatgggggtcagggctggggccttgcttccctgtggtatcttgggaggttgctgctccaggttcagccaaggctcaaagagtcccaggtgcagctcaggctgccactccagaaggtgcaagctggaagccttggtagcttccacatggtgctaagcccacaggtgggcagaatacaagagtgaaggaggcatggcagctcctacctacatttcagagggtgtataggaaagtctgggtgcccatccaaatcagtaaaaaggaagtcagactgttgctgttcactgatgatatgatcacatacctagaaaaccctaaagctcatccaaaaagcttctagatctgttaaattaattcagtaaaatttcaggatacaaaatcaatgtacataaattagcagcactgctatacaccaacaatgaccaagctgagaaacaaatcaagaactcaatcccttttacaacacctgcaaaaaataaaatacttaggaacatacctaaccaaggaggtaaaagatctgtacaagaaaaactacaaaacactgctgaaagcaatcatcaatgacgcaaacaaatggagacacatcccatgctcttggatgggtagaatcaatattgtgaaaatgaccatactgccaaaaacaatctacagatttaatgcaattcccatcaaagtgccaccatcattcttcacagaaatataaaaaacaattctaaaattcatttggaaccaaaaaagaccccacatagccaaagcaagactaagcaaggtgaacaaatctggaggcattacattacccaaattcatactatactacaaggctatagttaccaaaatagcacggtacttgtataaaaataggcattagaccaatggaacagaacagagaatccagaaatgaagtcaaatacttatatccaactgatctttgacaaagcaaacaaaaatgtaaagtggggaaaagatgtcctattcaacaaatggtgctgggataattggcaagccacatgtagaagaatgaagctggatcctcatctctcactttatataaaaatcaactcaagatggatgaaaggcttaaatctaagacctgaaaccatgaaaattctagaagataacattggtaaaactcttctagacattggcttaggcaaagagttcatgatcaagaacccaaaagcaagtgcaacaaaaccaaaaataaataaataaataaataaatgtgacctaattagacaaaaaaaacttctgcacagcaaaagaaataatcagagagtaaacagacagcccacagaataagagaaaatatttgcaaactatgcatctgataaaggactaatatccagaatctacaaggaattcaaacaaatcatcaataaaaaaaataccatcaaaaagtgggcgaacgacatgaatagacaattctcaaaagaagatatacaaatggccaacaaacatataaagaaatgctcaatatcactaatttttggggaaatgcaaattaaaactgcaatgagataccacctcacttctgtaagaatgaccataattaaaaattaaaaactaacagatgttgtcatggatatggtgaaaagggaacagttttacactcctggttgggaatgtaaactagtacaaccactttggaaaacagtatggagattccttaaataactaaaagtagaatcaccatttgatccagcagtcccactattcgatatccagaaaaaaataagtcattatatgaaaaagacacttgcacacacatatttagagcagtgcaattgcaactccttgtaattgcaaaaatatggagccagcctaaatgcccattgaccaatgagtggataaaaaatgtggtatatatacaccatgggatactactcagccataaaaaggaataaaatagtggcatttgcagcaaactggatggagttggaggccattattctaagtgaaataactcaggaatggaaaaacaaacatcatatgttctcacttataagtgggagctaaactataaggatgcaaaggcataagaatgatataatggactttggatacttgagggcaagtgggggatggaggtgagggataaaagattacatattgggtacagcgtacactgcttgggtgacaagtgtgccaagatctcagaaattaccatgaaagaacttatctatgtaaccaaaaacctaaaactattgaaataaaaataaaaaaagagagagacaaaaaagaaagcctgggagcccagacagaaacctgccacaggggtggagttctcccacagagcctccagtagggcagtgtggagggaaaatgtagggttggagccccttcacagagtccccagtggggtactgcctagtggagctctgggaatggggctgctgccctccatacccaagaatggtagagccaccagcagcttgcgcccagagcctggaaaagattcaggcactcaactacaacccatgagagcagccatgtgggctgcactctgcaaagccatgggggcagaccagcccaaggccttgggaacccgctcctcacaccagtgtgccctggatgcaggacatggagtcaaggattattttggagctttaaagtttaatgtctttctctcagaattgtgtggggcctgttgcttcttccccctccttcttttggccaatttattccttttggaaggaagggaaatgtttacccaatgcctgtaccatcactgtatcttggaagtagcaacttgttttggatcttacagcctcataggtggaaggggcatgccttgagtctcagatgaaacttcggagttttgattgagtagatcctagaacaagttgagattttttgggcactattgggaagggatgattatattttgcaatgtgagagggacatgagatttggggggacagtgtggagtgacatggtttggatatttgtcccctccaaatctcctgttgaaatgtgatccccaatgttggaggtggggcctagtggaaatgtttgggtcatgccatggatccctatgaatggccttgctgccatcctcttggtgatgagtgagttttgctctactggttcacacaagagctggttgtttaaaagagcttggcacctcctctttccctctcttgctctctctctcaccatgttacatgctctctcccccttcaacttctgccatggttgtaagctccttgatgccctcaccagaagcagatgctggcaccagggttcttttatggcctgcaaaaccctgagccaaataaacctcttttctttataagttactgagcctcaggtattcctctacagcaatgcaaaatgaactaacaaagccagttgtactttaccatccaaccatcatggaagctacaagaggaattgtttctatctgattctacactccttttcagcatcagaatgttctgggagcaccaaaagagttcaggtggagatgagaatggtctctcctctgggtgcccacccctgatagctggggtgagctgttttgcggatgggaagacttggtagtctgctcaggttgacagcctgacagcctacagtgtctgacaatgagccctgtcatcacaactcatctgttatcagctctgacaagcctggccctcagggtctctctcaagctggatccccgaggctgtgggtgccatgacccacctggctctgctaacatcctccaggctggctccccacctgccccacagcctctgcccttggagtggactctggcctgcctcactccttgggtgctggatgggtcagctctttgggtgggctggctgcctgcaggagatcagaggaaggggatgctgatgctaagtggtgaccctggctctctccttgcagggttgcctggaccttattgccttcctcaacagacagcccaaggagcctctgttcctgcagatctcggagcggctctctctcctcctccagtgtgtggggaggtgcttgctcttgtaggggaagaaacatttttcccccttctacccatcttaggttcattagctggggtcttgtcaattagattaacaagatactaacatgagaaaaacaaacagaagtttactaacatgtgcattatgcctctatgtgggagccgtcagagatgaggaattcaaaggggcggttggaacgtgagcttacggagcatcttagcaaatgggcaatcatttttacagaattggcaagacaaaggaaaggggctttcaacctgtagggcagcaaattctgggaagtaaatatataggggaagctaacagaagatagcttgctagtttgttgtgtagattcctctagtgccttctctgggctgataagcatctagagttgtctccaaggactaagaatcctctgcttttcctggtagaaagggagtgggcagggatttttttcttgggtatgcttctttttaattgtcttcggctcaaaattattcttgtttgaaagtggcatattctgctactcttcactctgccggagccagctctggagtcctcagtgtcccaggggctcttgcactgagcccagatctgtgtcagcaaggtgtccttccattaaatcctgcctaaatgacttagttggaggtgcaaacccacagagcattgctggaggcatgtgggagagtggctgtcaggtgttgtctttgtccattaaattgctataagggaattcctgaagctgggtaatttataaagaaaagaggtttatttggctcatggttctgcaggctgtacaagaaccatggtatgtgcagagatcacatggggagagaggaagcaagaaagaggggagatgccaggctcctttcaccagccagctctagcaggaataagagtgagaactcaccctcaaaggagagcattttgggatctgcacccaaaatccaaacaccttctaccaggctccacctccaacactgggggtcgaatttcaacatgaagtcttgggggacaaacatccaactatagcaagggtcctgcagggactctctccctcccacttaacttcaagcttgagtgggtgatagaatttggtgtttggtcctgacaggatttgcactgcccaagtctgcagctacagctttagaattggaaggcccccttcacctccagggtgtcttgtgaccagggcaccaccggtgcccactaaggcctgcccctgcagcctggtcacatggggtggaggtagagtcaggatcttgattggcaggcagctccacccagaggagcaacctcctgactcccactgccccccacctcccacaatggcataccagcacccatggcagaggccacgaagacacctagggacacttctgggtcagaaggggtgccactgacggggtgagctccgtg

SEQ ID NO: 650 - DNA, 35108 bp, Homo sapiens
gtttttggtggtttttttacacaaaataaagaaactatgcacatggcctcggcctccgggtccggcagacggcatggctcccaccgagggccctgggtcccggcccagctggcagccgcccctactccttgccggcgtagcgggcctcattgatgctcctgaccgcgcggttgtccactttggggcctgaggcccagtgggccggcctccccggcgagcggccaggatctttggtgaatttgtgtgagaggaacttctccgcctccagggagtcctcctcaccgcggcccagatcctcgtcctcctcatcctccctgacggccgcgtggccggccggcccgggcagcgcctcgtccgccctgcgcggcggcggcgtgaagttcttgcactggtagagcacgtccttgtggccccccggccgctcaatggggttgcggatggggttgagcggggcccactggttgttggcgctctcctcccgcggcagccggctcctctcccgctctttcctgcgcttgcgtgtccaccacacgcacaggaccacgcacgccagccacagcacgctgaaggcaccacacagcacaggcaccagcagacctggggaccggggagaagagccggtgggcaatgaggcctgggcacctgcggggcactagccacacacccaggcctgggagggccctgcgggccaggcggccgggccccaccctccggttgctggctcgtggggagggtcccaggacgggggctgggaaggtcaggttgtggggctgggcggctggggcagcaggtgccagggacttctgtgttcctggtggctggcaggatcggcaggatcggccggctctgtgcccaatgcctgagttgcctgcctggtgccttcccaggggcccacctcccgcgcttacctgtggaagagccgcccgtaacaaccgtctccaccttgacctcggtgacagccaggagcagtgagctgttcccccgctgggtgatggcggccacgatggcgtgggccgcgccctggatcaggctgctgtcaggcaggtccctggcagggctgaaggactgcggcaaagaacggcattgtggggatggctcgagggctccaggctcccagcagcctgcccccaacactgaggccctggccacactggagcaaggtgggcgcacgggagacgagagcccggggtcctgcagtggcgacttcaccaccaggcagtgagtggggagtagcggggggaggagtggaggggtggaggctgtccccatccgggcacacaggagagcccagggtcctgaggtgtggggacctcaccaccaggcagcgagcagtggggggaaggggaggggtggaggatgtccccatccgggcgcacgggacagcccagggtcctgcggtggggacctcaccagcaggcagtgaggggtggggggaagtggaggggtggagggtgtccccgtccgggcacacaggagagcccggggtcctgcggtggggacctcgccaccaggcagtgagttggggaggtgtgtggccccattcgctgacacctgctccgtgatggccatcccttcttgtcagttcccagcccccacccccacctatgggccacaccccaggggcaccacaaacctagtgccttcacgaggccacagcaacccggggctgtgcccctgcctccaccacatccctgatggcgccctgacctgtgctggcacacttcttacatcttcccctgcccctactgcccttccatcacccagcagcacccatccatgtcccccaccccctctgcggcctcagggcaccaaaacactgcacgtccttcctgtgcctggccatggcctccaccagccacactgtgccatggccacacccactgctctgcacacccacccaccatgttccagaacattccctcccctctccgggcatgtctccaccccagtctcacccgacccccttggtatccattcacatctgacaccccccaggtccagggcaggtgccagtcccaaagcaggcctcccagggcagactaagcccacggactctcctgctgcctgtgacgtagggacacagagacaaaaacagagcaggggaccgggcgaggatgcagctgcaggggaagcgggctccacaccacagccctgcatctccctcatgctggccaggcccagggagcagttccacgggtctgcggcatggacagcgaggggccgcagggagacaggcctgcccgcagtccttccgcaccaggactagcctcgccagagcctctgtccagcatagccaggacctgcatagtacgggacccagggcccacccaggtgctgctccccactgggcactcaccacggccacctccacagcactggcccccgaggacgcccggtcgcaaagcaacaccagcaggcggtcccgtgccacagcccttgtggctggcagggagcggatcccggagcaaatggcgcccaccgtggtgccctgggcagagacaggcagtgcgtgggcagggcagggccgtgaacctgacacctacatccctggactggcgctgtgggtacacgtgggacacaccctacagcccgcccaggagagcacagcaaggatgccaagggcctgggggggcagcttcccacccggctgtgccctataccaggaggcaggagtgacggtgcccacccgcccatcctcagggcggacccagctccacctgcaggccagtgggggaaggagaggcagggcggggtacagtgggtctcctccagttctgagcccctcctgggagacaggggcccagctccaagcacacagcaggcaaaggtggctcctaggccagggcaaaactgcccacggagctacagcccaagagctggggccaggcagccatggcgccgtcagtccaggccctcagggcagctggacaaacaggcacccccagctggctgctctcccagcctcctctgccacctccacccagcaccaggcccaatgcccctctcatctgaccccacagggccactctctgtgaccaagagtgactctgctcagccaaccagggcctccctgccctgcggggctaggctttcgccatgccacgagcagatgccggcgtgtggcctctgcaagctcagatgccaccaggcccctcacctggggcacgtggtcacggttgaaatgcaaggtgaggcgggcacagttattgtccaggtggccggagcgtggcaggcagggggtgctcggtggctcttctgcgccgcactccccccaggcctcacagggtggtcgcagacactggcctggggccttctccaggcacctttgccccagtgggcactgggcgctcagggcctcgggctggccggccagcagacaaggcttccatccgcaccacacctgggcaggcacgcacaggagggtcaggcgcaggcgcacaggagggtcagatgcaggcacacagatgagaacccacaggcaggcacgggccccatgccaaggagggacaccgcccaagtctgtgagccccagggcccagcccaccccctacccagggctcccagggaggcaggccaagctcgacatcagaaagggcaggcggagcaaggcaggacccagaccaggcctgttttcccaactgcacatcgaagcatggggcctggctgagctctcgcctccctgggtgtccctgagggcagacggctctcagtccatccggaccccagcacccgcctcctgatctcacagagtggccagggtcagcgtgcaccagcctcgggtagggcagggcggctcacgggctgccctcaccttgctgcagtcacggcggccatccaggcagcggcagctgttgcagtcttccacccaggagcttccgtgtgggaacggagtgccccgggaccagcaggatctcccgaacccgatcactgtggggagaaggggctcgagggtcagcagtgggcatctggccctcggggctgggtgtcacccatgccccccaacccgccccaacccagggcaatcacacggggcctaccttcctggcaccgggggccggctcggccgggtgggcagctacagcgatacccgttgatctcatccacacacgtggccccgtaggcacagggcgaggactggcactcgtcgatgtctgcagggagagccaccgctgctcagtgcagtgaggccaacgcccaccgcaggaccggcatggcctagggcagcggggagccagtggcacacaggcgcaagccccaggacaatgaggagcagcccctgcccccgagcccaagctgctgcctgcctgaggccttcctgagcccagcctgaccctggcccaacagcaccctcctccgtctgcttctgcagtgggcctgtcccatcctggattagccccagctgctgcgtcggaccagccaaggggtgctggacagacagctgggccaacacccagggacaacagccctgcggccacagaggagcccacgtcaggctgcacgctccaacccccacagctccctgggccccggactggtcccccaggctggggctccccacttaatcacttggcagggtatacagcaggaaccccacagggcacagacatgtggggaaactgaggctcagaagagaggcaggaagtagttgtggccacactgcccttcaagggacgtggacgttgatgtccccagactcctgacaccgcggctgggctgaggggctcccagggctggggctgtctggccactcactgatgcggcagtcaggccccgcgaagccaggtgcacactcgcagcggaaccagttgacgccgtcaacacagatgccaccattgtagctgcagagcagagggtgggcatcaggtggccccccgtggtatgccaagtcccacccacccctgctgtggcccccagggtgccactcaccaaggcagagggttgcagtcgttggtatctggtttgggagaagagaacgcaggggatcagtacccaccccccaagcgtgccaggcactgtccaggctggcttggcgtgatcaggctgtggggctggggagggtcatcaaggagggtgccttttgctgggggcaggggcagcagggggaggggctggcagaagggactggggggcgagtcgggggcagggatgtcatctgggtggaggaaagcggcccccgcccacacccctcccacactcactgtgagtgcaagtacgaccctcccagccgtcccggcagatgcaggagaaggaggccccgctgcccacgcaggtgccaccattcacacaggggttgggcaggcagctgctgttcttggctgtaaggagaggaggaggagggagcgtctcacctggccctgggctggccctgggtctccataccgcgcccccaacccagacagggcagacagacccgggggcagggggcagggggcaggtggcaggtgtggccctcaaaaaagacccctcggcccatcgcgcccgagggagcggtgcctgggagggcatatgcccggcggtcgcagaggcagcgggggctcctcaccgacggcgcaggtgctgcccttccagccgggggggcaggcgcagcggaaggtgtcgccgctgtcgtagcaggtgccaccgttgctgcaggtgtaggcatcgcactggaactcgcctgttggcacatgggccgctcagcaggcaggccccagaccgccagggccagggtcctgggggcagccccaggcggccagggcctgcggacactcacgtgagtggcaggtcttgcccttccagccgtcgtcgcacgcacagtagaagtcattgaccaggtcgtagcagcggccgcggctgtggcagggatcgggaaggcagtcgttgggatctgggggcgaggacgccggtcagcgggcggggggtcaccggcgctcagggagggcttcccgggggaggaagcactggagctgggccaggtgaggacagagaggggcgggggaggagcgtcgggccgggggagctggcctcgggcatgggggcagcctgggactccaccccatggtggcagcaccccctggccaggcctttctgggtacggggcctgccgcacccagacagcggtccatctcagggtgataaggggcccacaggggtggaggcacaggccgtgtgggcgggtgctggaacactcactggtgtcgcagagctcgccctcccagccgctggggcagaagcagcggaaggcgtccacctcatcgatgcatgtgcccccattgcggcagggctggcccaggcagtcgtcaatgtctgcagaggcgagcggggtgagccagggcctcaggccagcccagccccaccaccagcccgccgttcgtggccactcactctcatggcagtaggtgccagtaaagccactgtcacagatgcaggaaaagttgccccctggctggctgacgcagcgtccatgggggccacacacgccggaggctgctgtgccaggcatcccaggccccgcgtctgacccgcagccatcgatcactatggcaggcagtacagtcaggagtcaggcccgcccctgccccaccacctcccccaccaccccatgccgcacccagcacctctgcaggccccgccagggcacggctcgcggggcacggagcagttcttgccaccaaagtcatcagggcaggcgcagtaatagtcaccctccaggttatagcagcgagcgccgttccggcaggggcttggctcacaaaggtcgacatccacctgcagggtggggggtgcctgtgagagcctaggcccaggcccaggccgggaacacaggccaggcctctgtccatacgaaggtagatccctggggacccccaggcccctccgccctgggcctaacagtgccagccagagcccaagacccctgcccacctgagactgcccaggccttagctgaacgcagatacctgtgggcccccacccccacctccactgcagcccagcttcctcactgtccctcgggaggagtgtggccttggcccctgctgctggcaggaaggacagctcctgagcccctcacacactgcctggccaccctcagagccaagactgtgggtcttttccagggccagccactgccatgcttgcaggtcctgaggtcagacccctgccctgggccccaagaagccctctggacaggaggcccatcctctgcaccaaggccagggcaggatcgtgggcggccgagggtggtagggaggtgggtggggggaggcagggaaaaaggggaagtaaggggagggggtggtagggaggcaggtaatggggaggcagggttgggggaggtggggaagggggtggtagggaggtgggtggggggaggcagggttgggggaggtggggaagggggtggtagggaggtgggtggggggaggcagggttgggggaggtaggggaggggtgatagtgaggtgggtggggggaggcagggttgggggaggtggggaagggggaggtggggaagggggtggtaggggtggtggggaagggggaaggcaggttactttggaggcaggggggaaggggaggttgggggagggggtccagtaccaacagatggtcagagggaggcgagagcatcagccctgagagagatgcccactccgacccaggactcacctatgacaggtgtatacctctccaccatcaggcacccaccctaccccatgtgctctgcccaccagagccccctgccctccagtcccgagggagtgcacagatggacagataggcctgggcagccagcagcccgggggctcctagcccaggccaccaggaaacccatcacaacaagcaatggccacagggggccaagcctggtgacctgtgacagccccgcctgcccacctggcacccagtggagagctgagcctgggacgccttggggacaacttcccctgcagcacccctgggtcactcaggccccatggtcaggggacgaggcctgccctacagctcccagagcagcaggtggggcagggtgaccaggcagacctcacctcacagagaggcccggagaagccctgggggcagtggcagtggaagccgtcggccaggtcctcgcagaggccgccgctgtggcaggggctgctggcacactcgtctcgttccagctcgcaatgccggcctccgaagccccgtgggcacacacactggtacccgttcaccaggtcctgggcgggccagccaggtgagcgtcccgcaggcaccctgacggccccgcagcacccacgccacacaccctcctggccccgcctcaccttgcaggtgcccccatgctgacactgcccgcgacagtcgttgacgtctgggggcagaggagcagggtcagaggcggggtcccatgtgcctcggcccacccgccggcgcccaccccccatactgactgatatggcagttgatgcccttccagcccgggatgcaatcacagtaatagccgccaatcaggtttttgcaagaaaaagcgttaaggcatggcttcccttcacactcattggcgtctgtgaaagagacaaggtgggagccgtggggctcgggccctgcctgccccctgcagcacgggcacctggcacccgcagcccagcagccccagcagccccagcagcccccgcagccccagcagcccccgcagcccgcatgcgcggcccacgttcccatgcactcgctcggagcccttacccagctggcaggtggcccccacccactgctcggggcagatgcactcaaagccgtccacctggtccacacaggtgccaccggccgcacacgggttcgaagcacactcatcgatgtctgcagagggtggagaaaggtggggccctggcagtgtgagccgtgggaataaggtccccatgggcaggtggcgctgcaagcctgggtcttcctgccatttgtcctcgccaagccagccgcagccacacgtgtggacttgaccactgcaccccatccccagcgagttgccccactcccagacccccactgatactaggcaggagtcccctactcacgtgcagacactcaccaagggcacaggtgggcccgctccagcccgatgggcagtggcattcgaagccggacggcacctcatggcaagagcccccgttggcacacgggttggaggtgcaggcgtgctcagctgtagaaccgcggggagggggcagagctggcagccaggcccccagctttccacaagcactcctccccaagcccacaggttcccaagctgggggtcaggggcccaccacacaggacgccagagggatggggcctgaccggctccccagggaaccagtccctgcctggccagaatttgggtggccagccccccacgtacccttctcacagttcctgcccgagtagccgtcagggcaggtgcagcggtactggtcaggctcggcgttgatgcacgtgcctccgttggtgcaggggtggtggctgccacagtagttcaggtctgggggcaggggtgggatgctcaggggaaaagccggccccccgctcccccacaacccacacttcgatggcagagcattaggcctgccgccccctaccactacctttgtcacagagcaggccgccccagttggtctcacagttgcactgccagggctccacacaactgccatgcacgcagccggggtaggggacacactcatcgcagaacctcccttgccagccgtagctgcacctgggggaaggaggaggggcgcaagacccagtgagctgtggtgcctgaaagggtggcaggggagccaggcacagtcacccacgccacacccagggccggcgggcggcctcaggcctttgaactggagcagccccagccaggcaggggttgcagccctgccggccagccccactgtcacgggcattcccggccgctggctgccgacggtcagccccagctgtcccgtcactcctccctgagctattttgggattcacccgtgagctgggccccgagagcaggcaccaggaaaggaaggccctgccgggaccccggggatgagaatgccggctcggactcacaaggtgctgccagggccgggaggcaccaggggctgggtaggccagcgggcagcaggggagcactcctggctctgcctcggccatgtggccctgggcacagcacgtgccctcgcccccacctcaaaggcagtcatttcgctcgctcccagtaaagtcccacaaggtacccatctcacagatggggctactgaggcccacaggctggcctgggccagccctgcccagggtagttcctgattctgcaggagctccagctgcacccccagctgcaccccccaggacacaaccaccaggactcgccctgccccaggctatcggccaacgtcctgtcttgggagtcccccaggagagggcaggtggccagggtagaacatggcctgacttgagggtgcctccgtcaggggagagagcctgcaacgaccccaaggctcagcaggctgccatccaggccctgccgggactcccggggggcccttcctagaactctccggtcctgcaggacgggaatgtcatccaggccacgtcacttccacaccggcacccgccacactttatttttgtaaaaggaaagaaccacggcccttcctgagccgccctcaagccacacagccagcaccgaaggcctatcagcccagttcagctgccacaaatggggaaactgaggccgggaagaacgtgtctccagtatccagcccagcatgcacagtggtccgcgtgggtggcctcacatcccgcctagaatccctcctccacagacacagagacccaggctcagggcggggctgtgacacaccttgggtcatcggccagagagcggccacagccgggctcagagcccagacctcgtgggtcccaagggcgtgctctcgaccctgggcagggcagcccacaccaggcccccacctcctggtttccccagccagcagccccagggccctggagaggcggcggcaggaaggcatggccatctccgcagcatccggtgggggggcgtcctgcactggaacctgagccgaggctgtcagcaacagctgggcctccccgacagggccagcaagaggggcaggcggagctcacctactgcccccacccaccaggccccccagactccggctcatcttcctgcgggtaaagggcagggatggccaacttctctgctgccttcctccagccttggtgtgacattcaagctgccagccagcagccatccagggagggtggcactgccatccaggttgtgtgatgcacactgggccaggcgagggtgagtggggccgactcccgtagatctacatctacatctgcccagaccaggtccaccttgttgcactttctgagctgacttgggactcgctcaacctgccgggaatccctgtgtgtgcaagtgaccgggtgggcggccccagccctgcttgcctccccgctctgggactggccgggaaagctcctcactgtaccctccaggccactcaaccgtggggcctgtggaagggtcacccacctccccaccttggctcccaactcagctggttcccaaactccccgactcctctccaaaacgccacgctgtgtgaccctggggaaatcagtaggctctctgtgccccagtgtcctcgtcccatggaggcaaacccactccacagagggaggtcctgggacccctgcaatccaaggctggctggagggcggtgctcacctccacctgctgtctctccacccgctcgcgcccctctctcgggctccccagcttgctcacgcacagtgagcgccacggctcgaagcccgtgcccaccccagaccctgggccccagcccctctggttgccctgctgacttctctgctccactctagggcaaagctgccagcccccctggctggatcccccacactctggtctgggtccagaggcctccaccatctggacttggctgtaagaccccggacactcccttgtggaggcccttgctgactcctcatccatccgccctgacctgtggcagccgggacttgctccttggcctccctcctctctgccttccccactttcccgtcaccgcctgaatgccaccccccacaggccccgcgtggcgcaggccaggcctctcccacgagctttctgggtgtctccagggacagggcaggcatcgcctctccacatccagctaaccccggccccgcctgctcctctgtggcattcctcctgccaccatggctctgctactcagcagcttggggttctccctgactccacacccttcctgcttgatcaaatccatccacaaacccctgggctccaccccaggatgtctgcaggacccgtgcgcctctcccccttccactgaccccctccccatcccgctggcccctcccccaccacccccacatgccccacagcggcctccccctcacagcctcccgtctggtgcttccccactcaacagctaccacagcccttccacccaccttgcccagctacaaacctgccagcagccccttcctctgtccctggtcctgcaggcctcagctcccaccactggtctgctctgccgcccctcgcctgctggtgtcacttgccggccgctcgccgcccaccccctccccatgggcagggttaccgtgtcctctgcccatgccccatctctgggtggcttgcagcctccgggtctctgcccctcggtgacgtgactgtccagccagcctccccagtctctcctcactgtcctcacatggctgccgccatcagacacatcccatgctcagacacgcacctactgcactaaggagcctcccgagctcagggcccggctctcacagctgtgtgcccaacctccagccagctccgggcgactcctgacagcaaggctgtgtgtgccagtgaggacgtgagggcaaaggttgggagggcaaagacgggccggcggcacactcacctgcactccccaggcacggtgcatcccccgtggagcaaattacacccttgtttacacacagctgcgaacagagaggagcgagaggcacagctgcagccagcctggccgcaaggcctgtgcccggggccctgcccgaggccctccctgccctccacgcagcccagcggccccctcaccttccttgcactccttgcccatccagccgtccatgcaggccttgttgccgtactggtcgcaggtgtagtggccgaaaaagtcgttgcggggccggcagaacttgttgcaagtggcgctgtagtagttctcgtcgcagcgcacgcggatctgcagctccaggtgcgccacgtggccgctgaagtgcaggctcttccagcggtcctccgggttgatcatgccggcatgcgacactcgctcgatcagcagctcctcttggggaggcggcagagtcagcacaggccagagaaaccagcccggccaggggtcctccaggaacaacggggacggggcagaagcctgcggctgctgcaaggccggggcacagcaggcagcagcacacggagggcagggcccccggccaggctgctacagaaagctcagggccccgagaggcctctccctcccgccaccaagcctgcgccccgctcccaccctaaacgcagagggtcggggggcccggctaggggctaggggccctgcagggagggctgctgagaccacaggctccacagagaaggcacggctgctgccagggcgtgagtctcacgtcccacacctgtgcccacccacctgcagccctgctccaacacctgcacccacctgcgccgtgtccagccctcgacagcacggacatggtgctcagttgccctcccctctcctgcgctgtgacttgctcccagaagtgccaaacaccactaccgtccccaccttaagacaagcctcccctcaggcccccaagacaggcataggtcccgtgacccgctgtctaagcctcactttaagtaagccaccaggagaccaggggccaggggcaccacagctgctggcgctggtatgcaaagtccgtgatgccggtccctgcgcttaggcacaggctcgacgttttgcacaataaaaggtgaacgggtcctccagaccccacctctcccgcctcgggccaaggcctgggaggacactgtgctggcccactccccaaggggcgtcccggccgccccagcctctccaggctcacgttgtcaagagccctgacgaccttgcttgggactcagcccacctgtctctctgccaccccctcaggaaacacccctgccctgagccgctggggtccccacaactgctgctccccacctgggcacccccaccgccgtccctgccctgaaaacagcccctccactctgctggcagccaggatgccctggccccgctctccctcctccaacccattggccaaccccatgcctccacttctgagagcccctctcacccccagactgcccctggtccaagtcaccctgacacgcccagattcacgtggcagctcctcctcggtctgtgtcctggccccacagcccaccctccataaggcagccacagcttgccaggcggagcccgtgtcctctcagtggcttgccagcctccatgatctgagcccagccccggctgctccccctgcacagccagcccgctcctgcccagaccttcacacgagctgctcccttggcctgtgggtgcttctgcattcacccatggaagtcatcccgttacccctgcagggccctgcagagcccctgcctcagggagagggccaccaaggctccatgctccagtacagacaagcagagggggccacaaagccagagacacactcaagggtgtcccctccactaagtcactgccatgggccccaaaagagcacacccaagaggagaacaacataggcaaagccaggactggggaagagagtgcatgcacagctctgcaagtcccaaacgtggcagagcttcctggcagccaaagcaaaaagggaaacagcacacatgatcctcagggtaaagcaaggctttgtcccaagcagacagaggagctgggccctgccacaggcacgctgaagctgagaggagctgccacctggcccagggctcactcaccattcggggtggtatcgttgtcccagtcccaggcctccacgatgagggtaaaggagcgctgcagacatggggaggcgggtcaggtacctgaggccacacctgcctgcctcgttcagggtgggacaaggcccagggctcagacgctgcccctgggtctgccaggctctggcccttcctccccagccagggacccaccaccctcctcatcctcaggccacatcctctgcagacccaaaaatgacccagctcaagggagggagactgcccctccaggccacgcgggctcaggggcctgggctccctaccgttggggtgccagaggcccagcctgccctgagctggctcaagtcagcacggagcacaggaagagcgaccggggggagaggtgggcaaagggcagcctggctggagtggccacagacaggggccccatgggcagccgggacccgagcgtttcctgtggaacgccccttggtgcctcactgggggtgaccacgggggagaacgtggggccccatcaccacgctggcggcctccaccaagtgcacggggtggccaagtacagggcgcccagccagaggccccaacaggccggagctcaggtcctgcaggcatacagcacacaggcaaacccacacctacctccaccctcacacagaacaggtggcaggaggggcccttgcggtacagttggggaaactgaggccaagaggtcctgggactgcccagcacagcctcagaccatggccactatgccccctctgcccccgggccacctggcccttgtaccccagccatggcgacaggcgatgctgtcagccaagcaaagagaccacagggctggccccctgctccgcctagtgcagcccacggagaccgtcactcacagacatgctcagacaggtgggacccccgggacatgccctgtactacccagcactgggtacccacattccacagcctctcagccctcactgcccaggaaccccccagtctacccctggtgtgctcttgacccctgagcccagccctggctccttccaggtggggcccagaggagggggctggggctgagtcacctcagggcctgctggcttcccaccccggggggatgctgcgttgggcagtgtccaggcaggccaggctcactccatccctcagcacaccccatccaaccagccccaaggcctggctaagctggggaaaaccacacttccccagcaaggcccaaccccacgcctgccagcccttccctggtcctcacccgccgcccaccccacgcacgtcccagtgcctcggcctcatccagctaaggacaggcctggcctcccaagatgtctcagaagactgcactcccacgtccagcccctcccctaaccaacgtgctaccagccacacccagcccagcctccaggacccccacccagtcccccgccccacacctccgactgtccctcaaatacagacaactagggcccaacatgactgctgaccctgggcctcactcacagctgggcaaccccggccccgcccccgagcccctgcctgcagaacacccggggacggcccgaggaggctcacccaggtaggagcacaggatggaagtggggggccatccccaacccgctcctagaaccctccctagccacgtcgagctgacaacagaccctcaatcccacctcttaagctccccttaaacccgttttcccacatccgccatggccccgccaggccacggggcccagtccccgcccatctccagggctccctgaggtcaccagggcccgcaaacctctgcctacaggcgccagacaatccccagagttccatccacatgcctcccaaggctccgtccacaccccccgccgagctctgtttacaccccccagagctccatccacacccccaaagaactcaatccacatcccccaacggggttccatccacaccccccaacaggctccatcacctccccagggctccatccacaccccgcaacatgctccatccacacccccccagagctccatccacacccccccagggctccatccacacccccccagagttccatccacacaccccaacatgctccgtccacacccccccccagagctctgtccacaccccccaacatgctccatccacaccccccagggctccatccataccccccagagctccatccacaccccccgagttccatccacaccccccaacatgctccatccacacaccccaacatgctccatccacaccccccaacagggctccgtccacaccccccccagagctctgtccaccccccccaacatgctccatccacacccccccagggctccatccatacccccccagagctccatccacaccccccaacatgctccatccatacccccccagggctccatccacaccccccaggactctgtccacaccacccccaggactgtgtccacaccccccaagggctctgtccacaaaccacccccgtcagctccatccacaccccccagggctccatccacacccccaccaggactctgtccacgccctctcagctcagagcacccttggggttcccaaggctcctgcccacccccacccacccaccccagcctatcaacccatctgcctggagcaccaccctcgcagctgcacctggccaagcccttccccacccccggtaacacctggagcacccagccgcttcccaggcgtctggcatttggctccttccttcgttccttccttccttcgttcacatcaagtgtacagcaggcatgcctctgccaccaaggacggcaacctatagccagcggggctcggggaaagcaacagggggcaggggctgttgttccaataaggccaggccaacgggtcacagtggctcacgcctgtaatcccaacactttaagaggctgaggcaggcagatcacctgaggtcaggagttcgagactagtctggtcaacacggttaatcctcatctctactaaaaatataaaaattagccagccatggtggcaggtgtctgtagtcccagctactctggaggctgaggcaggagaatcacctgaacccaggaggccgaggttgcagcgagccgagatcgcaccattgcactccagcctgggcaacgagggcaaaactccatctcaaaaaaaaaaaaaaaaggccaggccaggctttgaacaggtggcattgagattgaggctgcagggcatgaggaagtgaaggagctgcatggcagagcccacaagaaggcccaggggctgagaacgcatagcccacggggacagtggggtcataccacagatccagaccccaccacggacttccttcctgaggctaagcgaagtgggtgactgttgcgggtctgagtgaggtctgttcgggtgttgggggtccgagtgaggtctgttgggggtctgagtgaggtctgttgggggtctgagtgaggtctgttgttgggggtctgagtgaggtctgttgttgggggtctgagtgaggtctgttgttgggggtctgagtgaggactgggacccaccaggctttaacagtcactgtagccgctggacaggaaccagcaggaccaggaagcagcaatagtgaggtcagaggatggggccagcatgggtctgagagcagctctggccacggggcaggcagagaaaagccaggccacccggtctcccggcacagccacacctgggcttcagggccagcagggagttcctctcgactcccaggaaacctcatgccagccactcaggtaagattactgccaccttcgcctgagcccagggctccggttacctgctcccgcagggacgtgtgcctgcccgcccgccgagagggcctcaccgcccgccagctggggtccctacacctggatggcaggaagtcatccagagtgaacctgagctggctgacggggcggtacctgcctcaccccacctgccagctctcccagctccccttcttccctaggggccagcctccaggacttatttgcctcttctgtgaataacaacctctcacccccgtccttccaggactcagttgcctcctctgcgaatagcaacctctcatccctgtccttccaggactcagttgcctcctctgcgaatagcaacctctcacccctgtccttccaggactcagttgcctcctctgcgaatagcaacctctcacccctgtccttcctgcctggcgggccacgatctgggacagggttttgtcaacaccaaacccctagaacacaggagggactatagggcctggattgggcgggggttggcgggcatgttgcccttctaggaacggggctgggacatgtggggatgtgggcctggcgctggcaggggcaataggcgatgtgtgggctgggggtctggggacaggtgagagacccatcacctgcccaggttccccggcaagcagggagaggaacccaggccctccctcaaggccagcctagcagggctatgcccctgcccagtctctggaggccaagggggaagggcttcacccctgcaggcccagctaagcctctccctacaagcccggcctgacccacccccaccgcacaagcagacccgcagcccaacttcatctcccaccatctgattgcctcctccccagcccgaaccctcaaggctaagtctaaacccctcctcctgtccccaggcaggggcaacagcagtggcacaagccagaggacaggcagacaagacaatagatgttccaccccaggccagggcacctcaaagcccagggtaccccaggtccagggcaccccaaagcccagagtatcccacagcccagggcactgcatggcccagcatactccaagacccagggcaccccagttccagggcaccccaaagcccagggtaccccagagccccaaagcactgcatggcccagcacaccccaaggtccagggcaccttaaagcccaggacacctcaggtccaaggcacccaaagtacagagtaccctcctgcccagggcaccctagatccagtacaccccacagccttgtgcaccccatggcccagtgtacccacagtccagggcaccccaaagctcagggcactccaggtccagggcacccccagcccagggcactgcatggcccagcacacctcatggcccagggtactccaaatgccaagcaccctaagtccacggcaccccactgcccactgtaccccaatctacagcatcccaaaactcaggcaacccaagtctagggccctgcacggtcaaggccaacacagcctccctgctgccccgctaacggcccccccaggtccagggccctgcacggtccaggccaacacaacacagcctcctagacctgctgccccaccaacgccccgacttggtttcttctcctcggcctcccgcatcagcctcccgccccctacggagcacagcgcttggtgcaggcgccaggagctccaagcacagatacatttcctgaaacctgagcttctgagaggcccaggcctctgccaccattgtcacccgaggcagggaagaaggggtgggggcaaacaccatccccagggctctgggccccagggccgcagcaggaggagcagaccaaagcccatcccacgcaggaacacacacacccatgctccacaccagagaccagccagggccttgcctgggtgtacccccactccccagcacaccccctctaggtcccaggtcccccaccgtgaagacggtggcagccagggccggctagcacctgccacaaagcccagggtacaactgatgccagccacaccctgctcaggcctgggatgtggggataggaatcccgctcaggcctgtggtctggggacagggactccgctcaggcctgtggtctggggacagggcctccgctcaggcctgtggtcttgaggacagggactccgctcaggcctgtggtctggggacagtgacctcactcagatctggggtctggggacagggaccctgcttaggcctcaggtctgcagacagggaccctgctcagtcctgggacctggggacagggacccagctcaggcctggggcctgaggataggggccccactcaggcctggggtctagggacagggactccaatcaggcctagggtctggggacagggaccccgctcaggcctggggtctggggatagcgactgtggctggggcctgggattgcagatccttgtcttcctgcccccactccaccaccagcagcagctcaggccgaagcctggctccacaagcaccccttcactggcctagcttgctcccctcataaagacaccatggagcagcccaggagggcccctgagagcagcagtcccctcccacccaggcctgccgcctgctccccaacccgcccctccacctcccagccttcctatcgtgctgcggctttgacccttcagcccaccctcagggaccagcgacaaacccccagcccactctccaatcctccctggccaagggcagtcctccctggctccaatggtccccgtgttgcctgggcactgaatgccccaccctgcccccataccaaagctttgaaccagacccccaatgtacaaggcggacatgccctgagttctccccagggctctgggccccagggccatggcaggaggaacagaccgatgcccacccaacacaggaacccagatgcccacattccataccagaccagccagctctcctggtccctactgggaaggtgtgggaaggaggggggtggtccccagtgtgcagacaggatcccctgaaggtagggtggggaggccagggccctgtcatccccagcccaagctcagaaaaaacaggaagcagagtggtgctgaacctcacacctgccacgagcagcttaggtagctccaggcacagacctcagcctggcccaccttgagccctagggcggctggatgcagggggtgggctctgtaaaaaccttcctccctagggggcaaaggagagggtagggaaggctgggaaggggaggaactggacaggtctgggagccgggctgggggcacaagcagagcccgagctgggagtccagcagccccatctgacttcgtgagacctgcaatgaaaaagcggcagtgtgcccctttcacaggtgagaaaagctcagcccttctgatggcccaggacctcaggcctcctgagctgatagacgcagggtcagccccaggcccacctcctgtatctacagggccttcacccatcccgttctcctcataagcccagatctgtcacggggaccatgctccagccacaccaccccgcacagctgccctggagcccagcacacacatgccaagacagaacaagaaagaccctcgctggcaggcaggctcctgggctcctggctccagagatgggccagccaggcaggcacgacttccagctgcacctctgagggtggggccctggctgcccaggtcacggccaactgccaccaccctgctcctccctcagccagcaggtgtcccctgggcctgccacctaccaggccccagagcaaagctccctgctgcccccagcatgacactactcctccccaaacctccatcaccacctgccatgcctacagagcacccggggtgcgtgcacacacgcagctgggagaatgtggcctcaccctgccagctacaagccaggcaccagaaccaacccaggctgacaccggcctcctggggacgtctgggggtggagccaggagaggaggggcagccaggcagcctgctggcatgtggtccaccacctctccacattcaagaccctgggcccacccactgagggaagctgagcccgagaccagcacagatccatgactaatagcacacagaccccggccacaagaagccaggccagggggcagagggccacccagccaggcctgggtcaacagcagagaccacaaggtgggagagtcactcagggggcagggggtggagggagcgaatgcagagcccagactcccccactcctcttccacaaggccctctcattccctttactccaaggagcccaaaagccccacgggcctgggcaggatgccaccctagcctccaggctgaaacccctcctcaggtcccagggagcctgaactcggtccttgccttcccatcacagccaagtacacctcagctcaccgcacagagctggacctcagcaagccagggcagcatggccagggactgccgccgcccgagtgcaaataccagggtgctggcatcacggcacagctcccgcccggcagccaggccacatggcaggagaccagggctgcccccaaacacgcagctatgactctgccctggcccccaacccagagacaggccgcctgccccctcctggggcattcgaggaaccggctggaagcaagaggcagggaggtgagctggccccgaaacccagtgcccggactccaaggaaggcaagggcctacccggtcccatcccacacctgaccggctggcccgcggggcgaagagccagggcggacacgcgatagcccgccacattcctccaagacctccctgcccccacacccactgctgccaactcgagcagaaaacacatcctcaggtagcgatgtggggccacgctggctcaggcccaggtgcagatgacaggctgcgggccctgctcagacctgcctgctgcaccgccgtgggggcgaggggctgggcttctcacaactgcctgggccctcccatgcccgcccctgccttttccatctgggggacactttcccctctctggggcccccctggtcaagggatactcggcggggtgctcacgggttgaggacatggccagaggagactgtggccagcttccacgggtgggagctcaggaagcggtgaggatgggggcagcaggcaaggctgccagccagggctgcaaaggtacagcacaggactgggagccacacacggcaggcccaactggcgtgagctcggcagggattgccctcaactcacaatcacttcagggcccaggataccaggtgggcacactccggtgcctcctgctgactggagccacttcctggctcccagatccatctactccctgatcacaggtctgcatggtgctctcattcccgcactcacccagttccaggcccccagcacaatgaccaagcagggaaggacctctgggcaccagggcaaggccgtgctccaggcaatgaggtaaggcgcccgaggcctgggcctgcccacctaccactacccacctgccagcccactgggatgagtacctgtttcccagtgacactggacccctaccacccctcctcccagcacgcccaggccagggctcctgcctgactggccacctgccaggggagaccagacagccccgactcagcttctgcccctccagaataacaaaaccaaaaaaacccacaaacagggcagtgccacagaaggtcactgcaccaggatccactatctctgtctctgaacgatcttgggtcaccatcgggggcttctgccgacataagcgttaggcgttaggctctcccgggcctaggtcccacggcgcccgcccgtgccccccaggcatccaggaaactgcagggcaggcgcaggctggccacgggcccggggcggctcagtcagggcctgccctagaccagccccagcacgcgctgcgcacatgccaccgcggcctgcccgggaccggggcgcctcgcctcgcctccccacccagacagacacgcgcagggcgacgcaggcacacgccgcacaccgccgcgcacgcgggacgccgccgccccgcccccgccgcgaccccgctcccggtggccccggggccccggcgcgcccacgtggccaggcgcggaccaagtccccagagcacgcgccccctgccggccccgccccgcctgggcgcgcgcggctcgcacgcagacccggccgcaggtgttgggggtcgcgaagcgcgcggggccggggcgcggagagagagggaagggctggagcacgagggatggagcgcacgtaccggccaggcgaactggaaggggatgacgacgaggcccgggtcctggtcgccgccggcccgggcccgcgcccgcgctcggtcccccgcagcgcccgccggcggcaggtagaaggagttgccgcccagcacgggcgtggcgccgtggccgtagctgcagggccccgtgggcgtcaccttggcctggtactccttaaggcacacgcgcacgtacgtgtcgcactcgtcgtggccgcagccccccgcgcgcgttgtccggccgtcgccgtcacagcaggcgccgctcagcagctccccgttcacgttccgcagcgcgctcagctgcagctcgaaatagcccatgggccgcgccgcctaaaaataaggcagcgggagagcggagggaggcgcgggccggggtcggcgggccgggcgccaggggtgggggaacaggccccgccgccccgcccccacccagccgcgcccgcccggagccccagccgccgcgcgcagcctcgagggcttccgaaccacggcggccccaggcagtgcccgcccggcccctaggggcggcccggtgtgccccgtccgcgacccccgccgcccccgccgccccgctcacctgcacccagagcgccagcagcagcagcagccgccggggaaggcgcccccggccctgcgcccgcattgcccccgcgacccgcccgcccggccccgccgccgccgcccgcgcccggctcccagccgccgcgccggcctcccagcgcccgcccgccctccgagcgcccgcagaggcagcggcagcggcagaggcggcggcggcggcggcgcgggcggggtcgagcgcagcgccgcggcgcgcgggcctgggcggcgggcgtgcaggggcggcggcagctccggctcgctggcggccgcgctccggctgcccggcccggctcccacccggcggcgacggcggcggcggtgaaggcagcgggtcccggcctcggctctgcgcgcccgcgctcccggcaccgcagccaacaagttcggaacgagactgacagctcgctcgcccattcgtcacccgcgcacctgcatatgcatgagggggcggggccgcgccgcggggtggggccgggggggggtccgggggcgccccaggctttaaaggcggtggagggcgtcgcctgccagcgccccggcccggcgcgcgccccccagggcgcccgggcggcgggggcacggggcctcggggtcagcgcgggccgcgggggccccgctcacacctccgcgtgagtcggcgaggcgtgcgccggcgccgcaaagctgcctcccctcctccgcctgggctcctgccgggtgtcagaaaccgggggtggggcgccccgaggttgccgtgtggtcccctcccatcagtgcgccaccgccgcgctcctcgcagtcccagaggagatgccgcctcctactctgatcagggctcggcccccacgcggggtggcgcggccctggggccagagccgggcccagcccctactgcgcgccccccacctcctccgagaatctccccttctccgcgccgctcctaccgcctccacgccggctgcagggggcgctgcgcccctccgacgcccctgccttcccctctgcgaggcgcgctggtcaagcagccagtcaacaaatgctccagggtgcagactgctcagctcggcgctggcgtcgaggtagccaggccatgccctcaggaaatgctcaggccacattccccgtttcccgcctctcgccccccaaactcaggtctgggcttggggggcgagaggcgggaaatggggaacaaaagtcggcagtgcctgtccctgaaggctaccccgagagaggcctcccactgctgccctggtcaccaggcttccacaccccatcctctgcggtcacctccttgccctctccctgggtgacctcgcagctcctccacagggtcaaaaccaatggcaccttcctctcctccagtgagcacggtcctttccagagctaggggtcaccttggtggttaaagatccccatatggtccagaggggtcctcaacccatccccatgataactgagctgtcttctctccccctagctcctctcgcaaatttgccctgtgcccggagctgggtggctgtgcagccccccagcctggagcaagtcactgccaccatgctgctggggctgagggctgaaggaagagagctttggaggcacagggcctgtgaacaccccatgcgcagggtctgcctgctccatccctgtttagcagctcctccaggatccaggccgcaggctcagctgaaggtccctaaaggggtgggtgggagccccccatgcccacctcagctggctctgctcagagtgcccaccccaaacttggtggtgggtaggcttcgtggggattaagacacaagccaggatgaggcccgcacagagacccccaccaaacaagagaatccaagctgtgttcagagccttccagttgccgccttccggtgtgtgggcggtgattaccgcctacggggggaggggctccctgtggagatgccacctctcctgtgctttggcctgggggcaggtactcgggtactcgagagagggaagccccaggacagagaagccccctgcccggctccagaggcccagggctccatccccacctgcgcccactgccccactatggtgggggagggggtgctgggtgcctctgctgggcacttggccaagtggtgaacaagggagactccgcccctgcacaccctcaggagcccccagcccgggggtggacagaggacttagacaagtcatacagaagctggcatagggggccgccagagcgtggacgggcatgggtcagccagacctcacgatgtccatgagagcacccaggtcaggaaggtggccgcacctgcccttaggaaggagggggacataggaggcatcggagagggggtcccttccctgcaggaatttcagcagcccttgagccagaaatgccaggcagctggaccctggtttgagtttccagaaggcagcagtgggaaccctcgcccctcatacatatttcacaaaacacatttgccccctgctgcaccttgctggggtgaggggctgagatcagtggcggccagggctccagccccaaccctcaccagaccaggctacctggtctcttctagtaagggacctcgtcattgttctggggcccactggaccacagcaccctccagcctcccagagccacccgtcccccagcctggagggctcccactctgagcgctgggcggtgcccagcttgtatgcagagggcaagggtgcagctgctcagcctggccaggggctctgggcccatagggcagtcctggggaccaggctgaggacgggctgccaggggtttggacagagccggcgaggctccagagtaagctgtgcttccgctgggtcctgcagtgctaaatatagcagacggggaggggagtttccggttacaaccccccctccagtgccgggaaatcaatgccagctccattaggcccggcagcactgcctgctgacccaccccatcgggctgcggagcaaagtgaggggctggactacacccaggtccgggtgccctgtcacctgtcccctcagtgcttcaggggccagacccacctggtgcctgcgagaggtccctctgaggtagtgggaggcctctgctggtcaacccggagggcccatcgcactctcgtggtgtcaccaggcaggctgctggtaagggcagcacagcaaggctgctgtgggtcaggcagagctcctgtcctgtgaatgtcctgctggggcctcatctgggtagagtgaagctgaggctggccaagacccgcacaccccatacctggcagcccctccctggcacacaccccatacctgacagcccctccccggcagccctgtcgctggccttgctgatgcccacagggccccacctgggccacagccagcatttgcatacaggtggcactgcttttgtgggcccctgaggcacagcctcctcaggacagcctccaatgccaggctgtccagcactgtgctggatgacaacagggggtcagtctccacctccctgcccagggttccaccctgcagggtactgaggctcccttcacttcactgtccccttctctactttcctcctgggagccacagcctggacctaatgatgtccaggagcggatcgatcctgccgcagactgatggcccagcagtgccctcgaatgcccacaaccagtgccaacacacccattcacctgcagaacccttactgtgcacctgtggcccaggaagcagaccaggcgagctgggtcccctcctgcctcacaagcattctgggcacctggggagcagctctgagctgcacgcatctcccacagccccaccctcaggacaggtcagaaggcaaggccagggcatacaggccagagatgctcaggggccagtagagcctggtgctgggcggcccaggctgaggccgtgccccgggaccaggaccgggctggcaccaggaacctggcccatgtcaagaccactggccttgtgtccccaccctgtgccgccacctgctcctcttggagcaagcctgcagacatttctgcataccccacaggccgaggaaggtcccttggaaaacttccaaggctgggggtgcacggatcagctactggggcccccgacacagggcagctttggctccgggctcctgtggagtggctctagcccagccccagtcagggtggggacccctcacttgccccaggagcagggaacatactttccctgcagcgtgcagcctgcagtgctgcccaccccatcctaactcctgaggactggctcagccaccactctcgtgagcacagctcatgctgcagccccgtgaccagcaggcccacccccaggcctgccatgccaccctccatgagtcccggaccccacccctcccagctccaagaggaggcacagcctggccctgcccatggcatccccaggcctgtcctcagccccacagcaaccacctgcatggcctgccaccagctactcctcctacaggagagctcgccgtgtcccgagggccatctcaggtcagggtcactgcttcccgccccttccccagtcctctccaaggccctggtcacagagctcagaaccagcaggcagaagctggagctatgcaagcctttattggggtccgcggggtgtggggtgagtggccaagactggcctctgtctagaaccctggagtctcactggagatccaggttgggggccacctggctgaggaaccatgagacaccaaagatgacgccgagggtcttggggatgtccgggtcgtctgcaaaggcctgggcgccttccaggggcaggtgcaccacctcaatgagctcaccctcctccaccaggcccccacctggaccgctacgctgggcatctgtcacctctgtgtagaacatggtctgtctggagccagtcagtcccactccagacctacgggttgagacagggtctgctgagtcacccacgctggccccgctggccccctggcccttctaccaccctccaacccaccctctccactctgctccctccagccctccagtaggcaggactctgggatgccctctcccacccggattcccacctggtgtgcacgcccgtggcccctcccgcagcagggcatcccttccctgatcacgttgtactcgccaggtggggtgggtgttgtcgatgtgattaaggaccctaaccggtgacttgagctcatcagaagggagagcatcctaggcgggcatggcccgatcacgaagccctccagagggtgtttcaacgccagaaagggagaaattcaggccagtcctgctggccctgaaggggaagcaaccgccatgctgggaagggccaacagccagcagggaggtgggacccagtccccagccaccaggagctgaattctgccataacctcgtgagccgggaagaccccaagcccccatgagattgcagatccggctgacaacctgcctgcaacctgtcaaggccaagcagaagaccccacccctgtctgcagcccccaaccagataccctgaggctgttcccagtgctgtttggagcccctcagtctgtggccagctgcagaggcccatgccagaccccagcccatacccggggacacaggctggctgggaagcagggacaaacccaccaggccttcccgcaagggttccccaccaggcacccacaggacacaagtttcagactaggaacagcatgcactgaccgcccccccaccccccgtagcatggcagagtggggtggggtggcagcgaggtcctcagtaccaggcccagtggcccaggctggggaggggtaagaggaagccccctccctcagtgggcagtggccagaagggggctgctggcagccaggaggggtcaggcaccaagggaaggagcctggactggcgtgtgtggagggagaccacgggctaggaggacaggatggcagaggggctgggctgcattctggaacaggagggggagggccaggtgtggatctggggagaaacgggactgaggggcatctgggaagatgaccagggggtgggggagccctggctcgccgcaggaggggctgtcgggtgccatgaaccaaggccagccggaggcctgcagggtagaggccgccctctgagatgtacccaacatacaggggcagggacagaactgggggcttccatgccccacccccaaggcctccccacctccggggggactcaccccagaccgaccttacccagctgcttccttgccctctagcccctcacctcccgcagaccccttcctgatggcccatttccggcggcggccgcggctgcgcctctgagggaagtggcgggtctggggtttccagccccggtttccgccggcttgtgaaggagacaggcccggcccttggcccgggctgagaggaatctgccagccaggctgggcaacgcctcccccaccccagggcacgttccaacttcactccatcacgccccaagctgactgcctccctgggccttgtcctttgcagcggcaggtaagaggcctggctcacctccagaatcagagacagggagccacgggccctgccacagggtgggtgaactttgctgtcagtccagccccccatcaggccctcagagacggacaccctgacccctagtcagcagcatctccagtcctgcatccctgaagccacggcctgctcttcccgatgcgagtctaagcaggatgcctacttcccagagccctccttggctccccagcaccctcacaatcaggctgtggcccagaggctgtaccagtagaaccaccgcggccagggctgcttgaccacttgccctgagagcctgtgcggtccctctgccaggaacctgcccaggcccacctcctccagggggaccaaggggactccagcccctcccatgcctcccggctgtgctcagtactatgggctggggagctgggggcacagtgggcgtggcccaccacggggtagacacctgcagaaaaccaaggcccatccttcacacccaagtccacccttcggcatggaaattctgttttgttgagacagagtttcgctcttgttgcccaggctagagtgcaatggcgcgatctcggctcaccgcaacctccgcctcctgggttcaggctcaccgcaacctccgcctcctgggttcaagcgattctcctgcctcagtctcctgagtagctggaattacaggctcctgccaccacgcctggctaattttgtacttttagcagaggcggggtttctccatgtggtcaggctggtctcgaactcctgacctcaggtgatccgcctgcctcggcctcccaaagtgctgggattacaggcgtgagccaccgtgcctggcccagcgtggaaatgctgcctttaacttgggagtccacccatccagccaggaacgtgcccaggtgaagtccttgaggctgctgaggtgggagggccccaggctcaaccctgagtggcccatgtgccaggctgacaggtgcagagacttccggtgcttctcccagtggagcgggccctggcctctggaggaggctgtggaggctggtgctcagctggtgggggtgggggtctgtgacaccctcctccttccccaagacctcagctggggtcaggagcccatcgtagcgtccctggggaagtggatgggcttcataccaacatctagtcctgggaaggcaaccccaccccagctggcagccctcgcggggcaagagttggtgcctcgagtttggtgggtcaggtcccaaagcgcaggctctagtgcctgttccccaggagagctggagccaccccttctccagcccaggacacagcttctccctcattcctaagccaccctctgagaacagagctgtgagtcacccccacccccagcgcccggtcttaatcctacaggaagtagaggcacctgtcagcagcagctgtcacccggcctgcctcacacagctgggggccgcaggctgggggcatggggccgagacgctgcagagagagccccaagagcccagattctggcctggcttaggagctgaggcgcattcggtccaaccctcccctaatcccatgttggaaaacaaggaggaatccatcctgcttgcacactcccagggacggggccctcactctctcccatctcctgagtcacaccacaggcctgagggcctggtcccactcaccagtatgtggcgacccggcgcagatcagagggggccaagtggtagccacactcctcccaagcctccttgcaagccacttcctccagcgagagcccaggctggtccacgaggccggcacacagctcaactgtcacccccgctgagccgggcagggctggctgtagctcccgaggcccgtcctggtctacagctgctagggaccctgggaagcggcgctccacctcacccgcatacacagctgcgtgggaagaagccagactgtgctcacagccacgtggtggccacctccaggtcacccacacagccaagccccctcccagggcctcagcttcccctggagccccctcccacatctgtattcagaccctcaggaccacagggacctgaaggtgaccctgcagatccccttcccaccccagctggcctcacctggccggaactgcttcaccaacaccaggctcctccgagaagagttgaataagagaacggtcacgctgtgtacggggggaggggctcagcacagaagcactccactggccctcgtggggccccacctcccatctttctgttcccagcgtggccatcccacctccttgccagcagcccagggaggtcaggccccttgctcagataggatggctgaggcccaggcgggaccagagctttccagggtcacagtctggccaggacccagacctgctgtattccagctggcaggatgggaggcggggggcagggaaggacacacgggcagctgagtaggtcagggtgctcgcagctgaggccgggtgactgacaggacgtttggccctcactgagcagctgcccaccagccacactcctcgagccacgtcgccatccagcccagaccctggatgctaggggcaaaggctccaggacagcctctccctgccctgagagggcctgcccaccatcatggtcccggtggcctgagcaaagacctgactcagcccccaggcctcaggctgacccctcagggataggaaacccagaggccgggcagagagaagggacttttggagcccacgcagggaacagcaacgtcagggaggagagggcaccttcgccctgggcccagtgtccccgtagacatcagtctggggcttccccagtggccaggctgggcc

SEQ ID NO: 651 - DNA, 36571 bp, Homo sapiens
gtttttggtggtttttttacacaaaataaagaaactatgcacatggcctcggcctccgggtccggcagacggcatggctcccaccgagggccctgggtcccggcccagctggcagccgcccctactccttgccggcgtagcgggcctcattgatgctcctgaccgcgcggttgtccactttggggcctgaggcccagtgggccggcctccccggcgagcggccaggatctttggtgaatttgtgtgagaggaacttctccgcctccagggagtcctcctcaccgcggcccagatcctcgtcctcctcatcctccctgacggccgcgtggccggccggcccgggcagcgcctcgtccgccctgcgcggcggcggcgtgaagttcttgcactggtagagcacgtccttgtggccccccggccgctcaatggggttgcggatggggttgagcggggcccactggttgttggcgctctcctcccgcggcagccggctcctctcccgctctttcctgcgcttgcgtgtccaccacacgcacaggaccacgcacgccagccacagcacgctgaaggcaccacacagcacaggcaccagcagacctggggaccggggagaagagccggtgggcaatgaggcctgggcacctgcggggcactagccacacacccaggcctgggagggccctgcgggccaggcggccgggccccaccctccggttgctggctcgtggggagggtcccaggacgggggctgggaaggtcaggttgtggggctgggcggctggggcagcaggtgccagggacttctgtgttcctggtggctggcaggatcggcaggatcggccggctctgtgcccaatgcctgagttgcctgcctggtgccttcccaggggcccacctcccgcgcttacctgtggaagagccgcccgtaacaaccgtctccaccttgacctcggtgacagccaggagcagtgagctgttcccccgctgggtgatggcggccacgatggcgtgggccgcgccctggatcaggctgctgtcaggcaggtccctggcagggctgaaggactgcggcaaagaacggcattgtggggatggctcgagggctccaggctcccagcagcctgcccccaacactgaggccctggccacactggagcaaggtgggcgcacgggagacgagagcccggggtcctgcagtggcgacttcaccaccaggcagtgagtggggagtagcggggggaggagtggaggggtggaggctgtccccatccgggcacacaggagagcccagggtcctgaggtgtggggacctcaccaccaggcagcgagcagtggggggaaggggaggggtggaggatgtccccatccgggcgcacgggacagcccagggtcctgcggtggggacctcaccagcaggcagtgaggggtggggggaagtggaggggtggagggtgtccccgtccgggcacacaggagagcccggggtcctgcggtggggacctcgccaccaggcagtgagttggggaggtgtgtggccccattcgctgacacctgctccgtgatggccatcccttcttgtcagttcccagcccccacccccacctatgggccacaccccaggggcaccacaaacctagtgccttcacgaggccacagcaacccggggctgtgcccctgcctccaccacatccctgatggcgccctgacctgtgctggcacacttcttacatcttcccctgcccctactgcccttccatcacccagcagcacccatccatgtcccccaccccctctgcggcctcagggcaccaaaacactgcacgtccttcctgtgcctggccatggcctccaccagccacactgtgccatggccacacccactgctctgcacacccacccaccatgttccagaacattccctcccctctccgggcatgtctccaccccagtctcacccgacccccttggtatccattcacatctgacaccccccaggtccagggcaggtgccagtcccaaagcaggcctcccagggcagactaagcccacggactctcctgctgcctgtgacgtagggacacagagacaaaaacagagcaggggaccgggcgaggatgcagctgcaggggaagcgggctccacaccacagccctgcatctccctcatgctggccaggcccagggagcagttccacgggtctgcggcatggacagcgaggggccgcagggagacaggcctgcccgcagtccttccgcaccaggactagcctcgccagagcctctgtccagcatagccaggacctgcatagtacgggacccagggcccacccaggtgctgctccccactgggcactcaccacggccacctccacagcactggcccccgaggacgcccggtcgcaaagcaacaccagcaggcggtcccgtgccacagcccttgtggctggcagggagcggatcccggagcaaatggcgcccaccgtggtgccctgggcagagacaggcagtgcgtgggcagggcagggccgtgaacctgacacctacatccctggactggcgctgtgggtacacgtgggacacaccctacagcccgcccaggagagcacagcaaggatgccaagggcctgggggggcagcttcccacccggctgtgccctataccaggaggcaggagtgacggtgcccacccgcccatcctcagggcggacccagctccacctgcaggccagtgggggaaggagaggcagggcggggtacagtgggtctcctccagttctgagcccctcctgggagacaggggcccagctccaagcacacagcaggcaaaggtggctcctaggccagggcaaaactgcccacggagctacagcccaagagctggggccaggcagccatggcgccgtcagtccaggccctcagggcagctggacaaacaggcacccccagctggctgctctcccagcctcctctgccacctccacccagcaccaggcccaatgcccctctcatctgaccccacagggccactctctgtgaccaagagtgactctgctcagccaaccagggcctccctgccctgcggggctaggctttcgccatgccacgagcagatgccggcgtgtggcctctgcaagctcagatgccaccaggcccctcacctggggcacgtggtcacggttgaaatgcaaggtgaggcgggcacagttattgtccaggtggccggagcgtggcaggcagggggtgctcggtggctcttctgcgccgcactccccccaggcctcacagggtggtcgcagacactggcctggggccttctccaggcacctttgccccagtgggcactgggcgctcagggcctcgggctggccggccagcagacaaggcttccatccgcaccacacctgggcaggcacgcacaggagggtcaggcgcaggcgcacaggagggtcagatgcaggcacacagatgagaacccacaggcaggcacgggccccatgccaaggagggacaccgcccaagtctgtgagccccagggcccagcccaccccctacccagggctcccagggaggcaggccaagctcgacatcagaaagggcaggcggagcaaggcaggacccagaccaggcctgttttcccaactgcacatcgaagcatggggcctggctgagctctcgcctccctgggtgtccctgagggcagacggctctcagtccatccggaccccagcacccgcctcctgatctcacagagtggccagggtcagcgtgcaccagcctcgggtagggcagggcggctcacgggctgccctcaccttgctgcagtcacggcggccatccaggcagcggcagctgttgcagtcttccacccaggagcttccgtgtgggaacggagtgccccgggaccagcaggatctcccgaacccgatcactgtggggagaaggggctcgagggtcagcagtgggcatctggccctcggggctgggtgtcacccatgccccccaacccgccccaacccagggcaatcacacggggcctaccttcctggcaccgggggccggctcggccgggtgggcagctacagcgatacccgttgatctcatccacacacgtggccccgtaggcacagggcgaggactggcactcgtcgatgtctgcagggagagccaccgctgctcagtgcagtgaggccaacgcccaccgcaggaccggcatggcctagggcagcggggagccagtggcacacaggcgcaagccccaggacaatgaggagcagcccctgcccccgagcccaagctgctgcctgcctgaggccttcctgagcccagcctgaccctggcccaacagcaccctcctccgtctgcttctgcagtgggcctgtcccatcctggattagccccagctgctgcgtcggaccagccaaggggtgctggacagacagctgggccaacacccagggacaacagccctgcggccacagaggagcccacgtcaggctgcacgctccaacccccacagctccctgggccccggactggtcccccaggctggggctccccacttaatcacttggcagggtatacagcaggaaccccacagggcacagacatgtggggaaactgaggctcagaagagaggcaggaagtagttgtggccacactgcccttcaagggacgtggacgttgatgtccccagactcctgacaccgcggctgggctgaggggctcccagggctggggctgtctggccactcactgatgcggcagtcaggccccgcgaagccaggtgcacactcgcagcggaaccagttgacgccgtcaacacagatgccaccattgtagctgcagagcagagggtgggcatcaggtggccccccgtggtatgccaagtcccacccacccctgctgtggcccccagggtgccactcaccaaggcagagggttgcagtcgttggtatctggtttgggagaagagaacgcaggggatcagtacccaccccccaagcgtgccaggcactgtccaggctggcttggcgtgatcaggctgtggggctggggagggtcatcaaggagggtgccttttgctgggggcaggggcagcagggggaggggctggcagaagggactggggggcgagtcgggggcagggatgtcatctgggtggaggaaagcggcccccgcccacacccctcccacactcactgtgagtgcaagtacgaccctcccagccgtcccggcagatgcaggagaaggaggccccgctgcccacgcaggtgccaccattcacacaggggttgggcaggcagctgctgttcttggctgtaaggagaggaggaggagggagcgtctcacctggccctgggctggccctgggtctccataccgcgcccccaacccagacagggcagacagacccgggggcagggggcagggggcaggtggcaggtgtggccctcaaaaaagacccctcggcccatcgcgcccgagggagcggtgcctgggagggcatatgcccggcggtcgcagaggcagcgggggctcctcaccgacggcgcaggtgctgcccttccagccgggggggcaggcgcagcggaaggtgtcgccgctgtcgtagcaggtgccaccgttgctgcaggtgtaggcatcgcactggaactcgcctgttggcacatgggccgctcagcaggcaggccccagaccgccagggccagggtcctgggggcagccccaggcggccagggcctgcggacactcacgtgagtggcaggtcttgcccttccagccgtcgtcgcacgcacagtagaagtcattgaccaggtcgtagcagcggccgcggctgtggcagggatcgggaaggcagtcgttgggatctgggggcgaggacgccggtcagcgggcggggggtcaccggcgctcagggagggcttcccgggggaggaagcactggagctgggccaggtgaggacagagaggggcgggggaggagcgtcgggccgggggagctggcctcgggcatgggggcagcctgggactccaccccatggtggcagcaccccctggccaggcctttctgggtacggggcctgccgcacccagacagcggtccatctcagggtgataaggggcccacaggggtggaggcacaggccgtgtgggcgggtgctggaacactcactggtgtcgcagagctcgccctcccagccgctggggcagaagcagcggaaggcgtccacctcatcgatgcatgtgcccccattgcggcagggctggcccaggcagtcgtcaatgtctgcagaggcgagcggggtgagccagggcctcaggccagcccagccccaccaccagcccgccgttcgtggccactcactctcatggcagtaggtgccagtaaagccactgtcacagatgcaggaaaagttgccccctggctggctgacgcagcgtccatgggggccacacacgccggaggctgctgtgccaggcatcccaggccccgcgtctgacccgcagccatcgatcactatggcaggcagtacagtcaggagtcaggcccgcccctgccccaccacctcccccaccaccccatgccgcacccagcacctctgcaggccccgccagggcacggctcgcggggcacggagcagttcttgccaccaaagtcatcagggcaggcgcagtaatagtcaccctccaggttatagcagcgagcgccgttccggcaggggcttggctcacaaaggtcgacatccacctgcagggtggggggtgcctgtgagagcctaggcccaggcccaggccgggaacacaggccaggcctctgtccatacgaaggtagatccctggggacccccaggcccctccgccctgggcctaacagtgccagccagagcccaagacccctgcccacctgagactgcccaggccttagctgaacgcagatacctgtgggcccccacccccacctccactgcagcccagcttcctcactgtccctcgggaggagtgtggccttggcccctgctgctggcaggaaggacagctcctgagcccctcacacactgcctggccaccctcagagccaagactgtgggtcttttccagggccagccactgccatgcttgcaggtcctgaggtcagacccctgccctgggccccaagaagccctctggacaggaggcccatcctctgcaccaaggccagggcaggatcgtgggcggccgagggtggtagggaggtgggtggggggaggcagggaaaaaggggaagtaaggggagggggtggtagggaggcaggtaatggggaggcagggttgggggaggtggggaagggggtggtagggaggtgggtggggggaggcagggttgggggaggtggggaagggggtggtagggaggtgggtggggggaggcagggttgggggaggtaggggaggggtgatagtgaggtgggtggggggaggcagggttgggggaggtggggaagggggaggtggggaagggggtggtaggggtggtggggaagggggaaggcaggttactttggaggcaggggggaaggggaggttgggggagggggtccagtaccaacagatggtcagagggaggcgagagcatcagccctgagagagatgcccactccgacccaggactcacctatgacaggtgtatacctctccaccatcaggcacccaccctaccccatgtgctctgcccaccagagccccctgccctccagtcccgagggagtgcacagatggacagataggcctgggcagccagcagcccgggggctcctagcccaggccaccaggaaacccatcacaacaagcaatggccacagggggccaagcctggtgacctgtgacagccccgcctgcccacctggcacccagtggagagctgagcctgggacgccttggggacaacttcccctgcagcacccctgggtcactcaggccccatggtcaggggacgaggcctgccctacagctcccagagcagcaggtggggcagggtgaccaggcagacctcacctcacagagaggcccggagaagccctgggggcagtggcagtggaagccgtcggccaggtcctcgcagaggccgccgctgtggcaggggctgctggcacactcgtctcgttccagctcgcaatgccggcctccgaagccccgtgggcacacacactggtacccgttcaccaggtcctgggcgggccagccaggtgagcgtcccgcaggcaccctgacggccccgcagcacccacgccacacaccctcctggccccgcctcaccttgcaggtgcccccatgctgacactgcccgcgacagtcgttgacgtctgggggcagaggagcagggtcagaggcggggtcccatgtgcctcggcccacccgccggcgcccaccccccatactgactgatatggcagttgatgcccttccagcccgggatgcaatcacagtaatagccgccaatcaggtttttgcaagaaaaagcgttaaggcatggcttcccttcacactcattggcgtctgtgaaagagacaaggtgggagccgtggggctcgggccctgcctgccccctgcagcacgggcacctggcacccgcagcccagcagccccagcagccccagcagcccccgcagccccagcagcccccgcagcccgcatgcgcggcccacgttcccatgcactcgctcggagcccttacccagctggcaggtggcccccacccactgctcggggcagatgcactcaaagccgtccacctggtccacacaggtgccaccggccgcacacgggttcgaagcacactcatcgatgtctgcagagggtggagaaaggtggggccctggcagtgtgagccgtgggaataaggtccccatgggcaggtggcgctgcaagcctgggtcttcctgccatttgtcctcgccaagccagccgcagccacacgtgtggacttgaccactgcaccccatccccagcgagttgccccactcccagacccccactgatactaggcaggagtcccctactcacgtgcagacactcaccaagggcacaggtgggcccgctccagcccgatgggcagtggcattcgaagccggacggcacctcatggcaagagcccccgttggcacacgggttggaggtgcaggcgtgctcagctgtagaaccgcggggagggggcagagctggcagccaggcccccagctttccacaagcactcctccccaagcccacaggttcccaagctgggggtcaggggcccaccacacaggacgccagagggatggggcctgaccggctccccagggaaccagtccctgcctggccagaatttgggtggccagccccccacgtacccttctcacagttcctgcccgagtagccgtcagggcaggtgcagcggtactggtcaggctcggcgttgatgcacgtgcctccgttggtgcaggggtggtggctgccacagtagttcaggtctgggggcaggggtgggatgctcaggggaaaagccggccccccgctcccccacaacccacacttcgatggcagagcattaggcctgccgccccctaccactacctttgtcacagagcaggccgccccagttggtctcacagttgcactgccagggctccacacaactgccatgcacgcagccggggtaggggacacactcatcgcagaacctcccttgccagccgtagctgcacctgggggaaggaggaggggcgcaagacccagtgagctgtggtgcctgaaagggtggcaggggagccaggcacagtcacccacgccacacccagggccggcgggcggcctcaggcctttgaactggagcagccccagccaggcaggggttgcagccctgccggccagccccactgtcacgggcattcccggccgctggctgccgacggtcagccccagctgtcccgtcactcctccctgagctattttgggattcacccgtgagctgggccccgagagcaggcaccaggaaaggaaggccctgccgggaccccggggatgagaatgccggctcggactcacaaggtgctgccagggccgggaggcaccaggggctgggtaggccagcgggcagcaggggagcactcctggctctgcctcggccatgtggccctgggcacagcacgtgccctcgcccccacctcaaaggcagtcatttcgctcgctcccagtaaagtcccacaaggtacccatctcacagatggggctactgaggcccacaggctggcctgggccagccctgcccagggtagttcctgattctgcaggagctccagctgcacccccagctgcaccccccaggacacaaccaccaggactcgccctgccccaggctatcggccaacgtcctgtcttgggagtcccccaggagagggcaggtggccagggtagaacatggcctgacttgagggtgcctccgtcaggggagagagcctgcaacgaccccaaggctcagcaggctgccatccaggccctgccgggactcccggggggcccttcctagaactctccggtcctgcaggacgggaatgtcatccaggccacgtcacttccacaccggcacccgccacactttatttttgtaaaaggaaagaaccacggcccttcctgagccgccctcaagccacacagccagcaccgaaggcctatcagcccagttcagctgccacaaatggggaaactgaggccgggaagaacgtgtctccagtatccagcccagcatgcacagtggtccgcgtgggtggcctcacatcccgcctagaatccctcctccacagacacagagacccaggctcagggcggggctgtgacacaccttgggtcatcggccagagagcggccacagccgggctcagagcccagacctcgtgggtcccaagggcgtgctctcgaccctgggcagggcagcccacaccaggcccccacctcctggtttccccagccagcagccccagggccctggagaggcggcggcaggaaggcatggccatctccgcagcatccggtgggggggcgtcctgcactggaacctgagccgaggctgtcagcaacagctgggcctccccgacagggccagcaagaggggcaggcggagctcacctactgcccccacccaccaggccccccagactccggctcatcttcctgcgggtaaagggcagggatggccaacttctctgctgccttcctccagccttggtgtgacattcaagctgccagccagcagccatccagggagggtggcactgccatccaggttgtgtgatgcacactgggccaggcgagggtgagtggggccgactcccgtagatctacatctacatctgcccagaccaggtccaccttgttgcactttctgagctgacttgggactcgctcaacctgccgggaatccctgtgtgtgcaagtgaccgggtgggcggccccagccctgcttgcctccccgctctgggactggccgggaaagctcctcactgtaccctccaggccactcaaccgtggggcctgtggaagggtcacccacctccccaccttggctcccaactcagctggttcccaaactccccgactcctctccaaaacgccacgctgtgtgaccctggggaaatcagtaggctctctgtgccccagtgtcctcgtcccatggaggcaaacccactccacagagggaggtcctgggacccctgcaatccaaggctggctggagggcggtgctcacctccacctgctgtctctccacccgctcgcgcccctctctcgggctccccagcttgctcacgcacagtgagcgccacggctcgaagcccgtgcccaccccagaccctgggccccagcccctctggttgccctgctgacttctctgctccactctagggcaaagctgccagcccccctggctggatcccccacactctggtctgggtccagaggcctccaccatctggacttggctgtaagaccccggacactcccttgtggaggcccttgctgactcctcatccatccgccctgacctgtggcagccgggacttgctccttggcctccctcctctctgccttccccactttcccgtcaccgcctgaatgccaccccccacaggccccgcgtggcgcaggccaggcctctcccacgagctttctgggtgtctccagggacagggcaggcatcgcctctccacatccagctaaccccggccccgcctgctcctctgtggcattcctcctgccaccatggctctgctactcagcagcttggggttctccctgactccacacccttcctgcttgatcaaatccatccacaaacccctgggctccaccccaggatgtctgcaggacccgtgcgcctctcccccttccactgaccccctccccatcccgctggcccctcccccaccacccccacatgccccacagcggcctccccctcacagcctcccgtctggtgcttccccactcaacagctaccacagcccttccacccaccttgcccagctacaaacctgccagcagccccttcctctgtccctggtcctgcaggcctcagctcccaccactggtctgctctgccgcccctcgcctgctggtgtcacttgccggccgctcgccgcccaccccctccccatgggcagggttaccgtgtcctctgcccatgccccatctctgggtggcttgcagcctccgggtctctgcccctcggtgacgtgactgtccagccagcctccccagtctctcctcactgtcctcacatggctgccgccatcagacacatcccatgctcagacacgcacctactgcactaaggagcctcccgagctcagggcccggctctcacagctgtgtgcccaacctccagccagctccgggcgactcctgacagcaaggctgtgtgtgccagtgaggacgtgagggcaaaggttgggagggcaaagacgggccggcggcacactcacctgcactccccaggcacggtgcatcccccgtggagcaaattacacccttgtttacacacagctgcgaacagagaggagcgagaggcacagctgcagccagcctggccgcaaggcctgtgcccggggccctgcccgaggccctccctgccctccacgcagcccagcggccccctcaccttccttgcactccttgcccatccagccgtccatgcaggccttgttgccgtactggtcgcaggtgtagtggccgaaaaagtcgttgcggggccggcagaacttgttgcaagtggcgctgtagtagttctcgtcgcagcgcacgcggatctgcagctccaggtgcgccacgtggccgctgaagtgcaggctcttccagcggtcctccgggttgatcatgccggcatgcgacactcgctcgatcagcagctcctcttggggaggcggcagagtcagcacaggccagagaaaccagcccggccaggggtcctccaggaacaacggggacggggcagaagcctgcggctgctgcaaggccggggcacagcaggcagcagcacacggagggcagggcccccggccaggctgctacagaaagctcagggccccgagaggcctctccctcccgccaccaagcctgcgccccgctcccaccctaaacgcagagggtcggggggcccggctaggggctaggggccctgcagggagggctgctgagaccacaggctccacagagaaggcacggctgctgccagggcgtgagtctcacgtcccacacctgtgcccacccacctgcagccctgctccaacacctgcacccacctgcgccgtgtccagccctcgacagcacggacatggtgctcagttgccctcccctctcctgcgctgtgacttgctcccagaagtgccaaacaccactaccgtccccaccttaagacaagcctcccctcaggcccccaagacaggcataggtcccgtgacccgctgtctaagcctcactttaagtaagccaccaggagaccaggggccaggggcaccacagctgctggcgctggtatgcaaagtccgtgatgccggtccctgcgcttaggcacaggctcgacgttttgcacaataaaaggtgaacgggtcctccagaccccacctctcccgcctcgggccaaggcctgggaggacactgtgctggcccactccccaaggggcgtcccggccgccccagcctctccaggctcacgttgtcaagagccctgacgaccttgcttgggactcagcccacctgtctctctgccaccccctcaggaaacacccctgccctgagccgctggggtccccacaactgctgctccccacctgggcacccccaccgccgtccctgccctgaaaacagcccctccactctgctggcagccaggatgccctggccccgctctccctcctccaacccattggccaaccccatgcctccacttctgagagcccctctcacccccagactgcccctggtccaagtcaccctgacacgcccagattcacgtggcagctcctcctcggtctgtgtcctggccccacagcccaccctccataaggcagccacagcttgccaggcggagcccgtgtcctctcagtggcttgccagcctccatgatctgagcccagccccggctgctccccctgcacagccagcccgctcctgcccagaccttcacacgagctgctcccttggcctgtgggtgcttctgcattcacccatggaagtcatcccgttacccctgcagggccctgcagagcccctgcctcagggagagggccaccaaggctccatgctccagtacagacaagcagagggggccacaaagccagagacacactcaagggtgtcccctccactaagtcactgccatgggccccaaaagagcacacccaagaggagaacaacataggcaaagccaggactggggaagagagtgcatgcacagctctgcaagtcccaaacgtggcagagcttcctggcagccaaagcaaaaagggaaacagcacacatgatcctcagggtaaagcaaggctttgtcccaagcagacagaggagctgggccctgccacaggcacgctgaagctgagaggagctgccacctggcccagggctcactcaccattcggggtggtatcgttgtcccagtcccaggcctccacgatgagggtaaaggagcgctgcagacatggggaggcgggtcaggtacctgaggccacacctgcctgcctcgttcagggtgggacaaggcccagggctcagacgctgcccctgggtctgccaggctctggcccttcctccccagccagggacccaccaccctcctcatcctcaggccacatcctctgcagacccaaaaatgacccagctcaagggagggagactgcccctccaggccacgcgggctcaggggcctgggctccctaccgttggggtgccagaggcccagcctgccctgagctggctcaagtcagcacggagcacaggaagagcgaccggggggagaggtgggcaaagggcagcctggctggagtggccacagacaggggccccatgggcagccgggacccgagcgtttcctgtggaacgccccttggtgcctcactgggggtgaccacgggggagaacgtggggccccatcaccacgctggcggcctccaccaagtgcacggggtggccaagtacagggcgcccagccagaggccccaacaggccggagctcaggtcctgcaggcatacagcacacaggcaaacccacacctacctccaccctcacacagaacaggtggcaggaggggcccttgcggtacagttggggaaactgaggccaagaggtcctgggactgcccagcacagcctcagaccatggccactatgccccctctgcccccgggccacctggcccttgtaccccagccatggcgacaggcgatgctgtcagccaagcaaagagaccacagggctggccccctgctccgcctagtgcagcccacggagaccgtcactcacagacatgctcagacaggtgggacccccgggacatgccctgtactacccagcactgggtacccacattccacagcctctcagccctcactgcccaggaaccccccagtctacccctggtgtgctcttgacccctgagcccagccctggctccttccaggtggggcccagaggagggggctggggctgagtcacctcagggcctgctggcttcccaccccggggggatgctgcgttgggcagtgtccaggcaggccaggctcactccatccctcagcacaccccatccaaccagccccaaggcctggctaagctggggaaaaccacacttccccagcaaggcccaaccccacgcctgccagcccttccctggtcctcacccgccgcccaccccacgcacgtcccagtgcctcggcctcatccagctaaggacaggcctggcctcccaagatgtctcagaagactgcactcccacgtccagcccctcccctaaccaacgtgctaccagccacacccagcccagcctccaggacccccacccagtcccccgccccacacctccgactgtccctcaaatacagacaactagggcccaacatgactgctgaccctgggcctcactcacagctgggcaaccccggccccgcccccgagcccctgcctgcagaacacccggggacggcccgaggaggctcacccaggtaggagcacaggatggaagtggggggccatccccaacccgctcctagaaccctccctagccacgtcgagctgacaacagaccctcaatcccacctcttaagctccccttaaacccgttttcccacatccgccatggccccgccaggccacggggcccagtccccgcccatctccagggctccctgaggtcaccagggcccgcaaacctctgcctacaggcgccagacaatccccagagttccatccacatgcctcccaaggctccgtccacaccccccgccgagctctgtttacaccccccagagctccatccacacccccaaagaactcaatccacatcccccaacggggttccatccacaccccccaacaggctccatcacctccccagggctccatccacaccccgcaacatgctccatccacacccccccagagctccatccacacccccccagggctccatccacacccccccagagttccatccacacaccccaacatgctccgtccacacccccccccagagctctgtccacaccccccaacatgctccatccacaccccccagggctccatccataccccccagagctccatccacaccccccgagttccatccacaccccccaacatgctccatccacacaccccaacatgctccatccacaccccccaacagggctccgtccacaccccccccagagctctgtccaccccccccaacatgctccatccacacccccccagggctccatccatacccccccagagctccatccacaccccccaacatgctccatccatacccccccagggctccatccacaccccccaggactctgtccacaccacccccaggactgtgtccacaccccccaagggctctgtccacaaaccacccccgtcagctccatccacaccccccagggctccatccacacccccaccaggactctgtccacgccctctcagctcagagcacccttggggttcccaaggctcctgcccacccccacccacccaccccagcctatcaacccatctgcctggagcaccaccctcgcagctgcacctggccaagcccttccccacccccggtaacacctggagcacccagccgcttcccaggcgtctggcatttggctccttccttcgttccttccttccttcgttcacatcaagtgtacagcaggcatgcctctgccaccaaggacggcaacctatagccagcggggctcggggaaagcaacagggggcaggggctgttgttccaataaggccaggccaacgggtcacagtggctcacgcctgtaatcccaacactttaagaggctgaggcaggcagatcacctgaggtcaggagttcgagactagtctggtcaacacggttaatcctcatctctactaaaaatataaaaattagccagccatggtggcaggtgtctgtagtcccagctactctggaggctgaggcaggagaatcacctgaacccaggaggccgaggttgcagcgagccgagatcgcaccattgcactccagcctgggcaacgagggcaaaactccatctcaaaaaaaaaaaaaaaaggccaggccaggctttgaacaggtggcattgagattgaggctgcagggcatgaggaagtgaaggagctgcatggcagagcccacaagaaggcccaggggctgagaacgcatagcccacggggacagtggggtcataccacagatccagaccccaccacggacttccttcctgaggctaagcgaagtgggtgactgttgcgggtctgagtgaggtctgttcgggtgttgggggtccgagtgaggtctgttgggggtctgagtgaggtctgttgggggtctgagtgaggtctgttgttgggggtctgagtgaggtctgttgttgggggtctgagtgaggtctgttgttgggggtctgagtgaggactgggacccaccaggctttaacagtcactgtagccgctggacaggaaccagcaggaccaggaagcagcaatagtgaggtcagaggatggggccagcatgggtctgagagcagctctggccacggggcaggcagagaaaagccaggccacccggtctcccggcacagccacacctgggcttcagggccagcagggagttcctctcgactcccaggaaacctcatgccagccactcaggtaagattactgccaccttcgcctgagcccagggctccggttacctgctcccgcagggacgtgtgcctgcccgcccgccgagagggcctcaccgcccgccagctggggtccctacacctggatggcaggaagtcatccagagtgaacctgagctggctgacggggcggtacctgcctcaccccacctgccagctctcccagctccccttcttccctaggggccagcctccaggacttatttgcctcttctgtgaataacaacctctcacccccgtccttccaggactcagttgcctcctctgcgaatagcaacctctcatccctgtccttccaggactcagttgcctcctctgcgaatagcaacctctcacccctgtccttccaggactcagttgcctcctctgcgaatagcaacctctcacccctgtccttcctgcctggcgggccacgatctgggacagggttttgtcaacaccaaacccctagaacacaggagggactatagggcctggattgggcgggggttggcgggcatgttgcccttctaggaacggggctgggacatgtggggatgtgggcctggcgctggcaggggcaataggcgatgtgtgggctgggggtctggggacaggtgagagacccatcacctgcccaggttccccggcaagcagggagaggaacccaggccctccctcaaggccagcctagcagggctatgcccctgcccagtctctggaggccaagggggaagggcttcacccctgcaggcccagctaagcctctccctacaagcccggcctgacccacccccaccgcacaagcagacccgcagcccaacttcatctcccaccatctgattgcctcctccccagcccgaaccctcaaggctaagtctaaacccctcctcctgtccccaggcaggggcaacagcagtggcacaagccagaggacaggcagacaagacaatagatgttccaccccaggccagggcacctcaaagcccagggtaccccaggtccagggcaccccaaagcccagagtatcccacagcccagggcactgcatggcccagcatactccaagacccagggcaccccagttccagggcaccccaaagcccagggtaccccagagccccaaagcactgcatggcccagcacaccccaaggtccagggcaccttaaagcccaggacacctcaggtccaaggcacccaaagtacagagtaccctcctgcccagggcaccctagatccagtacaccccacagccttgtgcaccccatggcccagtgtacccacagtccagggcaccccaaagctcagggcactccaggtccagggcacccccagcccagggcactgcatggcccagcacacctcatggcccagggtactccaaatgccaagcaccctaagtccacggcaccccactgcccactgtaccccaatctacagcatcccaaaactcaggcaacccaagtctagggccctgcacggtcaaggccaacacagcctccctgctgccccgctaacggcccccccaggtccagggccctgcacggtccaggccaacacaacacagcctcctagacctgctgccccaccaacgccccgacttggtttcttctcctcggcctcccgcatcagcctcccgccccctacggagcacagcgcttggtgcaggcgccaggagctccaagcacagatacatttcctgaaacctgagcttctgagaggcccaggcctctgccaccattgtcacccgaggcagggaagaaggggtgggggcaaacaccatccccagggctctgggccccagggccgcagcaggaggagcagaccaaagcccatcccacgcaggaacacacacacccatgctccacaccagagaccagccagggccttgcctgggtgtacccccactccccagcacaccccctctaggtcccaggtcccccaccgtgaagacggtggcagccagggccggctagcacctgccacaaagcccagggtacaactgatgccagccacaccctgctcaggcctgggatgtggggataggaatcccgctcaggcctgtggtctggggacagggactccgctcaggcctgtggtctggggacagggcctccgctcaggcctgtggtcttgaggacagggactccgctcaggcctgtggtctggggacagtgacctcactcagatctggggtctggggacagggaccctgcttaggcctcaggtctgcagacagggaccctgctcagtcctgggacctggggacagggacccagctcaggcctggggcctgaggataggggccccactcaggcctggggtctagggacagggactccaatcaggcctagggtctggggacagggaccccgctcaggcctggggtctggggatagcgactgtggctggggcctgggattgcagatccttgtcttcctgcccccactccaccaccagcagcagctcaggccgaagcctggctccacaagcaccccttcactggcctagcttgctcccctcataaagacaccatggagcagcccaggagggcccctgagagcagcagtcccctcccacccaggcctgccgcctgctccccaacccgcccctccacctcccagccttcctatcgtgctgcggctttgacccttcagcccaccctcagggaccagcgacaaacccccagcccactctccaatcctccctggccaagggcagtcctccctggctccaatggtccccgtgttgcctgggcactgaatgccccaccctgcccccataccaaagctttgaaccagacccccaatgtacaaggcggacatgccctgagttctccccagggctctgggccccagggccatggcaggaggaacagaccgatgcccacccaacacaggaacccagatgcccacattccataccagaccagccagctctcctggtccctactgggaaggtgtgggaaggaggggggtggtccccagtgtgcagacaggatcccctgaaggtagggtggggaggccagggccctgtcatccccagcccaagctcagaaaaaacaggaagcagagtggtgctgaacctcacacctgccacgagcagcttaggtagctccaggcacagacctcagcctggcccaccttgagccctagggcggctggatgcagggggtgggctctgtaaaaaccttcctccctagggggcaaaggagagggtagggaaggctgggaaggggaggaactggacaggtctgggagccgggctgggggcacaagcagagcccgagctgggagtccagcagccccatctgacttcgtgagacctgcaatgaaaaagcggcagtgtgcccctttcacaggtgagaaaagctcagcccttctgatggcccaggacctcaggcctcctgagctgatagacgcagggtcagccccaggcccacctcctgtatctacagggccttcacccatcccgttctcctcataagcccagatctgtcacggggaccatgctccagccacaccaccccgcacagctgccctggagcccagcacacacatgccaagacagaacaagaaagaccctcgctggcaggcaggctcctgggctcctggctccagagatgggccagccaggcaggcacgacttccagctgcacctctgagggtggggccctggctgcccaggtcacggccaactgccaccaccctgctcctccctcagccagcaggtgtcccctgggcctgccacctaccaggccccagagcaaagctccctgctgcccccagcatgacactactcctccccaaacctccatcaccacctgccatgcctacagagcacccggggtgcgtgcacacacgcagctgggagaatgtggcctcaccctgccagctacaagccaggcaccagaaccaacccaggctgacaccggcctcctggggacgtctgggggtggagccaggagaggaggggcagccaggcagcctgctggcatgtggtccaccacctctccacattcaagaccctgggcccacccactgagggaagctgagcccgagaccagcacagatccatgactaatagcacacagaccccggccacaagaagccaggccagggggcagagggccacccagccaggcctgggtcaacagcagagaccacaaggtgggagagtcactcagggggcagggggtggagggagcgaatgcagagcccagactcccccactcctcttccacaaggccctctcattccctttactccaaggagcccaaaagccccacgggcctgggcaggatgccaccctagcctccaggctgaaacccctcctcaggtcccagggagcctgaactcggtccttgccttcccatcacagccaagtacacctcagctcaccgcacagagctggacctcagcaagccagggcagcatggccagggactgccgccgcccgagtgcaaataccagggtgctggcatcacggcacagctcccgcccggcagccaggccacatggcaggagaccagggctgcccccaaacacgcagctatgactctgccctggcccccaacccagagacaggccgcctgccccctcctggggcattcgaggaaccggctggaagcaagaggcagggaggtgagctggccccgaaacccagtgcccggactccaaggaaggcaagggcctacccggtcccatcccacacctgaccggctggcccgcggggcgaagagccagggcggacacgcgatagcccgccacattcctccaagacctccctgcccccacacccactgctgccaactcgagcagaaaacacatcctcaggtagcgatgtggggccacgctggctcaggcccaggtgcagatgacaggctgcgggccctgctcagacctgcctgctgcaccgccgtgggggcgaggggctgggcttctcacaactgcctgggccctcccatgcccgcccctgccttttccatctgggggacactttcccctctctggggcccccctggtcaagggatactcggcggggtgctcacgggttgaggacatggccagaggagactgtggccagcttccacgggtgggagctcaggaagcggtgaggatgggggcagcaggcaaggctgccagccagggctgcaaaggtacagcacaggactgggagccacacacggcaggcccaactggcgtgagctcggcagggattgccctcaactcacaatcacttcagggcccaggataccaggtgggcacactccggtgcctcctgctgactggagccacttcctggctcccagatccatctactccctgatcacaggtctgcatggtgctctcattcccgcactcacccagttccaggcccccagcacaatgaccaagcagggaaggacctctgggcaccagggcaaggccgtgctccaggcaatgaggtaaggcgcccgaggcctgggcctgcccacctaccactacccacctgccagcccactgggatgagtacctgtttcccagtgacactggacccctaccacccctcctcccagcacgcccaggccagggctcctgcctgactggccacctgccaggggagaccagacagccccgactcagcttctgcccctccagaataacaaaaccaaaaaaacccacaaacagggcagtgccacagaaggtcactgcaccaggatccactatctctgtctctgaacgatcttgggtcaccatcgggggcttctgccgacataagcgttaggcgttaggctctcccgggcctaggtcccacggcgcccgcccgtgccccccaggcatccaggaaactgcagggcaggcgcaggctggccacgggcccggggcggctcagtcagggcctgccctagaccagccccagcacgcgctgcgcacatgccaccgcggcctgcccgggaccggggcgcctcgcctcgcctccccacccagacagacacgcgcagggcgacgcaggcacacgccgcacaccgccgcgcacgcgggacgccgccgccccgcccccgccgcgaccccgctcccggtggccccggggccccggcgcgcccacgtggccaggcgcggaccaagtccccagagcacgcgccccctgccggccccgccccgcctgggcgcgcgcggctcgcacgcagacccggccgcaggtgttgggggtcgcgaagcgcgcggggccggggcgcggagagagagggaagggctggagcacgagggatggagcgcacgtaccggccaggcgaactggaaggggatgacgacgaggcccgggtcctggtcgccgccggcccgggcccgcgcccgcgctcggtcccccgcagcgcccgccggcggcaggtagaaggagttgccgcccagcacgggcgtggcgccgtggccgtagctgcagggccccgtgggcgtcaccttggcctggtactccttaaggcacacgcgcacgtacgtgtcgcactcgtcgtggccgcagccccccgcgcgcgttgtccggccgtcgccgtcacagcaggcgccgctcagcagctccccgttcacgttccgcagcgcgctcagctgcagctcgaaatagcccatgggccgcgccgcctaaaaataaggcagcgggagagcggagggaggcgcgggccggggtcggcgggccgggcgccaggggtgggggaacaggccccgccgccccgcccccacccagccgcgcccgcccggagccccagccgccgcgcgcagcctcgagggcttccgaaccacggcggccccaggcagtgcccgcccggcccctaggggcggcccggtgtgccccgtccgcgacccccgccgcccccgccgccccgctcacctgcacccagagcgccagcagcagcagcagccgccggggaaggcgcccccggccctgcgcccgcattgcccccgcgacccgcccgcccggccccgccgccgccgcccgcgcccggctcccagccgccgcgccggcctcccagcgcccgcccgccctccgagcgcccgcagaggcagcggcagcggcagaggcggcggcggcggcggcgcgggcggggtcgagcgcagcgccgcggcgcgcgggcctgggcggcgggcgtgcaggggcggcggcagctccggctcgctggcggccgcgctccggctgcccggcccggctcccacccggcggcgacggcggcggcggtgaaggcagcgggtcccggcctcggctctgcgcgcccgcgctcccggcaccgcagccaacaagttcggaacgagactgacagctcgctcgcccattcgtcacccgcgcacctgcatatgcatgagggggcggggccgcgccgcggggtggggccgggggggggtccgggggcgccccaggctttaaaggcggtggagggcgtcgcctgccagcgccccggcccggcgcgcgccccccagggcgcccgggcggcgggggcacggggcctcggggtcagcgcgggccgcgggggccccgctcacacctccgcgtgagtcggcgaggcgtgcgccggcgccgcaaagctgcctcccctcctccgcctgggctcctgccgggtgtcagaaaccgggggtggggcgccccgaggttgccgtgtggtcccctcccatcagtgcgccaccgccgcgctcctcgcagtcccagaggagatgccgcctcctactctgatcagggctcggcccccacgcggggtggcgcggccctggggccagagccgggcccagcccctactgcgcgccccccacctcctccgagaatctccccttctccgcgccgctcctaccgcctccacgccggctgcagggggcgctgcgcccctccgacgcccctgccttcccctctgcgaggcgcgctggtcaagcagccagtcaacaaatgctccagggtgcagactgctcagctcggcgctggcgtcgaggtagccaggccatgccctcaggaaatgctcaggccacattccccgtttcccgcctctcgccccccaaactcaggtctgggcttggggggcgagaggcgggaaatggggaacaaaagtcggcagtgcctgtccctgaaggctaccccgagagaggcctcccactgctgccctggtcaccaggcttccacaccccatcctctgcggtcacctccttgccctctccctgggtgacctcgcagctcctccacagggtcaaaaccaatggcaccttcctctcctccagtgagcacggtcctttccagagctaggggtcaccttggtggttaaagatccccatatggtccagaggggtcctcaacccatccccatgataactgagctgtcttctctccccctagctcctctcgcaaatttgccctgtgcccggagctgggtggctgtgcagccccccagcctggagcaagtcactgccaccatgctgctggggctgagggctgaaggaagagagctttggaggcacagggcctgtgaacaccccatgcgcagggtctgcctgctccatccctgtttagcagctcctccaggatccaggccgcaggctcagctgaaggtccctaaaggggtgggtgggagccccccatgcccacctcagctggctctgctcagagtgcccaccccaaacttggtggtgggtaggcttcgtggggattaagacacaagccaggatgaggcccgcacagagacccccaccaaacaagagaatccaagctgtgttcagagccttccagttgccgccttccggtgtgtgggcggtgattaccgcctacggggggaggggctccctgtggagatgccacctctcctgtgctttggcctgggggcaggtactcgggtactcgagagagggaagccccaggacagagaagccccctgcccggctccagaggcccagggctccatccccacctgcgcccactgccccactatggtgggggagggggtgctgggtgcctctgctgggcacttggccaagtggtgaacaagggagactccgcccctgcacaccctcaggagcccccagcccgggggtggacagaggacttagacaagtcatacagaagctggcatagggggccgccagagcgtggacgggcatgggtcagccagacctcacgatgtccatgagagcacccaggtcaggaaggtggccgcacctgcccttaggaaggagggggacataggaggcatcggagagggggtcccttccctgcaggaatttcagcagcccttgagccagaaatgccaggcagctggaccctggtttgagtttccagaaggcagcagtgggaaccctcgcccctcatacatatttcacaaaacacatttgccccctgctgcaccttgctggggtgaggggctgagatcagtggcggccagggctccagccccaaccctcaccagaccaggctacctggtctcttctagtaagggacctcgtcattgttctggggcccactggaccacagcaccctccagcctcccagagccacccgtcccccagcctggagggctcccactctgagcgctgggcggtgcccagcttgtatgcagagggcaagggtgcagctgctcagcctggccaggggctctgggcccatagggcagtcctggggaccaggctgaggacgggctgccaggggtttggacagagccggcgaggctccagagtaagctgtgcttccgctgggtcctgcagtgctaaatatagcagacggggaggggagtttccggttacaaccccccctccagtgccgggaaatcaatgccagctccattaggcccggcagcactgcctgctgacccaccccatcgggctgcggagcaaagtgaggggctggactacacccaggtccgggtgccctgtcacctgtcccctcagtgcttcaggggccagacccacctggtgcctgcgagaggtccctctgaggtagtgggaggcctctgctggtcaacccggagggcccatcgcactctcgtggtgtcaccaggcaggctgctggtaagggcagcacagcaaggctgctgtgggtcaggcagagctcctgtcctgtgaatgtcctgctggggcctcatctgggtagagtgaagctgaggctggccaagacccgcacaccccatacctggcagcccctccctggcacacaccccatacctgacagcccctccccggcagccctgtcgctggccttgctgatgcccacagggccccacctgggccacagccagcatttgcatacaggtggcactgcttttgtgggcccctgaggcacagcctcctcaggacagcctccaatgccaggctgtccagcactgtgctggatgacaacagggggtcagtctccacctccctgcccagggttccaccctgcagggtactgaggctcccttcacttcactgtccccttctctactttcctcctgggagccacagcctggacctaatgatgtccaggagcggatcgatcctgccgcagactgatggcccagcagtgccctcgaatgcccacaaccagtgccaacacacccattcacctgcagaacccttactgtgcacctgtggcccaggaagcagaccaggcgagctgggtcccctcctgcctcacaagcattctgggcacctggggagcagctctgagctgcacgcatctcccacagccccaccctcaggacaggtcagaaggcaaggccagggcatacaggccagagatgctcaggggccagtagagcctggtgctgggcggcccaggctgaggccgtgccccgggaccaggaccgggctggcaccaggaacctggcccatgtcaagaccactggccttgtgtccccaccctgtgccgccacctgctcctcttggagcaagcctgcagacatttctgcataccccacaggccgaggaaggtcccttggaaaacttccaaggctgggggtgcacggatcagctactggggcccccgacacagggcagctttggctccgggctcctgtggagtggctctagcccagccccagtcagggtggggacccctcacttgccccaggagcagggaacatactttccctgcagcgtgcagcctgcagtgctgcccaccccatcctaactcctgaggactggctcagccaccactctcgtgagcacagctcatgctgcagccccgtgaccagcaggcccacccccaggcctgccatgccaccctccatgagtcccggaccccacccctcccagctccaagaggaggcacagcctggccctgcccatggcatccccaggcctgtcctcagccccacagcaaccacctgcatggcctgccaccagctactcctcctacaggagagctcgccgtgtcccgagggccatctcaggtcagggtcactgcttcccgccccttccccagtcctctccaaggccctggtcacagagctcagaaccagcaggcagaagctggagctatgcaagcctttattggggtccgcggggtgtggggtgagtggccaagactggcctctgtctagaaccctggagtctcactggagatccaggttgggggccacctggctgaggaaccatgagacaccaaagatgacgccgagggtcttggggatgtccgggtcgtctgcaaaggcctgggcgccttccaggggcaggtgcaccacctcaatgagctcaccctcctccaccaggcccccacctggaccgctacgctgggcatctgtcacctctgtgtagaacatggtctgtctggagccagtcagtcccactccagacctacgggttgagacagggtctgctgagtcacccacgctggccccgctggccccctggcccttctaccaccctccaacccaccctctccactctgctccctccagccctccagtaggcaggactctgggatgccctctcccacccggattcccacctggtgtgcacgcccgtggcccctcccgcagcagggcatcccttccctgatcacgttgtactcgccaggtggggtgggtgttgtcgatgtgattaaggaccctaaccggtgacttgagctcatcagaagggagagcatcctaggcgggcatggcccgatcacgaagccctccagagggtgtttcaacgccagaaagggagaaattcaggccagtcctgctggccctgaaggggaagcaaccgccatgctgggaagggccaacagccagcagggaggtgggacccagtccccagccaccaggagctgaattctgccataacctcgtgagccgggaagaccccaagcccccatgagattgcagatccggctgacaacctgcctgcaacctgtcaaggccaagcagaagaccccacccctgtctgcagcccccaaccagataccctgaggctgttcccagtgctgtttggagcccctcagtctgtggccagctgcagaggcccatgccagaccccagcccatacccggggacacaggctggctgggaagcagggacaaacccaccaggccttcccgcaagggttccccaccaggcacccacaggacacaagtttcagactaggaacagcatgcactgaccgcccccccaccccccgtagcatggcagagtggggtggggtggcagcgaggtcctcagtaccaggcccagtggcccaggctggggaggggtaagaggaagccccctccctcagtgggcagtggccagaagggggctgctggcagccaggaggggtcaggcaccaagggaaggagcctggactggcgtgtgtggagggagaccacgggctaggaggacaggatggcagaggggctgggctgcattctggaacaggagggggagggccaggtgtggatctggggagaaacgggactgaggggcatctgggaagatgaccagggggtgggggagccctggctcgccgcaggaggggctgtcgggtgccatgaaccaaggccagccggaggcctgcagggtagaggccgccctctgagatgtacccaacatacaggggcagggacagaactgggggcttccatgccccacccccaaggcctccccacctccggggggactcaccccagaccgaccttacccagctgcttccttgccctctagcccctcacctcccgcagaccccttcctgatggcccatttccggcggcggccgcggctgcgcctctgagggaagtggcgggtctggggtttccagccccggtttccgccggcttgtgaaggagacaggcccggcccttggcccgggctgagaggaatctgccagccaggctgggcaacgcctcccccaccccagggcacgttccaacttcactccatcacgccccaagctgactgcctccctgggccttgtcctttgcagcggcaggtaagaggcctggctcacctccagaatcagagacagggagccacgggccctgccacagggtgggtgaactttgctgtcagtccagccccccatcaggccctcagagacggacaccctgacccctagtcagcagcatctccagtcctgcatccctgaagccacggcctgctcttcccgatgcgagtctaagcaggatgcctacttcccagagccctccttggctccccagcaccctcacaatcaggctgtggcccagaggctgtaccagtagaaccaccgcggccagggctgcttgaccacttgccctgagagcctgtgcggtccctctgccaggaacctgcccaggcccacctcctccagggggaccaaggggactccagcccctcccatgcctcccggctgtgctcagtactatgggctggggagctgggggcacagtgggcgtggcccaccacggggtagacacctgcagaaaaccaaggcccatccttcacacccaagtccacccttcggcatggaaattctgttttgttgagacagagtttcgctcttgttgcccaggctagagtgcaatggcgcgatctcggctcaccgcaacctccgcctcctgggttcaggctcaccgcaacctccgcctcctgggttcaagcgattctcctgcctcagtctcctgagtagctggaattacaggctcctgccaccacgcctggctaattttgtacttttagcagaggcggggtttctccatgtggtcaggctggtctcgaactcctgacctcaggtgatccgcctgcctcggcctcccaaagtgctgggattacaggcgtgagccaccgtgcctggcccagcgtggaaatgctgcctttaacttgggagtccacccatccagccaggaacgtgcccaggtgaagtccttgaggctgctgaggtgggagggccccaggctcaaccctgagtggcccatgtgccaggctgacaggtgcagagacttccggtgcttctcccagtggagcgggccctggcctctggaggaggctgtggaggctggtgctcagctggtgggggtgggggtctgtgacaccctcctccttccccaagacctcagctggggtcaggagcccatcgtagcgtccctggggaagtggatgggcttcataccaacatctagtcctgggaaggcaaccccaccccagctggcagccctcgcggggcaagagttggtgcctcgagtttggtgggtcaggtcccaaagcgcaggctctagtgcctgttccccaggagagctggagccaccccttctccagcccaggacacagcttctccctcattcctaagccaccctctgagaacagagctgtgagtcacccccacccccagcgcccggtcttaatcctacaggaagtagaggcacctgtcagcagcagctgtcacccggcctgcctcacacagctgggggccgcaggctgggggcatggggccgagacgctgcagagagagccccaagagcccagattctggcctggcttaggagctgaggcgcattcggtccaaccctcccctaatcccatgttggaaaacaaggaggaatccatcctgcttgcacactcccagggacggggccctcactctctcccatctcctgagtcacaccacaggcctgagggcctggtcccactcaccagtatgtggcgacccggcgcagatcagagggggccaagtggtagccacactcctcccaagcctccttgcaagccacttcctccagcgagagcccaggctggtccacgaggccggcacacagctcaactgtcacccccgctgagccgggcagggctggctgtagctcccgaggcccgtcctggtctacagctgctagggaccctgggaagcggcgctccacctcacccgcatacacagctgcgtgggaagaagccagactgtgctcacagccacgtggtggccacctccaggtcacccacacagccaagccccctcccagggcctcagcttcccctggagccccctcccacatctgtattcagaccctcaggaccacagggacctgaaggtgaccctgcagatccccttcccaccccagctggcctcacctggccggaactgcttcaccaacaccaggctcctccgagaagagttgaataagagaacggtcacgctgtgtacggggggaggggctcagcacagaagcactccactggccctcgtggggccccacctcccatctttctgttcccagcgtggccatcccacctccttgccagcagcccagggaggtcaggccccttgctcagataggatggctgaggcccaggcgggaccagagctttccagggtcacagtctggccaggacccagacctgctgtattccagctggcaggatgggaggcggggggcagggaaggacacacgggcagctgagtaggtcagggtgctcgcagctgaggccgggtgactgacaggacgtttggccctcactgagcagctgcccaccagccacactcctcgagccacgtcgccatccagcccagaccctggatgctaggggcaaaggctccaggacagcctctccctgccctgagagggcctgcccaccatcatggtcccggtggcctgagcaaagacctgactcagcccccaggcctcaggctgacccctcagggataggaaacccagaggccgggcagagagaagggacttttggagcccacgcagggaacagcaacgtcagggaggagagggcaccttcgccctgggcccagtgtccccgtagacatcagtctggggcttccccagtggccaggctgggccaggctctcacctgtcatgcgtcttcatgaagtcccaggacttctgggcaccattctagaaggggcaggtcagcggttagaatgtcccaggatgggcggaggtgctcggggaaccgaggaggccacagacccattgcacccactcctaaccagggagatcggctcgtggcctgggcccacgggagccaggaactgcagctcccgtgggcagaggagcaagcagcctgggaggggcagggaggtcaaggacagcctaataccctacgagtgaggcagaagaccagggcaaagggcagggaaggtgtccaggcacctcatgaaacactgcccagcacagaccgagcacaaggggctgcagagagacgtacaccgtcaccaagtataggaaggctcatggaggctcggggagggcaggcgtgactccctcacagcagggcaggagggccctgcaggcagaggagaggtcaggttttcctgctgatgcttccttgggccactgaacaggtggagacgggagggcaggaggggccggcaccaggagtggatggggaagggtggcaggaggggctggcaccaggagcagatgaggaagggtggcgccccagccaggtaggagatcgcactgcaggactcggtgactgtcatgatggtgaccaggctcggcagcccccccacacacccctacccccagtttctggcctcgactctcccacataccctgtggtcccgttctcctgtggccaccctccaccttcccactcccccacactgggcacaccaccctggcaggcccctgcaccctgggtggcactcagtgaacggaggaggcagggtgggcaggtgtgtgggctgggcctgctgggggaggctggaactgatgcattctgagatgcactcccatcctgggggctgagcctggggtcccgcggggtcccatctccggcacgctcagcccatctgccactctgaggcccaggccagctgctcatcccccaccgggggctctgcccagggctgtgaaatggacaagaggtctgagcagcagagacacagaagtgcagccaggactgcagaagagagaagaagccttcctgaggactttctggaggaggtgacggaagtgagggaagggactctgggcaggcagaggcgcagaggccctctgagcttggccgggaggcaaaggcgtcctgggaggagagtaccggtttccaagggaagggagggccggcgtcccgcgcaggtcaggcagcccgagaggccgtggggtaccactcccgggaggcgaccccaggcctgcctgacacccagccacccccgaaccaccacccagccagggcaggctccagggaagccccctgcccacagcctgccatgtgcctgctgtgcccatgccccttccccaccactgcttccccccgagtaacatcaccccatgcaggtctcaaggaccctctcagctca

SEQ ID NO: 652 - DNA, 17064 bp, Homo sapiens
atcagggcaggcgcagtaatagtcaccctccaggttatagcagcgagcgccgttccggcaggggcttggctcacaaaggtcgacatccacctgcagggtggggggtgcctgtgagagcctaggcccaggcccaggccgggaacacaggccaggcctctgtccatacgaaggtagatccctggggacccccaggcccctccgccctgggcctaacagtgccagccagagcccaagacccctgcccacctgagactgcccaggccttagctgaacgcagatacctgtgggcccccacccccacctccactgcagcccagcttcctcactgtccctcgggaggagtgtggccttggcccctgctgctggcaggaaggacagctcctgagcccctcacacactgcctggccaccctcagagccaagactgtgggtcttttccagggccagccactgccatgcttgcaggtcctgaggtcagacccctgccctgggccccaagaagccctctggacaggaggcccatcctctgcaccaaggccagggcaggatcgtgggcggccgagggtggtagggaggtgggtggggggaggcagggaaaaaggggaagtaaggggagggggtggtagggaggcaggtaatggggaggcagggttgggggaggtggggaagggggtggtagggaggtgggtggggggaggcagggttgggggaggtggggaagggggtggtagggaggtgggtggggggaggcagggttgggggaggtaggggaggggtgatagtgaggtgggtggggggaggcagggttgggggaggtggggaagggggaggtggggaagggggtggtaggggtggtggggaagggggaaggcaggttactttggaggcaggggggaaggggaggttgggggagggggtccagtaccaacagatggtcagagggaggcgagagcatcagccctgagagagatgcccactccgacccaggactcacctatgacaggtgtatacctctccaccatcaggcacccaccctaccccatgtgctctgcccaccagagccccctgccctccagtcccgagggagtgcacagatggacagataggcctgggcagccagcagcccgggggctcctagcccaggccaccaggaaacccatcacaacaagcaatggccacagggggccaagcctggtgacctgtgacagccccgcctgcccacctggcacccagtggagagctgagcctgggacgccttggggacaacttcccctgcagcacccctgggtcactcaggccccatggtcaggggacgaggcctgccctacagctcccagagcagcaggtggggcagggtgaccaggcagacctcacctcacagagaggcccggagaagccctgggggcagtggcagtggaagccgtcggccaggtcctcgcagaggccgccgctgtggcaggggctgctggcacactcgtctcgttccagctcgcaatgccggcctccgaagccccgtgggcacacacactggtacccgttcaccaggtcctgggcgggccagccaggtgagcgtcccgcaggcaccctgacggccccgcagcacccacgccacacaccctcctggccccgcctcaccttgcaggtgcccccatgctgacactgcccgcgacagtcgttgacgtctgggggcagaggagcagggtcagaggcggggtcccatgtgcctcggcccacccgccggcgcccaccccccatactgactgatatggcagttgatgcccttccagcccgggatgcaatcacagtaatagccgccaatcaggtttttgcaagaaaaagcgttaaggcatggcttcccttcacactcattggcgtctgtgaaagagacaaggtgggagccgtggggctcgggccctgcctgccccctgcagcacgggcacctggcacccgcagcccagcagccccagcagccccagcagcccccgcagccccagcagcccccgcagcccgcatgcgcggcccacgttcccatgcactcgctcggagcccttacccagctggcaggtggcccccacccactgctcggggcagatgcactcaaagccgtccacctggtccacacaggtgccaccggccgcacacgggttcgaagcacactcatcgatgtctgcagagggtggagaaaggtggggccctggcagtgtgagccgtgggaataaggtccccatgggcaggtggcgctgcaagcctgggtcttcctgccatttgtcctcgccaagccagccgcagccacacgtgtggacttgaccactgcaccccatccccagcgagttgccccactcccagacccccactgatactaggcaggagtcccctactcacgtgcagacactcaccaagggcacaggtgggcccgctccagcccgatgggcagtggcattcgaagccggacggcacctcatggcaagagcccccgttggcacacgggttggaggtgcaggcgtgctcagctgtagaaccgcggggagggggcagagctggcagccaggcccccagctttccacaagcactcctccccaagcccacaggttcccaagctgggggtcaggggcccaccacacaggacgccagagggatggggcctgaccggctccccagggaaccagtccctgcctggccagaatttgggtggccagccccccacgtacccttctcacagttcctgcccgagtagccgtcagggcaggtgcagcggtactggtcaggctcggcgttgatgcacgtgcctccgttggtgcaggggtggtggctgccacagtagttcaggtctgggggcaggggtgggatgctcaggggaaaagccggccccccgctcccccacaacccacacttcgatggcagagcattaggcctgccgccccctaccactacctttgtcacagagcaggccgccccagttggtctcacagttgcactgccagggctccacacaactgccatgcacgcagccggggtaggggacacactcatcgcagaacctcccttgccagccgtagctgcacctgggggaaggaggaggggcgcaagacccagtgagctgtggtgcctgaaagggtggcaggggagccaggcacagtcacccacgccacacccagggccggcgggcggcctcaggcctttgaactggagcagccccagccaggcaggggttgcagccctgccggccagccccactgtcacgggcattcccggccgctggctgccgacggtcagccccagctgtcccgtcactcctccctgagctattttgggattcacccgtgagctgggccccgagagcaggcaccaggaaaggaaggccctgccgggaccccggggatgagaatgccggctcggactcacaaggtgctgccagggccgggaggcaccaggggctgggtaggccagcgggcagcaggggagcactcctggctctgcctcggccatgtggccctgggcacagcacgtgccctcgcccccacctcaaaggcagtcatttcgctcgctcccagtaaagtcccacaaggtacccatctcacagatggggctactgaggcccacaggctggcctgggccagccctgcccagggtagttcctgattctgcaggagctccagctgcacccccagctgcaccccccaggacacaaccaccaggactcgccctgccccaggctatcggccaacgtcctgtcttgggagtcccccaggagagggcaggtggccagggtagaacatggcctgacttgagggtgcctccgtcaggggagagagcctgcaacgaccccaaggctcagcaggctgccatccaggccctgccgggactcccggggggcccttcctagaactctccggtcctgcaggacgggaatgtcatccaggccacgtcacttccacaccggcacccgccacactttatttttgtaaaaggaaagaaccacggcccttcctgagccgccctcaagccacacagccagcaccgaaggcctatcagcccagttcagctgccacaaatggggaaactgaggccgggaagaacgtgtctccagtatccagcccagcatgcacagtggtccgcgtgggtggcctcacatcccgcctagaatccctcctccacagacacagagacccaggctcagggcggggctgtgacacaccttgggtcatcggccagagagcggccacagccgggctcagagcccagacctcgtgggtcccaagggcgtgctctcgaccctgggcagggcagcccacaccaggcccccacctcctggtttccccagccagcagccccagggccctggagaggcggcggcaggaaggcatggccatctccgcagcatccggtgggggggcgtcctgcactggaacctgagccgaggctgtcagcaacagctgggcctccccgacagggccagcaagaggggcaggcggagctcacctactgcccccacccaccaggccccccagactccggctcatcttcctgcgggtaaagggcagggatggccaacttctctgctgccttcctccagccttggtgtgacattcaagctgccagccagcagccatccagggagggtggcactgccatccaggttgtgtgatgcacactgggccaggcgagggtgagtggggccgactcccgtagatctacatctacatctgcccagaccaggtccaccttgttgcactttctgagctgacttgggactcgctcaacctgccgggaatccctgtgtgtgcaagtgaccgggtgggcggccccagccctgcttgcctccccgctctgggactggccgggaaagctcctcactgtaccctccaggccactcaaccgtggggcctgtggaagggtcacccacctccccaccttggctcccaactcagctggttcccaaactccccgactcctctccaaaacgccacgctgtgtgaccctggggaaatcagtaggctctctgtgccccagtgtcctcgtcccatggaggcaaacccactccacagagggaggtcctgggacccctgcaatccaaggctggctggagggcggtgctcacctccacctgctgtctctccacccgctcgcgcccctctctcgggctccccagcttgctcacgcacagtgagcgccacggctcgaagcccgtgcccaccccagaccctgggccccagcccctctggttgccctgctgacttctctgctccactctagggcaaagctgccagcccccctggctggatcccccacactctggtctgggtccagaggcctccaccatctggacttggctgtaagaccccggacactcccttgtggaggcccttgctgactcctcatccatccgccctgacctgtggcagccgggacttgctccttggcctccctcctctctgccttccccactttcccgtcaccgcctgaatgccaccccccacaggccccgcgtggcgcaggccaggcctctcccacgagctttctgggtgtctccagggacagggcaggcatcgcctctccacatccagctaaccccggccccgcctgctcctctgtggcattcctcctgccaccatggctctgctactcagcagcttggggttctccctgactccacacccttcctgcttgatcaaatccatccacaaacccctgggctccaccccaggatgtctgcaggacccgtgcgcctctcccccttccactgaccccctccccatcccgctggcccctcccccaccacccccacatgccccacagcggcctccccctcacagcctcccgtctggtgcttccccactcaacagctaccacagcccttccacccaccttgcccagctacaaacctgccagcagccccttcctctgtccctggtcctgcaggcctcagctcccaccactggtctgctctgccgcccctcgcctgctggtgtcacttgccggccgctcgccgcccaccccctccccatgggcagggttaccgtgtcctctgcccatgccccatctctgggtggcttgcagcctccgggtctctgcccctcggtgacgtgactgtccagccagcctccccagtctctcctcactgtcctcacatggctgccgccatcagacacatcccatgctcagacacgcacctactgcactaaggagcctcccgagctcagggcccggctctcacagctgtgtgcccaacctccagccagctccgggcgactcctgacagcaaggctgtgtgtgccagtgaggacgtgagggcaaaggttgggagggcaaagacgggccggcggcacactcacctgcactccccaggcacggtgcatcccccgtggagcaaattacacccttgtttacacacagctgcgaacagagaggagcgagaggcacagctgcagccagcctggccgcaaggcctgtgcccggggccctgcccgaggccctccctgccctccacgcagcccagcggccccctcaccttccttgcactccttgcccatccagccgtccatgcaggccttgttgccgtactggtcgcaggtgtagtggccgaaaaagtcgttgcggggccggcagaacttgttgcaagtggcgctgtagtagttctcgtcgcagcgcacgcggatctgcagctccaggtgcgccacgtggccgctgaagtgcaggctcttccagcggtcctccgggttgatcatgccggcatgcgacactcgctcgatcagcagctcctcttggggaggcggcagagtcagcacaggccagagaaaccagcccggccaggggtcctccaggaacaacggggacggggcagaagcctgcggctgctgcaaggccggggcacagcaggcagcagcacacggagggcagggcccccggccaggctgctacagaaagctcagggccccgagaggcctctccctcccgccaccaagcctgcgccccgctcccaccctaaacgcagagggtcggggggcccggctaggggctaggggccctgcagggagggctgctgagaccacaggctccacagagaaggcacggctgctgccagggcgtgagtctcacgtcccacacctgtgcccacccacctgcagccctgctccaacacctgcacccacctgcgccgtgtccagccctcgacagcacggacatggtgctcagttgccctcccctctcctgcgctgtgacttgctcccagaagtgccaaacaccactaccgtccccaccttaagacaagcctcccctcaggcccccaagacaggcataggtcccgtgacccgctgtctaagcctcactttaagtaagccaccaggagaccaggggccaggggcaccacagctgctggcgctggtatgcaaagtccgtgatgccggtccctgcgcttaggcacaggctcgacgttttgcacaataaaaggtgaacgggtcctccagaccccacctctcccgcctcgggccaaggcctgggaggacactgtgctggcccactccccaaggggcgtcccggccgccccagcctctccaggctcacgttgtcaagagccctgacgaccttgcttgggactcagcccacctgtctctctgccaccccctcaggaaacacccctgccctgagccgctggggtccccacaactgctgctccccacctgggcacccccaccgccgtccctgccctgaaaacagcccctccactctgctggcagccaggatgccctggccccgctctccctcctccaacccattggccaaccccatgcctccacttctgagagcccctctcacccccagactgcccctggtccaagtcaccctgacacgcccagattcacgtggcagctcctcctcggtctgtgtcctggccccacagcccaccctccataaggcagccacagcttgccaggcggagcccgtgtcctctcagtggcttgccagcctccatgatctgagcccagccccggctgctccccctgcacagccagcccgctcctgcccagaccttcacacgagctgctcccttggcctgtgggtgcttctgcattcacccatggaagtcatcccgttacccctgcagggccctgcagagcccctgcctcagggagagggccaccaaggctccatgctccagtacagacaagcagagggggccacaaagccagagacacactcaagggtgtcccctccactaagtcactgccatgggccccaaaagagcacacccaagaggagaacaacataggcaaagccaggactggggaagagagtgcatgcacagctctgcaagtcccaaacgtggcagagcttcctggcagccaaagcaaaaagggaaacagcacacatgatcctcagggtaaagcaaggctttgtcccaagcagacagaggagctgggccctgccacaggcacgctgaagctgagaggagctgccacctggcccagggctcactcaccattcggggtggtatcgttgtcccagtcccaggcctccacgatgagggtaaaggagcgctgcagacatggggaggcgggtcaggtacctgaggccacacctgcctgcctcgttcagggtgggacaaggcccagggctcagacgctgcccctgggtctgccaggctctggcccttcctccccagccagggacccaccaccctcctcatcctcaggccacatcctctgcagacccaaaaatgacccagctcaagggagggagactgcccctccaggccacgcgggctcaggggcctgggctccctaccgttggggtgccagaggcccagcctgccctgagctggctcaagtcagcacggagcacaggaagagcgaccggggggagaggtgggcaaagggcagcctggctggagtggccacagacaggggccccatgggcagccgggacccgagcgtttcctgtggaacgccccttggtgcctcactgggggtgaccacgggggagaacgtggggccccatcaccacgctggcggcctccaccaagtgcacggggtggccaagtacagggcgcccagccagaggccccaacaggccggagctcaggtcctgcaggcatacagcacacaggcaaacccacacctacctccaccctcacacagaacaggtggcaggaggggcccttgcggtacagttggggaaactgaggccaagaggtcctgggactgcccagcacagcctcagaccatggccactatgccccctctgcccccgggccacctggcccttgtaccccagccatggcgacaggcgatgctgtcagccaagcaaagagaccacagggctggccccctgctccgcctagtgcagcccacggagaccgtcactcacagacatgctcagacaggtgggacccccgggacatgccctgtactacccagcactgggtacccacattccacagcctctcagccctcactgcccaggaaccccccagtctacccctggtgtgctcttgacccctgagcccagccctggctccttccaggtggggcccagaggagggggctggggctgagtcacctcagggcctgctggcttcccaccccggggggatgctgcgttgggcagtgtccaggcaggccaggctcactccatccctcagcacaccccatccaaccagccccaaggcctggctaagctggggaaaaccacacttccccagcaaggcccaaccccacgcctgccagcccttccctggtcctcacccgccgcccaccccacgcacgtcccagtgcctcggcctcatccagctaaggacaggcctggcctcccaagatgtctcagaagactgcactcccacgtccagcccctcccctaaccaacgtgctaccagccacacccagcccagcctccaggacccccacccagtcccccgccccacacctccgactgtccctcaaatacagacaactagggcccaacatgactgctgaccctgggcctcactcacagctgggcaaccccggccccgcccccgagcccctgcctgcagaacacccggggacggcccgaggaggctcacccaggtaggagcacaggatggaagtggggggccatccccaacccgctcctagaaccctccctagccacgtcgagctgacaacagaccctcaatcccacctcttaagctccccttaaacccgttttcccacatccgccatggccccgccaggccacggggcccagtccccgcccatctccagggctccctgaggtcaccagggcccgcaaacctctgcctacaggcgccagacaatccccagagttccatccacatgcctcccaaggctccgtccacaccccccgccgagctctgtttacaccccccagagctccatccacacccccaaagaactcaatccacatcccccaacggggttccatccacaccccccaacaggctccatcacctccccagggctccatccacaccccgcaacatgctccatccacacccccccagagctccatccacacccccccagggctccatccacacccccccagagttccatccacacaccccaacatgctccgtccacacccccccccagagctctgtccacaccccccaacatgctccatccacaccccccagggctccatccataccccccagagctccatccacaccccccgagttccatccacaccccccaacatgctccatccacacaccccaacatgctccatccacaccccccaacagggctccgtccacaccccccccagagctctgtccaccccccccaacatgctccatccacacccccccagggctccatccatacccccccagagctccatccacaccccccaacatgctccatccatacccccccagggctccatccacaccccccaggactctgtccacaccacccccaggactgtgtccacaccccccaagggctctgtccacaaaccacccccgtcagctccatccacaccccccagggctccatccacacccccaccaggactctgtccacgccctctcagctcagagcacccttggggttcccaaggctcctgcccacccccacccacccaccccagcctatcaacccatctgcctggagcaccaccctcgcagctgcacctggccaagcccttccccacccccggtaacacctggagcacccagccgcttcccaggcgtctggcatttggctccttccttcgttccttccttccttcgttcacatcaagtgtacagcaggcatgcctctgccaccaaggacggcaacctatagccagcggggctcggggaaagcaacagggggcaggggctgttgttccaataaggccaggccaacgggtcacagtggctcacgcctgtaatcccaacactttaagaggctgaggcaggcagatcacctgaggtcaggagttcgagactagtctggtcaacacggttaatcctcatctctactaaaaatataaaaattagccagccatggtggcaggtgtctgtagtcccagctactctggaggctgaggcaggagaatcacctgaacccaggaggccgaggttgcagcgagccgagatcgcaccattgcactccagcctgggcaacgagggcaaaactccatctcaaaaaaaaaaaaaaaaggccaggccaggctttgaacaggtggcattgagattgaggctgcagggcatgaggaagtgaaggagctgcatggcagagcccacaagaaggcccaggggctgagaacgcatagcccacggggacagtggggtcataccacagatccagaccccaccacggacttccttcctgaggctaagcgaagtgggtgactgttgcgggtctgagtgaggtctgttcgggtgttgggggtccgagtgaggtctgttgggggtctgagtgaggtctgttgggggtctgagtgaggtctgttgttgggggtctgagtgaggtctgttgttgggggtctgagtgaggtctgttgttgggggtctgagtgaggactgggacccaccaggctttaacagtcactgtagccgctggacaggaaccagcaggaccaggaagcagcaatagtgaggtcagaggatggggccagcatgggtctgagagcagctctggccacggggcaggcagagaaaagccaggccacccggtctcccggcacagccacacctgggcttcagggccagcagggagttcctctcgactcccaggaaacctcatgccagccactcaggtaagattactgccaccttcgcctgagcccagggctccggttacctgctcccgcagggacgtgtgcctgcccgcccgccgagagggcctcaccgcccgccagctggggtccctacacctggatggcaggaagtcatccagagtgaacctgagctggctgacggggcggtacctgcctcaccccacctgccagctctcccagctccccttcttccctaggggccagcctccaggacttatttgcctcttctgtgaataacaacctctcacccccgtccttccaggactcagttgcctcctctgcgaatagcaacctctcatccctgtccttccaggactcagttgcctcctctgcgaatagcaacctctcacccctgtccttccaggactcagttgcctcctctgcgaatagcaacctctcacccctgtccttcctgcctggcgggccacgatctgggacagggttttgtcaacaccaaacccctagaacacaggagggactatagggcctggattgggcgggggttggcgggcatgttgcccttctaggaacggggctgggacatgtggggatgtgggcctggcgctggcaggggcaataggcgatgtgtgggctgggggtctggggacaggtgagagacccatcacctgcccaggttccccggcaagcagggagaggaacccaggccctccctcaaggccagcctagcagggctatgcccctgcccagtctctggaggccaagggggaagggcttcacccctgcaggcccagctaagcctctccctacaagcccggcctgacccacccccaccgcacaagcagacccgcagcccaacttcatctcccaccatctgattgcctcctccccagcccgaaccctcaaggctaagtctaaacccctcctcctgtccccaggcaggggcaacagcagtggcacaagccagaggacaggcagacaagacaatagatgttccaccccaggccagggcacctcaaagcccagggtaccccaggtccagggcaccccaaagcccagagtatcccacagcccagggcactgcatggcccagcatactccaagacccagggcaccccagttccagggcaccccaaagcccagggtaccccagagccccaaagcactgcatggcccagcacaccccaaggtccagggcaccttaaagcccaggacacctcaggtccaaggcacccaaagtacagagtaccctcctgcccagggcaccctagatccagtacaccccacagccttgtgcaccccatggcccagtgtacccacagtccagggcaccccaaagctcagggcactccaggtccagggcacccccagcccagggcactgcatggcccagcacacctcatggcccagggtactccaaatgccaagcaccctaagtccacggcaccccactgcccactgtaccccaatctacagcatcccaaaactcaggcaacccaagtctagggccctgcacggtcaaggccaacacagcctccctgctgccccgctaacggcccccccaggtccagggccctgcacggtccaggccaacacaacacagcctcctagacctgctgccccaccaacgccccgacttggtttcttctcctcggcctcccgcatcagcctcccgccccctacggagcacagcgcttggtgcaggcgccaggagctccaagcacagatacatttcctgaaacctgagcttctgagaggcccaggcctctgccaccattgtcacccgaggcagggaagaaggggtgggggcaaacaccatccccagggctctgggccccagggccgcagcaggaggagcagaccaaagcccatcccacgcaggaacacacacacccatgctccacaccagagaccagccagggccttgcctgggtgtacccccactccccagcacaccccctctaggtcccaggtcccccaccgtgaagacggtggcagccagggccggctagcacctgccacaaagcccagggtacaactgatgccagccacaccctgctcaggcctgggatgtggggataggaatcccgctcaggcctgtggtctggggacagggactccgctcaggcctgtggtctggggacagggcctccgctcaggcctgtggtcttgaggacagggactccgctcaggcctgtggtctggggacagtgacctcactcagatctggggtctggggacagggaccctgcttaggcctcaggtctgcagacagggaccctgctcagtcctgggacctggggacagggacccagctcaggcctggggcctgaggataggggccccactcaggcctggggtctagggacagggactccaatcaggcctagggtctggggacagggaccccgctcaggcctggggtctggggatagcgactgtggctggggcctgggattgcagatccttgtcttcctgcccccactccaccaccagcagcagctcaggccgaagcctggctccacaagcaccccttcactggcctagcttgctcccctcataaagacaccatggagcagcccaggagggcccctgagagcagcagtcccctcccacccaggcctgccgcctgctccccaacccgcccctccacctcccagccttcctatcgtgctgcggctttgacccttcagcccaccctcagggaccagcgacaaacccccagcccactctccaatcctccctggccaagggcagtcctccctggctccaatggtccccgtgttgcctgggcactgaatgccccaccctgcccccataccaaagctttgaaccagacccccaatgtacaaggcggacatgccctgagttctccccagggctctgggccccagggccatggcaggaggaacagaccgatgcccacccaacacaggaacccagatgcccacattccataccagaccagccagctctcctggtccctactgggaaggtgtgggaaggaggggggtggtccccagtgtgcagacaggatcccctgaaggtagggtggggaggccagggccctgtcatccccagcccaagctcagaaaaaacaggaagcagagtggtgctgaacctcacacctgccacgagcagcttaggtagctccaggcacagacctcagcctggcccaccttgagccctagggcggctggatgcagggggtgggctctgtaaaaaccttcctccctagggggcaaaggagagggtagggaaggctgggaaggggaggaactggacaggtctgggagccgggctgggggcacaagcagagcccgagctgggagtccagcagccccatctgacttcgtgagacctgcaatgaaaaagcggcagtgtgcccctttcacaggtgagaaaagctcagcccttctgatggcccaggacctcaggcctcctgagctgatagacgcagggtcagccccaggcccacctcctgtatctacagggccttcacccatcccgttctcctcataagcccagatctgtcacggggaccatgctccagccacaccaccccgcacagctgccctggagcccagcacacacatgccaagacagaacaagaaagaccctcgctggcaggcaggctcctgggctcctggctccagagatgggccagccaggcaggcacgacttccagctgcacctctgagggtggggccctggctgcccaggtcacggccaactgccaccaccctgctcctccctcagccagcaggtgtcccctgggcctgccacctaccaggccccagagcaaagctccctgctgcccccagcatgacactactcctccccaaacctccatcaccacctgccatgcctacagagcacccggggtgcgtgcacacacgcagctgggagaatgtggcctcaccctgccagctacaagccaggcaccagaaccaacccaggctgacaccggcctcctggggacgtctgggggtggagccaggagaggaggggcagccaggcagcctgctggcatgtggtccaccacctctccacattcaagaccctgggcccacccactgagggaagctgagcccgagaccagcacagatccatgactaatagcacacagaccccggccacaagaagccaggccagggggcagagggccacccagccaggcctgggtcaacagcagagaccacaaggtgggagagtcactcagggggcagggggtggagggagcgaatgcagagcccagactcccccactcctcttccacaaggccctctcattccctttactccaaggagcccaaaagccccacgggcctgggcaggatgccaccctagcctccaggctgaaacccctcctcaggtcccagggagcctgaactcggtccttgccttcccatcacagccaagtacacctcagctcaccgcacagagctggacctcagcaagccagggcagcatggccagggactgccgccgcccgagtgcaaataccagggtgctggcatcacggcacagctcccgcccggcagccaggccacatggcaggagaccagggctgcccccaaacacgcagctatgactctgccctggcccccaacccagagacaggccgcctgccccctcctggggcattcgaggaaccggctggaagcaagaggcagggaggtgagctggccccgaaacccagtgcccggactccaaggaaggcaagggcctacccggtcccatcccacacctgaccggctggcccgcggggcgaagagccagggcggacacgcgatagcccgccacattcctccaagacctccctgcccccacaccca

SEQ ID NO: 653 - DNA, 1519 bp, Homo sapiens
gttaaaacgatagttaacggttgcgtcggtgtaaagacgaatgcaattcgagaaggattcattattattttgttttttcttctgatttttaacagaaattggcgttgaacatttcccccgtgagcgccgggccacgggggtccggggcggcggggggctccggggcggcggggggctcccgggcgggcgggggcgggtctcgggctggcaccgccctccgcgcccgctcctcgcgctcacagcggcccgcgggccgggcgtcatgggcggcctcttctggcgctccgcgctgcgggggctgcgctgcggcccgcgggccccgggcccgagcctgctagtgcgccacggctcgggtgagtggggccgcgcgccccggcggggacgcggaggggaggaaggggcgcgcgccgctcggcctttgtgcgcgcacgtgcgggctggggtccgactcccccagaggcctcggggcgcgggctgcggggtccgtccgagttggggaaggcgccggctcgcacccgcacgcccctccagtgcccgtccggctctgcggctccttctcgcctccccaggccccaggctgcaggcgcccggcgagttggcagcctgggcgggtccggggcgaccgagggcccgggagcgcaaggaaggcagaggccggctgcagcactgggcggggagggggtctcccggccggggtgggggtgggggtgtgggggggtgagggagtcggggggtgggggtgggggtgtgggggggtgagggagtcggggggtgggggtggggggagccgctccgctggggcgttcgctgaaggccaagttaggccagaatctgactgggacgtcaggccccaagtccccggccccgccgctgcccggcccccccagctgccacctcacaggacgatccatgtcccagggctccctccatcggctctgaaaagtgagccgccgcctgcaatgcccgcaccagccgcagcagagccccaggctacacaaggcgccctgcaaactgggttttgggggaacaaaccaaccagggggtcttcctcccgtgggcttcagccgcctgctggggttaacttttcctcctggcctggcggagcccctttggctctgtccagattctgtgggacatacagggtctgggctcctctggaaaccagggacccgatgccggagggtagcttggctctggagcagcctgggactataggaaggtgaggacgtcttctgtttccctggcagcgtcccctccagaggaggacggctggggcggagctcagcgctgaccctgggtctggaagcgacaggccttgaaactccacagcagcacaggccccgtctcctggctcggacagaaccctgctaccttccctcttcaatcttcaggcccctttttgtccgtgtttccagggctcacctggtggggaaagtgtgtttctccctggttccctgccactcattcacctcagacacagggtgggctctgggttcttcctcatgtggaaagtcggggc

SEQ ID NO: 654 - DNA, 15381 bp, Homo sapiens
gttaaaacgatagttaacggttgcgtcggtgtaaagacgaatgcaattcgagaaggattcattattattttgttttttcttctgatttttaacagaaattggcgttgaacatttcccccgtgagcgccgggccacgggggtccggggcggcggggggctccggggcggcggggggctcccgggcgggcgggggcgggtctcgggctggcaccgccctccgcgcccgctcctcgcgctcacagcggcccgcgggccgggcgtcatgggcggcctcttctggcgctccgcgctgcgggggctgcgctgcggcccgcgggccccgggcccgagcctgctagtgcgccacggctcgggtgagtggggccgcgcgccccggcggggacgcggaggggaggaaggggcgcgcgccgctcggcctttgtgcgcgcacgtgcgggctggggtccgactcccccagaggcctcggggcgcgggctgcggggtccgtccgagttggggaaggcgccggctcgcacccgcacgcccctccagtgcccgtccggctctgcggctccttctcgcctccccaggccccaggctgcaggcgcccggcgagttggcagcctgggcgggtccggggcgaccgagggcccgggagcgcaaggaaggcagaggccggctgcagcactgggcggggagggggtctcccggccggggtgggggtgggggtgtgggggggtgagggagtcggggggtgggggtgggggtgtgggggggtgagggagtcggggggtgggggtggggggagccgctccgctggggcgttcgctgaaggccaagttaggccagaatctgactgggacgtcaggccccaagtccccggccccgccgctgcccggcccccccagctgccacctcacaggacgatccatgtcccagggctccctccatcggctctgaaaagtgagccgccgcctgcaatgcccgcaccagccgcagcagagccccaggctacacaaggcgccctgcaaactgggttttgggggaacaaaccaaccagggggtcttcctcccgtgggcttcagccgcctgctggggttaacttttcctcctggcctggcggagcccctttggctctgtccagattctgtgggacatacagggtctgggctcctctggaaaccagggacccgatgccggagggtagcttggctctggagcagcctgggactataggaaggtgaggacgtcttctgtttccctggcagcgtcccctccagaggaggacggctggggcggagctcagcgctgaccctgggtctggaagcgacaggccttgaaactccacagcagcacaggccccgtctcctggctcggacagaaccctgctaccttccctcttcaatcttcaggcccctttttgtccgtgtttccagggctcacctggtggggaaagtgtgtttctccctggttccctgccactcattcacctcagacacagggtgggctctgggttcttcctcatgtggaaagtcggggcttcagaccatgtctgtcgtcatccagaagggatggagtcaaaagtgaggctggagttttgcaggatctccagacttccctgaggccactgagctgggctgtgcctctgtggacctcagggtggtcgctgagctgggctgtccctccctggaccttgaggtggtccctgagctggctctgcctctatggaccttgcggtggtggtccctgagctgggcagtgcctccctgaacctcggggcgatctcaggcagcctctgcctctgctgggaggagccatggcccctgggagaggctagaagccctggggacacattgccttgggtgtccctgacagggactatcatgggggtgtttgtggctgtgggcaccatccctgtcccttccagagtgccctgcatagaggcagacaccctgaagcctggtgacccctgggctctggctgggaaacccgggtcgtggggacgtgaaagggtgaggtggcagtgcctctgacctcttgccttttgaaggagggccctcctggacccgggagcggaccctggtggcggtgaagcccgatggcgtgcaacggcggctcgttggggacgtgatccagcgctttgagaggcggggcttcacgctggtggggatgaagatgctgcaggtagtgggactctgggcttgtgggtgtccctgtggggatggggttgggggatccttctcggcctttcacatcccagccagcgccggggcagggcctggctttggcagttgaaggggcaggagggatctattctgcggtgggggtgctgcccatgctggtgttatctgcaaggtgcctgaggtcagggcatcacagctgctgtgctagtgcccacgtttactgtctgcggctcctccttacctcaatgccacccaggcaccagagagcgtccttgccgagcactaccaggacctgcggaggaagcccttctaccctgccctcatccgctacatgagctctgggcctgtggtggccatggtacggcagggcaggggtggtggaagggcctgtgggtaaagggcgtgtgggtgtgtctttccccccagcaaagggaggggccctggattgagcccaggggcccttggtgttccccacttctccccaaccattatctctcgctgcaggtctgggaagggtacaatgtcgtccgcgcctcgagggccatgattggacacaccgactcggctgaggctgccccaggaaccataaggggtgacttcagcgtccacatcagcaggtacgggggtcctgatacaccaggctgctgctgggggcaaggagggccatcacttggggtggtggcagatccacgagacctggctgtcttgctgtgctaggatgaagccaggtcggacatgacagctcacactggtgagagccgtgttctcccagggcacacagggcaatgaggtgttccctttgtgttgtgtgtaccgtgccatcgttgcctgttacctgacaccccaaggggttggcacggggcaacttggggggaaatgaggctcccaaaagctggggcctgggcgggtccacgaggctgtaagaggccgaggccaggctggaacccggtttcccagctccactgttactccttccctgtctgcagtcacaggcttgctcccctagacagagggcaacgggagcagcagatggtccctgggattcctcagggtgcacatgaagcctgagcctcacattgctcctgtcctggcacaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaattatgacttcccccagctctgaggtagaaatgacgcctttatgcaagttgtaaggagttgaacagtaaagaggaagttttgcacacccagttccataacgttgttggatgtatgagccaggcaggggtccagagaccaccagcctgcaatccggagaacccaagctaggcgcgagccggtgctgtgatcccgccaaaggagaagctgccttcccggggaaggggcagagaggggccggcgggctgaggccaaccagcgcagaaagggcctggcagccattactgtagcgctggcggctctgtcacgcccctgaagccgctggcccgcgggtgtgttcagctcaggagcggccctgcgtgtttttcccccgtggccgtcgcggacccccgtcttccaacagtggtgcgggcggggcgccccgtcctgggttcgcggcatagccccgcccgggcccccacgcggaacagaagtaacggacccttttttttttgtttttgtttttgaaacggagtgtcgctctgtcgcccaggatagagtgcagtggcgcgatctcggctcactgcaacctccgcctcccgggttcaagcgattctcctgcctcagcctcccgagtagatggaactacaggcacccgccacaatgcccggctaatttttgtatttttagtaaagagggggtttcgccatgttgtccaggatggtctcgaactcctgacctcgtgatccgcccgcctcggcctcccaaagtgttgggattacaggcgtgagccaccgcgcccggccccggacccttctttattggcctcaaaacgggtcattttgggaagcggcgcggggctggccgcgcttccctgggccccggccctccccatggtgtttacggggaggcgaacggggagcccagaggctgcgagcctggcctggacccaggagccaggggtatcccacaagtcctggaggctctgaacgcggcgctgacgccgaatacctgtgaaaaagactcggggaggagacccgcagaccgccgagcttctgccgcgggaaccgcgcccccggccccgcaatgcgcctgcgcctcgcgcgccgacttccagtcccagcaggccgcgggcgggggcggggcctccggggagaattcgggggaggggcggggcctccgggaagcaatcagggcaggggcggggcgtccggggagtggggcggggctcccggttccaggcgagttcgcagctgcgcgccgggtcctggaggccgaggccgctcccgcccgttgtccccgcagtccccgacgggagcgccatggcccagccgccgcccgacgtggagggggacgactgtctccccgcgtaccgccacctcttctgcccggacctgctgcggtgagcggggcctgggaagcgagcgcagccttggtgcggggtccggtccgcgggcgccggcgcccccacgtggtccccgagggctcgcgtgttaggaaacctgtcttgcctggctcctttctttcttttttctttctttttttttttttgagacggaatctcgctgtgtcgcccaggctggagtgcagtggcacgatctccgctcactgcaaactctgcctcccgggttcaagcgattctcctgcctcagcccggctaatttttatttttagtagagagggggtgtcaccgtgttggtcaggctcttttcgaactcctgacctcaggtgatccacccgcctcggcttcccaaagtgctgggatttacaggcgtgagccaccgcgcccggcccaacctggcctctttcttaacagaaaattttaggttgaaatcatttttccggaagacccagaaggcccaggaatgccaggttttgcccagcagctcttcattttcctgcaaacgccttggtgttcacaagagaaggcagcccgggcaaaggtcgatcctccccggtcacctgccctcactcggctaatgggcggatccttttttttttttccttttctttttttcaattggcaacattttcaagtttctattaaaattttgatcttttgccaggagcagtggctcacgcctgtaatcccagctctttgggaggccgaagcgggtagatcaccagaggtcaggagttcgagaccagcctggccaacatggtgaaaccccgtctctgctaaaaatacaaaaaattagccgggtgtggtggcgcacacctgtaatcccaactacttgggaggctgaggcaggagaatcacttgaactcgggaggtggaggttgcagtgagccgagatcgcaccattgcactgggcaacaagagtgaaactccatctcaaaaaaagaaaacaagttttaaattatgttctccaaggacaggtattgacaattctctctgagtgttctgcaggaaaaaaaaaaagttttttttcgaaacggagtctcattctgggttgaagcaattctcctgcctcagcctcccaattctcctgcttcagcctcagtgcgcccaagtgggactataggcacacaataccacgctgggctaattgtatttctagtagaggtgagtgtcaccatgttggtcaggctggtctggaactcctgacctcagatgatccacctgcctcggcctcccaaagtgctgggatgacaggagtgagacgctgcacctggcccaaaattaatctttaataattaagaataggaaaggcaacttggagatcagcaaaagtttgccatccatctggtacagtttgtgccagtcataccgatcagtacacatttaatgcgtacaagaaaatctctaataaataaaaaagccatattatcccgacgtagcttgctgaatctcaggtatcatatttgatattagtgccatgcagggcttaggagagaggaaattataacctctatcttgtttaagccagggtatttttctctcttgtatctacttctgtccatttctgtcaaaagacacagaaataccctttcccccactgcactttgcaagtttgtgtcagcacaagttcaggaccagcctgagcaacaaaacgatacccctctctagaaaaactagatgaaaaattagctgggcactctggcatgcacctgtagtcccagctactggggaggctgaagcaggaggatccttctagcccaagaggtcaaggcggcagtgagccgtgatggtgccactgcactccaacctggatgacgtagcaagaacctgtctcaaaataaataaataggcccggtgtggtggctcatgcctgtaatcccagcactttgggaggccgaggtgggtggatcacaaggtcaggagatcgagaccatcctggctaacacggtgaaacctcatctctactaaaaatacaaaaaattagctgggcgtggtggcaggtgcctgtagtcccagctactctggaggctgaggcaggagaatggtgtgaacctgggaggaggagtttgcagtgagcctagatcatgccactgcactccagcctgggcgacagagcgagactccatctcaaaaaaaataaaaaataaataaataaattaaataaaatactataattttatgaattttcattttatttatttatttattttttaagaccatgtttcgctcttgttgcccaggctggagtgcaatggcgcaattttggctcaccacaacctccgcctcctgggttcaagtgattctcctgcctcagcctcccaagtagctgggattacaggcatgcaccaccacacccggctaattttttatatttttagtagagacggggtttctccatgttggtcaggctggtctcgaactcccgacctcaggtgatccgcccgccttggcctcctaaagtgctgtgattagaggtgtgagccaaggcacctggccgaattttcattttaaatcattgccgtatagcaatatgggaggtgtattttaacagggctcttttattttttatttatttttattttattttatttatacatattttttgagacggagtcttgctcttttgcccaggctggagtgcagtggtgcgatctcggctcactgcaacatctgcctcccgggttcaagctattctcctgcctcagcctcccaagtagctaggactacaggcacccaccaccacgcccagctgatttttgtatttttagtagagacgaggttttaccatattgtccaagctggtctcgatctcctgaccttgtggcccacccaccttggccttccaaagtgctgggagccaccggcccggcccaatagggctcttttaaaagagcctccttttttattctcagggacaaagtggccttcatcacaggaggcggctctgggattgggttccggattgctgagattttcatgcggtgagactgctctgtgtcccttccctgctcctcgcttctccctgcccgggccctgctggatgcccgacccctggaaagatgttggtgggaggtagatgtcccctgctcacctacccgacaggatccaggtgcctgccagagggactggggagcggtcgaggattgccctggggggagtcaggacttcaaggcccctacaggtcagtggagattgtgtggctctggtctggggcctgctgggacctcgagagtcagggctgtgtcgggccccagtgctggcgccctgcagagcacattttctcctgggacacaattctgtggcttcaggccagggtcagcaacttatcccacctgacagtggctagagttaggctggggtgggggaaagggacccttcctcagttcccctgaggcccctgcttttcagaccaaaaaggtgagtcccacaggaagagatatggcctttccactggtggctttgtgctcagggcatctgaggaccagatgggacattgcagctccagtgggacctgcctagcaggggtagctacctttatggttattgtgggcaagcaacccccgaaccagaagagccgagaaaccaaagaacaaggcagacagatcccgtttgtctgtgtcaggtgattttaccagggaatttgtgggcagaagcgtagtcttgggtggctgtgagacgggcgtctccatgctgttacccccaggcccagggcttctataccacagggaaaggggtcctgcttcagagggagtgtgtaggaatttgtttaggataacatcaaggtggttttgacctaaaggcaggacttctttgtgctctttcgcaagaacagtagataagctggaaatcctagcggcattcctggaaccagggttcatagaggccaacgtggtggattcgcatccacgtggtcaggaaggggagcagggagcaccccgcttcagaacagtcctccacgccagccccacagggagaagggggtggagaatgtgggcccagcaggccccaggcagatgtgtgggctgggcgtctgtggctcacagctgtctctgtacctggtgtttggggcaggacccgcaggcctgtgcggtgggatgtcccatgccagaaaccccggggtgggcaccacctgaggtccctccagagtacctcagtcctgttcacgcccctgtgccctctgccagctgggccttcagcctggactggtacttccgcctgagagactcctgctcaggagctgggcagatgccccgggagtgcccctcgcccacactgccctcacacctgcttctggttttgcaggcacggctgccatacggtgattgccagtaggagcctgccgcgagtgctgacggtgagagggcctctcccatggtcccctgttcgggtggctgtgggggggctggggctgggcctgggccaggagagtccagaggctatggggatgttggcaccaaaactttttttttctgagacgggagtctcgctctgtcacccaggctgaagtgtggtggtgcgatctcggctcactgcagcctccacctcccaggatcaagcgattctcctgcctcagcctccggagtagctgggactacaggtgcccgccaccacgcctggctaatttttgcatttttttggtagagatgggttttcaccacgttgaccaggctggtctcgaattcctgacctcaggtgatccgcccacctcagcctcccaaagtgccaggattacaggtgtgaaccactgtgcccggccggcacctcagcctcccaaagtgccaggattacaggtgtgaatcactgtgcccggccggcacctcagcctcccaaagtgccaggattacaggtgtgaaccactgtgcccagccggcaccaaaacttgcacctatcctaaatatggagcttcagtgtaagtggcctcccagagacatctttgactttttaaaaaatctagttattgggttctgggagggaccttcctgtttgggggtaatgtggccccaagaaagacctctgggctcacctgggttatttaggtggtccgtgcgtcccacctactggagccctcgacctgggaggagagtctcacctgtgccacctctggtctgcagcaggggcaggacatgggtgacagtggcctggagggcgacgcagagggaggattctaggacaggtggcaggtggggggagagcgtggcaggttcccacaaacatccactggggtcgtgggcacttgcaggctgtgcttccccagagtggggtccagcagcaaacccagggtccccgaggaacccggaagcatcgtcctctgcagattccaaaggccttttctccaggccgaggctgcagggctgctgtctgcctctttacctggcttctaggccgccaggaagctggctggggccaccggccggcgctgcctccctctctctatggacgtccgagcgcccccagctgtcatggccgccgtggaccaggctctgaaggagtttggcagaatcgacattctcattaactgtgagtcggtgctgagtgaggttggtggcttctcacaggttggtggtaccatttggaggccctagaactctggtcatggggtggggaccatgccagggaacctagctgcctgtgctggggtgggctgcaccccatccaggtacctgaggccaagactcaggctccggccccctgtctccggccccatctccggccccctgtctccgggcccctgtctccgggcctctgtctccgggctctgtctccgggcctctgtcttcggccgcatctccggccccctgtctctgggcctctgtctccgggcgtctctctccggccccatctccggccccctgtctccgggcctctgtctccggccccatctccggccccctgtctccgggcccctgtctccaggcctctgtctccggccccctgtctccgggcccctgtctccgggcctctgtctccggccccctgtctccgggcccctgtctccgggcctctgtctccggccctctgtctccgggcccctgtctccgggcccctgtctccagccccctgtctccggacctctgtctccgggcccctgtctccgggcctctgtctccggccccctgtctccgggcctctgtctccgggcctctgtctccggccccctgtctccggccccctgtctccgggcctctgtctccgggcctctgtctccggccccctgtctctgggcctctgtctccggccccatctccggccccctgtctccgggcttctgtctctggccctctgtctctggccctctgtctccaggcctttgtgtcccgccttctgtctctggccctctgtctccggcctgactccgcttctctgggtggcagcaggtcagcacagctgcagcccaagtggacgccatgaacacagctcaatggtagagtcgggtgcccttgtgtcctgaaattccgtctttaaaaaaaaaagtaatagccttttttttttttttagacagcatctcactctgtcacccaggctggtgtgatcatggcttactgcagcctccaccttctgggctcaagccatcctcctgccccagcctcctgaggagctgggactacagacgtgtgccatcacgcctggctaatttttatattttttattttttgtagagacagggtcttagtgtgtgttgctcaggccagtctcaaactcctaggctcaagcaatcttcctgccttggcctcccaaaatgctgggattacaagcaagagtcatcaataaaatagaagctagcctggcctagctttttttttttttttagagggagtttcgctcttgttgcccaggctggagtaccatggtacaatctcagcttacagcaccctccgcctcccgggttcaagcaattctcccgtctcagcctcccaagtagctgggattacaggcgcccgctaccacacctggctaatttttgtatttttaatagagatggggtttcatcatattgtttagactggtctcgaactcttgatctcaggtgatccgcccgccttggcttccgaaagtgctgggattacaggcgtgagccgccgcgcctggcccccagcttttatttttatttctttattttttatttttattgatttttatttttattttttgagagagtcttgctgtgtcgcccaggctggagtgcagtggcgcaatcttggctcactgcaagctccgcctcccgggttcatgccattctcctgcctcagtcccccagtagctgggactacaggtgcctgccaccacgcctggctaactttttgtatttttactagagatggggtttcaccatgttagccaggatggtctcgatctcctgacctcgtgatccgcccgcctcagcctcccaaagtgctgggattacaggcgtgagccaccacgcctggccgatttttttttttaaatcacagttttaggtttatagaataattaatagtatatggaattccatactcccacctacagttttccctgttaacatcttgcgtttgttacaattgatgaaccaacactggtttcactctgcagaaattcccttttaaaaacatcctgtgtattagtttcctgggctaacagagtactacgacctgtgtgggtaaaacaaccgaaatataatctcccagttctggaggccagaacgtccaaggggaaggcgtcggcagagctatgctctctgaaggccccaggggagagcctcttcctgccttctgcgtggcttcgggtactgccatagcccttggccctcccgggctcggagaccgtcgctgcactgtctgccactgtcttcccgtggcgtgtgtctgtgtgtcctcttcccttgttataaggatgctggtcattggatttagggctcaccctaattcgttgtgacttcagtgtaattcgattatctctgcaacccaccccatttccaaacaaggccacagtcgcaggtacggagccagggcttcagcatgtcttctcttctcggggacacagtgcagccaggacgcccgtcttgctctggtcattttggaatttatcctagggcatgggtctcctccctgtgccacagggcacctgggctccctcctgcaccctccgctctgcccacctggccaccacccacttggcatccctctccccaggctccagcagctcctgcggtctcccattctgcaggtgcggccgggaacttcctgtgccccgctggcgccttgtccttcaacgccttcaagaccgtgatggacatcgataccagcggcaccttcaatgtgtctcgtgtgctctatgagaagttcttccgggtgggtgcctcgtgcgctctgtgagaagttcttccgggtgggtgcctcgtgcgctctgtgagaagttcttccgggtgggtgccttgtgcgctctgtgagaagttcttccgggtgggtgtactcccagcgggggcctccccctgacggccgcccgctccctgccctgggcctccccatgacggccgcccgctccctgccctgggcctccccctgacggccgcccgctccctgccccgggcctccccctgacagccacccgctcactgtcctgtgacctcccccgacacccgcccgctcactgccccgggccttgtgtgttgcaggaccacggaggggtgatcgtgaacatcactgccaccctggggaaccgggggcaggcgctccaggtgcatgcaggctccgccaaggccgctgtgggtatgaccacccccccccgcccaggtttgcccacgtgggtccccaatgggccgtctgcttccatcccaggaggccagcagtctccacttgaagctgagcccagctgcaggcagcgagacctggccttggccctgcgccctcgcagagggcagagcggccctttcatatccaactttcttctgtgcagacgcgatgacgcggcacttggctgtggagtggggtccccaaaacatccgcgtcaacagcctcgcccctggccccatcagtggcacagaggggctccggcgactgggtaaggctctcagggagcccaggcctcccacagatcctctcctggggcacagggtgcccatgaagcttccagaaccttggcagggtgtatgttgaaaagccctgtgctggttccatggtggcaactatgttctgtgcctggcctgatcctgctccatgctaggccttggtgacactgactgtgtccttgctgttcccagatgcctctcagggaatgagctgggggagaggggagggtgctgggtcttggggctcacggggcctgagccttctgctgccctccaggtggccctcaggccagcctgagcaccaaggtcactgccagcccgctgcagaggctggggaacaagaccgagatcgcccacagcgtgctctacctggccagccctctggcttcctacgtgacgggggccgtgctggtggccgatggcggggcatggttgacgttcccaaacggtgtcaaagggctgccggatttcgcatccttctctgctaagctctaggtgaggtactgctcccgcttcttggggtcatctgtgtccttggacgctggtcactgcatgggcaggtctctgcgggacccacggggctggcgtctcctttgtccccatcctcccggcccctgcgccagcctgcccacacatgggtgctgcccagtggggctgagcaggaggcgggcgctggtgtacttgctcttctgtagcggcctcggcctctgccggcatttctggcaggtgctgggtggccgaggcagccgaggtgttttagggggaagccgtcctcagccggctactaagttctgaaactcctgcaggaatcttccggccgctgcttcctgccgcctcactcagccaggtggagagcaccaatctgaaccagcaatgcctgcagcccagcccctcctctgaacactcagctattactgcgctttccctccccacggccccaactccagggcaggagcaactggacagtgggcctggcccgtggagctgccacgcaggtgcctgagggccaggtgccacgcaggtgtctgaggaccaggtgccacgcaggtggtgggggtacagacaagatgctgggatgtcccctgccccatggtcaagggtgtcctgcctgcctgggtccagggcctgagggagccacatggatcccgagacttgtgttctcttggctgaaaacactgaggtgctcccatctgtgcgtggcccatgagctgggatggtcctccagctgcccacaaggtccgcccctctgtctctgcac

SEQ ID NO: 655 - DNA, 92380 bp, Homo sapiens
ttgtttacaggcttgaaaaactgggaaaaataccgactcttgcacttactgaatatttgacaaaatatccttcttgggacaaaaacattggcattactggtgagcttgttagaaattcaaaaaattggctgagcatggtggctcatgcccgtaatcccagcactttgggaggctgaagtgggtggatcacctgaggttgtgagttcgagaccagcctgaccaacatgtagaaaccccatctctactttaaaaaaaaaaaaaaaaaaaaaattagccaggcgtagtcacgcatgcctgtaaccccagctacgcaggagacaaaggcaggataattgcttgaatccgggaggtggaggttgcagtgagccagatcatgccattgcactccagtctcagcaacaagagtgaaactctgtctcaaaataaatacatttaaaaatcagactttataccagatcttctggaaaaaaaaaaaccctgcaaaacaaggtcttcagcttattctacacatcaaaatttgagaggtgctttctaactcaacatgtcttttccatctgaaaaatattcacaagtcattttgtatgatgtaaatatagcactcaaaaatatacatgtttgtgttcatgtccttaattttatactttattatccagaaaaatatcattatatgaactgatcttgtggatattatgctgctcttttttctcagagatagagaatacattagaaaatatttgtgttgaaaattattttattggataattttagtcagtcctataagtcagaatgagtgctctttactctctcatttcaccttaagtcaaattaaaaattccgctcatggcaacttagtaaaaatgtgtgtgtgtgtgtgctttacagtgaccactgcaatttagggatgtggctatagaattctctctggaggagtggcattgcctggacactgcacagcacaatttatatagggatgtgatgttagagaactacagacacctggtcttccttggtgaggataacttgagtacataattcataatatatcctaaagattttatttctctttttatttttattttttgagatggagtctcactctgttgcccaggctggagtgcaatggtgcaatctctgctcactgcaacctcagcctcctgggttcagtgattctcctgcctcagcctcccaagtagctgggattacaggtgactgccaccacgctcggctaatttttgtatttttagtagagatgggatttcaccatgttggccacactggtctcgaactcctgacctcaggtgatatgcccgtcttggcctcccaaagtgctggaattacaggcataagccaacatgctcagcctatttctcttttttgtagaatgtttttagacctttattctttgcataaaaaactttcagatcccctttttccagaaaatcttcaaaatttgttcatttattaaagaatttcttcaagatgtttcatcttaatccaaactttccacattcctgagttgagctgtattcttcactctaaattagtggtaattccagaaatttagtggcataaaatatttttgtccccacctgaaaatcgaattgccaccaccaatttttgattcagcagtaccaggtagtaaaattaagaaacccacaaattgaaagtattttctaaatatttagaaatttctgttataacttagtattttgctattaatttgctagaatattttatcacattctctctgctgagcacattactagcttgtaattggagaatatgagaaaaatttatgtatttatttttaataaaacaggtattgttgtctctaacccagacctgatcacctggctacagcaaggaaaagaaactttgaccatgaagagacaggtgatgattgccaaacacacaggtaggtgttttttttgctctcacaaaggggcatcttctgtcttatgcttttaaattctctaaggattctgcttttcttttggtgagcttccttcaagttcacagtgagagccaatgtcctcttcatggcatagaagagactgcacaatctgactgcttttccattattttggggacacacaaatatctgcatgatgttgagaaactaaaactatgttttaagttcccttttttcatcaggtttgaaatgtgtgaaagtagtagtttctgttgcatttttttgttcatttttctgcacagtccattctgtttttattattatgtggccttgaaatatagtttcaaattataagtatgatatccttctgctttgttctttgtcttcatgattgcttcggctattcaaaatttattttagtttcatgtaaattttagaattgtattttccattactgtgaaaaaaaaccacagcaattttgataggaagtttattgaatctatagattactttggataatatggcactacaataatatttattctttcaagccatagacaaaatattttaaaatttatttggatcttctctaatttatttatttttttattgtaaaaatgttttacctccttggttaattttttcctcagaaatttactaattaatgctctagtaaataaacgtttttctttatcagacagtttaagtgcatgaaaccatacatacacttgtatgttaattttatattttgctgatttactgagtgtatttattagtttagataggctttaatgtactgtttatagttttttaaatgtatgattgtatgacctacaaacagcaactttttactcatttttcaatttcaatggttttttttaaatttctttgactaattcttctgttacatacttccagtgctacattaaaatagaagaattgacaaagggcacaatatagttttgtattggtgtctgaatttgatggagcagacacctcttcaagtttttgtaaactgattttagattgtaaagatcttcttttattggttccttagggtgatgagatgccatctgaatttgtagtgaagagggattgtagcttggtcacaaggctgctaggtctgcactagggttcacccttagttggcttgttacaggggcttgggttgttgtaattcccattttatttttggacagactaaatatccttcagtacttttctcagtagggcaggcactacagcatgtttttgcagtcgagtctgcatatgctgggccttaaatcaggatgtggatgagtgtggctttcatgagtatgagagagcatttcctcaggtaactgtgtgggtttctatgcaggaagaactgatcataaactgtggctcaggtaactgaaactgagtcattgaaccacttcagggacctgagtaaaggccaaggtctgcagacctgcctgcatggctgtaaataggtgccttcctctgggtctctagaatggcaggacctctcccagacagtggctgggaggagtttgggacggttatatgataagttcagaattctcagaatctcagtttgggaccaagttgggtgaactctatcctggtctgtagccataaacaggaatcctgcactttcccacctaattgagggcctgctttctgagtagaacacttttcaatcctaagctttaacagagtttcatcactccttccctggatctcaaatctctcttacaggcacttattttggagatggggtcttgctacataacccaggctggtctcaaaattctggcctgaagcagtttttccaccttaatgtacgatgtagctgtcattacaggtgtgagccataatgcctggttctctcataaaggcatttttgtcagggatggctgacattattttgctgtaaggggatatgaatgtaggggacttttaatcttttcatcttactgatgtcactctccctatacatttttactttccattttctatttcaaatttttctgtaattttagattcagatatttaggacaatatgctagaatttgcatggtatgcctgatgtagttagaaaattagtaggtactccatatttactaaaagagttacttataaatgtaagtttgctacaggcaaaaaagaattataggattttcatctactttcttcagcctatatataaataataacatagtttatttcccaatatttgttttacatatcagaggatctaattctattctgcaatatatacatgtatattttctgtctttaacaatgtaagactattctttgcttctaaagttagaatacagcagtttcattttgtgtaagaataacatattcaaaacataaaactaactctagtttttttaaatgcttatttattaaaagtttctcattagaatcttctatttatgattatactgcatattttctgaaattttactgccacacagtgcatgccaatgattcaaaatacctgcatttaatgagtacacagtaacagctaaatattgcagttacccagacaaatttttttaaattatttttttgagatggactcacagcctgtcacccaggctggagtgcagtgctgcaatcttggctcactggaaactccacatcctgggttcaagcagttttcatgcctcagcctcccaagtagctggaattacaggtatgtgccaccacacctggctaatttttgtatttttatgtgagatgaggtttcatcacgttggcaaggttggtcttaaattcctgacctcaggtgatctgcccgcctcagcctcccatagtgctgagattacagatgtgagccaatgcacccagcctgacaaattctttttaatgatacatcaatgttgcataccaggttttatgagtaaactcttctcttattattgttttgaagtttcacattagtgtgtttctttaatgaaggtttctgtttttttgggggggacagagtctcactctgctgcccaggctggagtgcagtggcatgatctcagctcactgcaacctctgcctcccaggttcaagcaattcttctgccacagcctcccaaattgctgggactacaggcttgtgccacaacatctggcagatttttgtatttttcatcgagacagggtttaaccgtattggccaggcttgtctcgaactcctgaccttgtgattcatctgcctccgcctctcaaagtgctgggattacaggcgtgaacccccgtgccaagcctcatttatatttcaaatagggtctcacttggttaaccaggctgatttgcagggctcactgctgcccgaacctcccaaactcagatgttcctctcacttcagcttctcaaatagctgggttacacatttttgccgtcacacccagcttgcttttttgtattttttgtagagacagagttttgccatttgcccaggctcctgttgaactactgagatcaagtgatcagcccaccttggccttccaaagtcctaagattacatttcattttattaagtagtttaattaatttatatttaaaataattgcttaaaaaatgaagttgttattaccagttatactgttattgttttatgtgtttctagtagttatatttttctcattttctgttttactttcttaattttcacttaatcttgtactagcatgctttgattatattttgttttcttttgcatactttctataaatattatctttgtaatcagcttgaaaactgaagattacatacaccttaaagttaaaaaacaatatattttaatcttataacggcctccattgaatacaaaaactatgcttctgtattttccagtttgttgttaatattaaaattattattattattttttgagatggagtctccctctgtcgcccaggctgtagtgcagtggaacgatcttggctcactacaacctccgtcgccctggttcaagggattctctgcctcagcctcctgagtagctgggattttaagctcctgccaccacgcccagctatttttgtttgttttagtagagatggggtttcaccatcttgaccagtctagtgttgaatgcctcacctagtttatatggtgtatctattcacagatttatgcggatttacatattgttttttatattccataaaagcactttaaaggttttatgtaccatcattttggtttttttgttttgttttgtttggtgtgggattatttttttcagactgagtcttgctccatttcccaggatggagtgcagtggtgcgatcttggctcactgcaacctccacctctcggcttcaagcaattcttcttcctcagcctcctgagaggctgggattacaggtgcctaccaccatgccctgctaattgtttgtatttttagtatagatggagtttcaccatgttggccaggctggtctggaactcctgacttcaagttatctgcccgcctcagcttcccaaagtgctgggattacaggtgtgagccaccacttccagcctgtaccatcattttgatagtaaagaattccatatgtgtccatttatttacattagtgtatagctttatatttatatatgtttttatgatgctgtccagggtcaatttgtgtttcaacataatggacacattctaacatttctgtatttttagatatagaatctcattatgttgttcaggttgatgttgaacttttggtctccagtgatatgactgctttggcctctgaaagatgtaggattacagacatgaacaattgtgcctgagcctcttgtagtatttttttttacttttttttttttttgagacggagtctttctctcctagctcaggctaaagtgcagtggcacgatcttggctcactgcagttttcgcctcccaggctcatgcgattctcttgcctaagcctccctcccgaggagctggggttacaggagcatgccacaatgcgcagctaatttttttttttttgtagttttagtagagatggagattcaccatgttggccatgctgctctcaaactcctgacctcgggtgatctacccgccttggcctttcaaagtgctgggattacaggcttgagaaaccgtgcccggcttttatttttttaaatttttttaagagtgagtctcactctgtctcccaggctggagtgcaatggcatgattttgactcactgcaactcccacctcctgggttcaagcaattctgcctcagcctcctgagtagctgggactacaggtgtgtgccaccatgcctgggtaatctttgcatttttagtagaaatggggtttcaccatgttggtcaggctgatctcgaactcctcacctcaggcaacccacccaccttgacctcccaaagtgctgggattacaggcatgagccagtgcacccaggcccatgtattatattatgagagacagtgatagttgtgatgaatactctcaccttttattttggaaagtctttatttttatcttctttttgaagtaaagtaattttgaatcgagtattgttagaaattttttttgttacatcaaaattggggaagttttcagtttttttaatcttcgtgtaacctctatattactttttccctatattctaagatttgtttcatgaatacattgatctacttcatggtatccaataagttttatattctatgttttacttttgttccacaattttatatttttgtgttatatatattttgggtatgccacatcacaccagttaattgtattttaattttttagtttatattataattgtatatgacaatttttaactctgtacaatttaagacagtatggagcaaaattaaatatgaataagccatatgtctattgccaatataattatttatatgtttgtttgcctggataaatattatctttgtattttttgtcacttgtatatttattgtgtaggtttgctgtaacagttttttttttttttttggaagagaggtttgctcttgttgctcatgctggagtacaatggtgtgacctcagctcactgcaacctccgcctcctgggttcaagtgattctcctgcctcagcctcctgagtagctgagattacaggcatgcaccaccatgcccagcgaattttgtatttttagtagagacggggtttctccatgttggtcaggctggtcttgaactcctgacctcaggtgatctgcctgcctcagcctcccaatgtgctgtgattataggtgtgagccaccattcccagtctgtaacagttttttaatcctgtctaggtgagtagtcataaaaattctcctgatttcagcatttatttatgtgtgaatctatattttttcggtgggggagaaacacctaaagaaatgtgttatgtgtcaaaaacacataacaaaatttacaataaaatatttctaggctgggcacagtggctcacacctgtaatcccagaactttgggaggccgaggcgggtggatcacgaggtcaggagattgagaccatcctggccaacatggtgcaaccccgtctctacaaaaatgcaaaaaattagctgggcttaggtggcgggtgcctgtaatcccagctactcaggagggcgaggcaggggaatcgcttgaacacaggaggtggaggttgcactgagccgaagttgtgccgctgcactccagcctgggaggaagggtgagactccattttaaaagaaaaataagtatatatatatgtatataaatatatatatgcttctaaatattcagtttggtcatattaattctgttgacattgttatgcaacatatcactagaatatttttatcttgcaaagctaattctcaatagtcattaaacaactaccaattctagggccgggcgcggtagctcacgcctgtaatcccattactttgggaggccgaagcaggcgaatcatctgaggtcaggagttcaagaccaacctgaccaatgtgcagaaaccccgtctctactaaaaatacaacaaaattagccgggcatggtggcgcatgcctgtaatctcagctacttgggagcctgaggcaggagaatcgcttgaacgcgggaggtggaggttgcggtgagccaagatcgcaccactgcactccagcctgggcaacaaggtcctaactcggtttcaaaaaaaaaataataataataaagaaagaaagaaacaactaccaattcttctcattttgtggtacttttcaaacaccactctgttttctgtttctaagagtataattgctttgtatatctcatacaatctctgtctctttgtggatggcttattttattttgcataatgtcatcaatatttatcttaatagttgttagaatattttctgctttttgaaatctgagtgatattccagtatttttatatctactgaatgatttggagacagaaatttgcattgcttttacctattggcttccagtaacaatgttacaatagttatgtgaaagttaatatatgtgctgcattctgttttattagtctacattttcacctttataatcataccgaattgttgtaattctatacgtttttgatgtgtttgaaatcagaaattgtaatgcctccaacattgttcctttttctcaagattgttgggtactttattatctctttagattccatatacttttggagttggtgtttttgtttcttcaaaaatgcaatgagaaatttgagaaagattgtattaaatctgtagattaaattgagcagtatagacatcttcacaatattaattatttcttttttcattgtttgtttttgagatggggttaaattcacccacctcagcctcccaaaatgctaggattacaggcatgaaccactgcacccagcccagttatttcaacaagtgcatgctcaagagtgtgttgtatcatttctatatagatgtaaatttatcatttatttatattattgttttgtactctaattctatttttgtcatagaaaataatctatgaaatttcagttgtaaataatgtgttaagactttgtttttggcctaacaggtggtctataaagaagaatattgtatgagctatcgagaaggctgtgtatcctgatgttgttgaggagtgttctctataccttcattagaaataattgttttttactgccttctagtcctctgttccattactaatattatgtcttgttttattattattacagaaagtggggtattgaaatatcctactataatcatattgctctctctgtattcaattttgttagtatttgcttgatataattgaaaccctaatttgagacacacacagaaaaatacacacacgtgtataaacaaatttgtcataggttcccagtgaatgaatctatatattgtttaacgcccttctttgtctttttgaagttttgacttaaagtacattttataaaatatgacagtttttttacttaagatgtagcttgtgtaatattattttgacctcttctgctgtaatttggttaatatttatataaaaattctacttttgtcttgcaactttcagtcttttcttgtcattagatctcaactgactctttaaaaaggtaagttgagtctgatttttaaaactttttaatgaacctttttattgaaattatgtctcttgaatggaaagataattgtatatatttaaatagttttctgaaagagaaaaacttagttattttaattgttttatttgattattgtatccttgtgtgtcattttctctgtctttttgtgttgttttgatttttatattgacatgctttcagttttctcttattgttttttgtgtatccatatggattttttttagtggtatcttagggaattacctaaaacctctaaaagattcaacaatatattttaatgtagtaagaaattagcttcagttgcatacaaaaattcttattacatctgccttaaactttgttactgactttactaattacattttttatgttgtatattcatgaacagatgcttataatttctatacatttatcttttaaattttaaagaataattaaaaaagttttctgtaccattatgataatgttaagtaagaaattctatttttatgtgtgtacatatctttcccagaaatttatgtattttcatatgattatgtgttgttttcttgcattacgttattttctgtagaagaaactcctttcagcgttcttgatatgtaggacatatgcagtgccaatataattctcaagatttggttattttggaagaacttctttctatttggtagtacaattttgctcttatggtaatactcccatttgacaacttattttgaaattataattttaaaaatatcacagtttccttctgatctgcaaaaatttttttgataaattcactggttatctgatgagactatgcttatagattattattatatttatcttgcagcttgcaaaattcttatctgtgatttttgaaattttgcttatatatgtgtttgttataaatatatgtttgagtgtatcctagtttgttcagctttttcatgtttaccccattttttcttacttttaagaaatttttcagttttttttacatccactattttcattttctgctattttaatattttttgtggttaatctcatttttccgatcttcagtagttgtctgtgtttctatataacttcctggatattattcaatttattttatttatttattattctttttttttttttttttctgagatggggtctcaccctttcacccaagctggagtgcagttgtgtgatctcggctcactgcaacctctgcctcctggattcatgcaattctcctgcctcagcctcctgaggaactgggattacaggcacctgccagtatgcctggctaattttttgtgtttttaaatgaggtgggttttccccatgttggctaggctgatcttgaattcctgatttcaaatgaactgcccatctcagcctctcaatgtgttgggattacaggtgtgagccaccatgcttggcctattttattttatttttgagacagagtcttgctctgttgcccaagctttagtgcagtggcacatctccactcaccgcaaacttcccttcctggattcaagcaattctcctgtgtcagcatcccacgtagctaggattacagtcagataccaccaggcccactaatgtttgtatttttagtacatacagggtttcaccatgttggccaggctggtctccaactcctgacctgtgattctaccaccttggcctcccattgtgttgggattacaggaatgagcctccaaatatggtctgttcaatctattttgaatttttaaaattactttatacatttttaatgattgcttttgaaaattttataatttttttgatggggcaatgttgccttaatattttgtatacattgtaatctttgatcgatatttgaacattaacaaaaagccacctgttacaatctttataatatagctctgtcctggcatagtctgaaatcaattgtcttggctagagattctgggaatttctcaaacctgtttttaggaggtgtcttgtctaaaattttgtgtttattgtttagttaaatcagtttattaatatttcttcttaataatcagtaatcacttgctacacccatttcctgtttggggtactgcagtttctctgcttttgtaacatttaccttaagccttggcagactcaaactgtcattccaacatatatcaccatttctttcagcattttatgttgtgggagaccttaaccagtgccttaaaaagtccctagaagccagaaataaagatgtatgtgccaatatttttcttgtttttttaaaaagaaaccaggagttggcaatttacatttgtgtgtgtgtgagacagagtctcactctgttacttaggctggagtgcagtgacattatcttggctaacaacagtctctgcctccagagttcaagcaattctcctgcctcagcctcccaagtagctggattacaggtacctgttaccatgcctggctaatgctttttatttttagtagagacgggtttttaccatcttggccaggctggtcttgaacacttacttacccttgtgattcaccgacctcagcttcccaaagtgctgggattacagacttgagccatcctgcctggccaggaatgtacatttaaaggcacaatgttatactggagagcaggaagaagtgaagaatatttcttctaaagacagccattagaaatataaagggggttgtagtgcctttacttgcatcatagatcttattgcacacattttgtactagaggaaaaccctgaagcagttgctcaagctttgttcaacattggaatttatattggagaagagtcctgaaatataatgaatttaaaaacacttatatttcaaaaactacagcttagaaaacaccagagagtttatactaaaatatatttttgcagatgcagtaaatataaaaaaaattaatttaaaattgattttatgtaaatatcagagaatttacggtagaataactaaggcactgacatttcagacattacagcaaatcagtgttgagtataaaaactaatctacagctacagctgttagataaattgcttgtatataactttaaaaggagtagatttttgaagcatggtaattctattgaaagtatacttatttgcggccttgagcagtggctcatgcctgtaatcccagcactttgggaggcagaggtgggcagatcacgaggtcaggagatcaagaccatcctggctaacatggtgaaaccttgtctctactaaaaatacaaaaaaattagctggatgtggttgcacacacctgtagtcccagctactcaggaggcttaggcaggagaatggtgtgaaccctggaggtggagcttacagtgagccgagatcacaccactgcactccagcctgggcgacacagcaagactctgtctcaaaaaaaaaaaaaagaaagtatacttattcgcttgaaaaaaattttttgaaaagtgaataatgatgtaatacaggtttcaagttactttatgctgttattttattcctatattattcacacatgaaagcatgtgatcaattgttgatgcatcagagatactagacattgttttttattagttgggcattatttattaccttttctataaaagagtaagaacattaaaatgtaagatgcatgatgaaaatgtaagtggagaggctctttgtagtaaacctctattaagtaatgtataaggtggtggtttgtgttctcatttgtgtaatcctagcctatgacttaatgttgacactttgctttgtcttttggatggcctaacctacattaacatatacgcagaacattttaaacctttttttcaaaaatcataaagaattactttatcaataaacaaaggtaaacaataagctgagggttcagagtaatacttttctacattatagtgagagaaataaattattaattatagtcaaaagtattaaaataaattagtattgcaggctgggcgccgtggctcatgcctgtaatcccagcactttgggaggctgaggtggacggatcacgaggtcaggagatcgagaccatcctggcaacacattgaaaccctgtctctactaaatatacaaaaaattagccgggtgaggtggcaggcgcctgtagtcccagctactcgggaggctgaggcaggagaatggtgtgaacccgggaggtggaggttgcagtgagccgagatcgtgccactgcactacagcctgggggacagagcatgactcagcctcaataagtaaataaataaataaataaataaaaataaaataaaataaattagtattttactaattgtacttttaagtaataaaatgtattacatttaaaaattgttagattatgtgtgaacttaatttttttaccatgttaagcctattgtgcatttaatgaagcattttttttaatgaagcattattatgccactaactttaaactatttctccttacccaagcgtgtaaataaaagatggtagcaatatactatttggtatatagtggaataacatctctagtaatcactttgccaatggctttaaactgtaaatgtattgaagaatattgttcccataggtcaaatttttattctttattcttattgaaatgtattattagtatttatgagtatgtagtatgtgtatatatttatgccttatatggcatattttgagttaggcatataatatatagtaattactttagggtaaataagatagccatcagctgggtgtggtggctcatgcctgtaatcccagcactttgggaggccgaggtgcgtgaatcatgaggtcacgagattaagaccatcctggccaacatggtgaaaccccatctctatttaaaataaaaatattagttgggcacggtggtgcgcatctgtaacctggaatcccagctacttgggaagctaaggcaggagaatcacttgaacctgggaggtggaaattgcagtgagctcagaatgcaccactgcacttcagcctggtgacagagtgagactctgttaaaaaaaaaaggtatccatcacttgtagcatttatccttttattacaaactgtaattatacatttttagtgtataatttagtgagaaggattgcctggtgtcaggatttcaagaccattttgcccaacatggtgaaatcccatctgtactaaacataaaaaatttagttgagcatggtggcacacgcctagaggctgagtcaggaaaatcacttttaactccagaggtggaggttgcagtaaggcaagatcatgccattgcactccagcctggttgacagagcgagacttcatctcaaaaaaagagaaagaaatataaataaaatccttacatttctgagtcctgaaaaattattaaatatttgttatatagttttcttttaacatttggtctctctgcctgcgaacatatagacttttagttttaatttatgtggggaaaagtgagagaaatcagattgttactgtgtctgtgtagaaagtagacatgagactccattttgttctgtactaagaaaaattcttctgccttgagatgctgttaatctgtaaccctacccccaaccctgtgctccctgagacgtgtgctgtgtcaactcagggttaaatggattaagggttgtgcaagatgtgctttgttaaacagatgcttgaaggcagcatgctccttaagagtcatcaccactccctaatctcaagtacccagagatgcaaaacactgtggaagaccgcagggacctctgcctaggaaagccaggtattgtccaaggtttctccccatgtgataacctgagatatggcctcatgggaagggaaagacctgaccatcccccagcccaacacccataaagggtctgtgctggggaagattagtgaaagaggaagacctctttgcagttgagataagaggaaggcctctgtctcctgctcatccatgggcaatggaatgtctcagtgtaaagtccaattgtatattccatctactgagataggggaaaactgccttagggctggaggtgagacatgctggcagcagtactgctctttaatgcattgagatgtttatgtatatgcacatcaaaagcacagcacttttttctttaccttgtttatgatgcagagacctttgttcacgcgttttcttactgaccttctctccactattaccctattgtcttgccacatccccctctctgggaaatgcccgataatgatcaataaatactaagggaactcagaggccacggcaggcaggcgcggttcccccttatgctgaacgctggtcccctgggctgatttttttttctctatactttttctctgtgtctctttcttttccaagtctctcattccacctaacgagaaacacccacaggtgtggaggggcaacccagcccttcaaatttacatagagttaaatatacacatattactctgaagataaatcttaggtgtaagaaaagtattaagtgagtgtttgtgtgagtatgagtttgtacatattttcaggagaaaagagcaataattgcaacaaaatgaataaataaggtgactaatagaaaactaaacacctcaaaaatgctgaaagcaaatctatactttttgctttgtcttgaattcctttattcattttattttattttatttttttgagacagagtttcactcctgttgcccaggctggagtgcaatggcacgatctcggctcactgcaacctccaccttttgggttcaagtgattctcctgcctcagcctcccagtagctgggactacaggcacatgccaccatgcccagttaatttttttttttgtatttttagtggagactgggttttaccatgttggccaggctggtctttcattcctgatctcaaatgatccatccacctaggcctcccaaagtgctgggattacatgtgtgaactgccacattcagtgtgtcttgaatttattaatgtaaaatgttatggcttatggtttggattctccctagaatctgcctattaaagcacaggcatctttgtcttcagaaatgacactcttgagtagaacaataaaaaccctcttcaaacagaaaaaaataatcatttttaacacttattttaatgaaaatttaaccaacattgagtaattggatatatttttattgttttatgtgtgtgtgaatgtataaaatggtacatacaggaaaaataattcaagccagaaaaaagatgtaagttaatatttgtaatgaatgaaactggagagtagttaattattatttgcagataatatatttgtttatgtagataacaaaaggagcagaaagactattttaaaagtttatttaggtgggtaggcaacattttaagataataccctggattaccagtctgttgcacacctgctgtgtcatactttcctcttgagtgaaaaaaaaatgtatgactgtggtgggaaatcactcatgaaattaggttactcaactgttgactttgtgtttatcaaaatggagattattctgattgtgttaaacttaatcacaggtgcttctaagagaaagagacacatagaaaaacaacctgctggcctgattgttttgtgtgtttttctgtgctggcttactttacttggcataatatttttcaggttcatgaatattgttgcaaataacaagactttcttatttttaagtgcagagaagtatttcattgtgtacatataccacattttctttttctattcaactattgatggacacttaggatgattccataccttagctattgtgagtaatccacttccttccctctgttttgttttgtttgagatggagtctcattctgttgcccacgctaaagtgcagtggcacgatctcagctcaccgcaacctatgcctcccaggttcaagtgattctagtgcttcagcctcctgagtagctgaggttacaggtgtgcaccaccatgcttggctaatttttgtatttttagtagaggcaggctttcaccatgttgaccagagtaactttcatttgtttgtatatatttttcttccttttctatttctagaagcatgttaattttaaaatataaattatgaatgttaaaaaccttcattctctgtctttgattactattacaactgatttaaaaataagtttttttgaaattccctggataaaggttattacttcattattaacataacttgagacagcatagaaatgaaagtgaatatttgatagtaaaacagcaattatgtagctcctggtagtcatttaatctctcacccactctttggaacttctatcaagacaagaattctatttttgaaatgcttatgtttttaacaggattataagccacagccttccagcatcgggtcccaccaatgtatttggtggatccatttgtaaaccaagcatgtttctgatcttctgggattagttttttaaacgatttgcgccattggtcggggtgggaagggtggtttccttccatatctacaggacttgctcagtggtttttttgagctggcaagttttgtacatcctcatgtaaaactgataccccctttggttttggcttagcctggtcatgtatgtaccatttccattttatgctgctactttcttgggcatgccctatctggtaggttttgggggaactcatgtcccaagtcacaataggaatttcaggccacataaagacatcatggttgaagcagaggtgttccatttccagcaaagttcaatagcaagctaaaaattgcttcttgaagggatataatctttgctggcctctggcagtttgtaggtccgaaatccaaaagtaccctcttcccatgttgttcctgcctaaggctccaattagcatgttgatctaggacagttacttgcagttctactggcccatcccctataggccatagatccagggccagcttcaccacttgtttagcttgttcaaaagccatgctgtcttcctctccccaaagaaagtcatagcattttctagttgctgcatgcggaggttgtaaaatgttacccaagtggggaaaatgatgtttccagaatccaaacaagacaatacatttctggacctccttcttagtggtagaggttgcaaattgtagtattttagctttagcctttggtaaaatggactatttctctgtattccataggatgccaaggtgttggggtgatcagacccaacaccaggtcataggggctatgaagtctgatagagtcaaagaatgagacaagacaagttaaaagttcatagggtgggtccagggggccaactccaagcatggtggctgtgaagaccccaagctctgggagcccatgctatttataacttataacttattggtaatcaaacaaaaaagcagttggtgaggacatgtggacatgggggtagacaggtgaggatgtgcggatagaaaggtagtggtgaatcaagcgtagctgtgatggttgagcatatgctctgctacttgagataaaggagaacaggttcttctaattcaagacacaatcaatttatggtctcaggagagcaagaagcaatgggccaacgagtctggatacattccagaggctacaaggggttttatgccctgagcctgggttctgtccaagccacaaggggttttatgccctgggcttagactgtagtgtggcagggcagccttccaccctttggcacagagcttggtgttccacaggccacaaggggttttagaccctggaaccaggacatgttccaagactcttttatattatgtcagacaagcaagccctgcctcagctcttctgccaacaccaaggaattttacagtttgtgcaggtcctttgaattttactaaggttaatttcccatccttgagataagagttgggctcttacccgctccaagccccagctaactagttcctcagtttcaccctgaccaggccatttagacagctgcttttttcagcaataggctgatagctttgagcctgatcagtcaagtcataggcctggcattgggccagggccagtctggaagtaaaattagcattttccttttccagcttacatttctcttgtagcaactagcccttatcttgacacattaacttataagcagtaagcaaacaccatccactctggcagatccctcagcttctcctttgctgactggaatctcctgcagcacttcccgcacagtcaaaggtttaaattgcactaatttagattcccaattcccacaaagagcagttcccctggaccattcaaaagggagaactggaggagttcccatcgcgggatatgaggagtcaccgagcctccagccctgtccttctggccaaaaagtggcacacttttgttttgaatcctgttcgtgacgccgaaactgttctgtgcgggaaagaggcaaggggataagaaaagacagacacacaatacctttaagggtaaacaagcttcatcccatgtaaatggcaatgcagatatattaagcaaatgatataataagcaaaaaaaatataataagcaggttgatataataagcaagttgcaatgggaagaggagaagggaaaagtttgtgaagtttacgctcaccagactatggaagattcaccaccagagtgggaagcaacaacctgggctccagagtcggccacccatttgtgcacagatgaggagaggtctcatgaagcttcagtgcagtctgggaccttagctcatttgtaacaagttgtttggcatgaggcccggtcatgagggccctttgcaactgggcttaaggaacacaaaaagattaacttgtttttgcgattgtctattgtttttcaaaaatgaatgtatatgaatagattgaaatagagatttctccaaaacagcactggatgaatgcctctaggggctcacaaaacctattctgggacttggtgaccattgcttctgtccacgttcaattgacttcaaatttaatatttaactttacctccacaaattcctctgtcttgatgaatcggctctgtctaggcaaagggcaaagcgaaccacttgggccttacacaacctttacctcctcgattcaagcgattttcctgcctctgcctccgaagtagctgggactataggagtgcaccaccacaccctgctaattctttgtatttttagtagagatggtgtttcaccatgttggccaggctggtcttgaacttctgaccccaagtgatctgcccaccttggcctcccaaagtgctgggattaaaggcgtgagccaccatgcctgtccctgaatgatttctttctatctcctataactgtgaaatcacttaatggatgtttcaaactgaaaataataaaaagaatgtacataaaaataaaatacaagaagtcataaaaattagaagagattacaaaatatatatgcatatctcgaggggtcaaaaatgagaaattttgtttatttacagcgttttgtttatttatttatttaattttttttgagatggagtctcactgtgttgcacatgctggagtgcagtggtgtgatcttggatcaccgcaacctccacctccctggttcaagcaattctcctgcctcagcctctggagtagctgggaccacaggtgcatgccaggaggcctggctaatttttttgtattttcagtagagacgtggtttcaccatgttagccaggatcgcctcgatttctttctatgtcctatagcagtttgaaattacttaaaagttgtttcaaattgaacaaataaaaataatgtgcataaaatataaatagtttaaaaaattacaagacattacaaaatacgtatgtaaatctggagttgtcaaaaatgacaaatttgatttatatataaggttttattaaaattagctttaatggatactacactattaccaaagtaaaagttgattttctcttgaacaaaaatttgttgtattattaatatgacagcaaaatacttctgttcaccttttgaatacattcaacaggagagagtaaaaaagaaatagaattttcccatgctctgggatgtaagaattatccaatcagggacactgtgctggaaaccgtccaatcaggcacacagctgtagcgaacagcacggcttccgggtttggcggggcctttgtgtctctctgcagcctgagctccaggtctcttcttcactgctctgtgtcctctgcccctagaggcccagcctctgtggccctgtgtcctgtaggtattaggagatccacagctaggacgccgggatcccggaagcccggaaatggtaagaatgccggtccgacatcccgagagagggggaggggctggttggaaccggaaggaaatgtctttggcaagactcagctccagtcagtcagctccacaatttgtgccccgagttctccttacccagctcggcctcagtcctgttcagccataagatggcggctacacagaagcctggccccctgggcgtcctctcttccgtgcgcaatgactgtgtcctggcctggagccctctgtgggcagctctgcatctgcagcgctgtgtctctcccagattgtacagggatcatgagagggtcgtcaagggagaatcctgacttggggttcaggttcatgaatgggaagagctttggtccgtggggttcacagtttctcttttctcctattaaaaatgtatggggccaggagtggtggttcatgcctgtaatcccagcactttgggaggccgaggcgggcggatcacttgaggtaaagagttattagaacaagtaagttcctcttcaaagactcaacttctttgtcataagttgtaaatcaaatttatccctgctttccccttctccttttgttgcaaattgctcgtttaccctatttggaaaaagctggggtctaagccaaccgggatcagcttagattattgggtctgacccaagccaatagaggaaggacacaaaaacaggaactgtgttagggttaataaccccttcctggctgggtgcggtggctcatgcctgtaatcccagcaatttgggaggctgaagcgggctgatcacgtggtcaatgtaaggctcttgtattggtttgaaccgtgagagcgtgccaacagacaacaccaggcagtgtggagcaacatgctgttttagtgagtgccagggtgcaggccggctgaggcctacaatggcgtcagcaccaaatgaggacgaggcaggagttttattgtctccagtaaacaggaagtctcccagtctgatggggctgctacgtagtacccagacagcctctttctcaaacttcagggttacatgtcttctggccagagttgatgtcttccagacggttctcttcctgcttctgctatcttgctggcacacactgctgatgcaggtaggcttgcgccttgggactgggcctgggaagggaggagttactcatcccttcaagctttcagaccccggggagattctttctttcctctctttttggttatagaaagaaagggaaaaggggtgactttctcaataactacttcaggtgtgacatagggggtggcattggaaccttggaaaaaggtgcgtggctgggtttagatgggagctggttaatttttggggtattcttgagagacgggttggtgtccatcgtgttgttgaagcagaagcatcatctggattgtctggcagttaactgtagtttcaacgagagttttaatggcttttattattagtgggataacacaggcgagaaacaggaggaacctaatgataaaggtaactgtccctaccagccttttaaatcctcctaaatgaaagaaccaccctcctaggaggtttgttgggccacatcccttccaggtttagactggtacatgggctacttttctcatgtttgaagtgatttctagaacaacttttctgttatcatctatgttaagacagcaattaggatattaaacttaccacagattccaccctttcctgctaataagtagcctagtgctggcctgttttgataaattgctgtgcgcatttgattttgttgttgtgtgaacatttccaaggctgagaccgtttggttagtgattatctttagaacagcctgtaattattctatttagcatatatatgggagtgcgataacctcatgaaccatcctctgcctaaatggcagggccataatattcgatgatccattgcagaggccactcgtcttcttgcacagggactccaagggtgtcacctgctgttaatgttttggaggaaggagtagccttggagatgagcttgaccctggtgtgatggatccagtgggggagttcttggactctcactacagttggcatgctgagtatgacagtgtaagggcctgtccactttggttgtaccttttggtgagggctgggttggcagataaacatgtctatgcctgcaaggcagttatgttgagaggacaaggaggtgctgacagggagaggcatggcctcatttgctgcttcacgaatgaaagactgtgttggattaagtaggggaggtaattcctgagtggctcggagtctggtaaggatggaggccttaagacaaaagtatggctatgtatgattttgaagggagtataaaaagagggtgcttttggtgttgtgtggagtctcatgagggtgaaagggagatttcttgtccacaactgacaggtttctagagctagcttggtgagttgggttttaaggacagagttgactttttaaactttgcctgaagattgaggcctgtagggtgtatggggaacctatttgattcttaaggatgtagagacaccttgggtaatttggctgataaaggtgagcctgttatcatactggatggatgttgggagtccgaaacggggaattatatgcatgatgagagtttgtgtgatgacatttgcaccttctgaagttgttgggaatgcttctacctacccggagaaagtacagacaaagactggaagatagcggagccgtttatcgggcagcatgtgagtgaagtttacttgccaatcttgcctgggtaccttgccctgggcttggtgggtaggaaaaggtggtggccagggtaagccttggggtgacactaagtggcatatagagcaggacagggtgattccttgaacacagcaggaaagatgaggacaagtgagaatagggtggagaaattgagggagaagtttgtaactgacatggaaagagttgtggagactttggaggatagggattgtttgagattgaggaaggatgaagcacccttccttgacataccatggtccttgcttttgaaggtttttggcctggaagtcctctttttctttggaggagtgaaaaggagggaatgaggacagggacagagcatggctgggtttagatgcgagctgttagcacagtgatgtggggagtttctatgaatagagcatacagttggaggagcagtggggcagagatgagacttagtacactggggtgagctagcatgtctttgatgttatgggttgaataaactgttaggttggcatggagagatagttttaggctttcaagggtgagaacagcagctgccgtcaaggctcagagacaggcaggtcatccaagaactgtggcttcaagctgtttagagagttaggcaacatcctggagggtgggtcccttatactgggttagaacacctagtgcaactctacgctgttcgtcggtatagagggagaaaggtttggtaaggtctgcgtctgggagaacgaggataggggctgagttgagagccttttggagtagacagaaaggttgggtaataggctgtgcagggtttaaaggctcatggagagggcctttagtggcttggtataacggattggcaagtagagcgaaggaggaaacctagagactaaaatatcccgctagtcctagaaaagagaatttcttgctagtttgtggaggcgggagggactggaggagggatatgtggttggttgtgagccttcggtttcgtggggtaagagctaggcctagataggtgactgagggggtgcatatttgagttttaggggagacctgatacccccattctgccaagaagtttaaaagaaagatagtatgggcgttgcagtctctttgagaggggctacacaagagcagatcattagcatattgaaggggagtggatggtgttaggaataaggtacagaggttgcaagccagggcctgcccaaaaaggtggggactgtctctgaaaccctgaggttactacttcaagggtaggtgggcacagcctggtgggcttacctgagggggcatggcctggtgggcttatctgggtatgcaccaggtgaaaggtgggtgtcggggttttcctacgtaaaggcaaagaggtcctgagaatcagggtgtgaaggaattgtgaaaaaaagcattatttagtttaggacagaaaaatgggtgatattgtagggaaccacggaaagtaaagtgtatgggttagaaactactggacatactgggagtacagcttggttaataagcctagggcctggactaagtgataagttccatgtagctttttaacaggtagaatcagtgtgaaaaggggagtttgttgggcagagtaggtgattggcgaggaggcgagaaatgatagggtttaggcctacaagagctgcttgggggttggatactgcttctgtgataggaactgggtggggtttttaagggtaatgtgaacgggggcgtggtgttctgtcactgagggtgtggaagtatcctaaacagtgaggttaactatggatggggaataaggaaaggctgcatgttttaaggtgggaggttggaggagaagaagaaaattagaagcccccgaggggtctgggtagatgcgttgggtactatggggaatgtggaggtggagagtagtgtggagttttgagaggatgtctctactttggaggggagttgggcatgagggcaggactaagaaagagtgagtaaggaaaaggtgtgcagggaccagaaaagtggaggagtggctcatggtttggacacttgtccatcaattcctacaacagactgggaggactgggaaattaggtaaagcagagtaggttgccccagtattaattttaaaaaacatactggcctacctgccaccatcagtgttacccttggctcagatgaagatatggtagttgctgggatgccctttccagggcaccatcagtcttcagcagcaaggctggtgagatccaagtaggaggttttggctggctcaggaagggatgagggcagtgcttctgggggacgctcacagtctgacttccagtggagtcctccatagagggggcacgaactggtgggcttacctgggtttgggcattgtctggaccagtggccttcattgccacacttgaaatgtgcaggtgcaggtggattcctaggggcttccatgtggagctgtggccccatgggcctgcagggcccctgatggcggaggcaagcatttgaaactctgcctgtttttgccttttactttcctcatcatgattgttaaagactttgaaggctaaattaagatctttttgtggggtttgtgggctgttaccaagcttctggcttctgaagcttgtgctgaatatcaggggtggattgggaaatgaactgaaggtttaaaatagtggttccttctgagctggttgagtctacgttgttatattttctcatggcttcaggtaaacaagagggagaaaaagggctgggttttcatcaggacattgggtgatttctgaaagtttttcatagttgactgctttatgggcaccttttgagtcctgcaaggagacacacaatcatgtggtcttgatagtggcatccagggtccctgtcttgataatcctagtgggggtcctggttggggactgcctctgtaccagtagctgggcaagagcctggtgattaattgtattagcatgtgcctgagctagggtccagatagtctcagtcttctggggtgagagttgaagagaggataatgtagaggtcatgccaagttagttcataagactgggtaaggtactgaaattccctaaaataagaggtagggtcttttggaaatgaaccaaatcttttgttaatttgagagagatcagtgagggagaagggagcatgaactctcacaataccttcagctcctgctacttcccaaagggggcactctagcaccgacactgaagtaagggtggggcatgggccaaagatggcacctgagtgagtatggatgggagagaaggaagaagtcggaagtggttcctactgaccatttgaagggagaaggggggttgagttgataggcagtggaggatagataggggtgtaaggtggttggatgggtttacaggcctcaagagagggcggtgggggaggagactgggtacaggcaatactagaattgtcctgaggaggggacgatgtaggaaaagaagtggatactgctgactgggaagatggcagctgagaatataaagaggaggcttggggggttatagaagacagttgagagggagaggtaggggctgtgaggggtggacagcagtctgctggatccagtaagaaaaaagacgtagggttgggaggagaaaggtgatcaggtcggtgagaatggagaagtatttgaacaagtgagcaagaattgcagaggtcttgttgtgatctgagtgcaaaaaggcctggacataaggcatttctgcccatttttccagcagtcagcaataattgctttaatcagttaaaattgtaaagtcgaatgttccatttgtgggccatttggacccattatccaattcataatgtggccagactgaattgcaaaaaaagacaaggtgcttagggcagatatcttgcctgaggcctaaggtttgcaggttttttacaaggcagcctagaaggctgtccttcagaatggaaaactgggaattttctataatggagggtaggcactagagaacagagaaaaggagaccgtcctggatagccggatggagacaataaaaggagcagttgtcatcactgcctttttcattcctggaacgggatcagatggcttagaggggttcccctaaggccagatgatcagctagtgcctgacacatgccagagccttcttggaccaacattggatttttggacacaagaaccaagagaggccatacagatttttccctgttaagcgggctcccacagaaagctaccagtaggtgagatcactgactgatgtgcatgtacagagaggcaactggaggctgaggagcttcttttgtccagctgctgtggcctgctctccagggcagaggggtaggtccatggggatgcagacatcagctctcctgggttttggcaccaaaatgtaaggttcttgtattggtttgaaccctgagagcacactaacagacaacatgaggcagtgtggagacacatggtgttttaatgagtgcctggttgcaggcgggctgaggcctaaaatggccccagcaccaaataaggatgggtcagggatttcatggtctcctgtaaatcagaagtggcccagtctgacatggctgctatatagtacctggacggcctctttcttgatcttcaggagtacgtgtcttctggccagggtgggtgtcttctggccatctctctttctactactgctatcttgctggtgcacactgctgatgcaagtagccttgtaccttgggactgggcctgagaagggagttactcatcccttcaagctttcaggccccggggagaatctatcagtcaagagttctagaccagcctggacaacatggtgaaacccgtctctactaaaaatacaaacattagtggggcgtggtggcaagagcctctaatcccagctacttaagaggctgaggcacaagaattccttgaacccgggaggtggaggttgcagtgagctgagatcctgccatcacactccagcctatgtgaaagagccagactcattctcaaaaaaaaaaaaaaaagaaaaaagaaaaaaaaaaggtaagcatcttaaaatttcctttgtttatttaaacactgtgagtaatttcactggatttttcaaacacttagtttcaaacacgaagtgaataactctgacatggaaattaaagcttgaacctagtgattccaagctaagactaatactaagcctacaacaggaggtttttgttgttgttattgttgtttttgagacagagattcgctcttgttgcccaggctggagtacaatggcacgatcttggctcactgcaccttccggttcaagtgattctcctacctcagcctcaagagtaactgggattacaggcatgtgccatcacacccagctaatttggtatgtttagtacagacggggtttctccatgttagtcaggctggtgtccaactcacaacctcaggtaatttgcctgcctcagcctcccaaagtgctgggattacaggcctgagccaccgcgcctggctaacagtaagttattaaaggcctactgtttttttctggggagcctcccctgcagatgtcccagcctgcgcatcctagcaatggaaggagcctttatcctgagagaagctacagagtcctggaaagctggggccccacagcttgatgcagttaagatgaagacgaaaggaaactgggaggttctaactgataatgaagttattgttttgaggcattttttagactttgtaaaataacaacgtcagatttatgttaaaaaaaaaaaacgaattccaaaatgtattgcaacaggaggaagtatcaactaactataaggcctttatggcttgcaaaaatgtaggcagaaaagggctttctttcctagggaggagcaaacaatattggaaaggaggtgggaggggaatggcaaatggagggtgaaaaagtcagattttagatcagagaatgtcataccctgaaatcagcatgttcttagtagggacataaaatggggttgtatgttgacacagactgagagtagctcaaagttcaggagcctgagggagaaagataaacttaagtaaagtttgattaagaaatattttattttaggctgagctcaatggctcacgcctgtaatcctagcactttgagaggcagaggcaggtggatcacctgaagtcaggagttcaagacctggctaacatggtgaaaccctgtgtctaccaaaaatacaaaaattagctgggtgtcattgcagtcatctgtaatgccagctacttgggaggctgaggaaggagaattgcttgaacccagaaggcagaagttgaagtgagccgaggttgagccactgcactcctgcctgggtgacacagcgagactccatctcaaaaaaaaaagaaaagaaaagaaaagaaaatgcttatttaagtgggatggcatttattaaccagaaagttctgaaaaaaattattaggagataccagctctctacggtgctgaatgaagtctacttaaaattactactaaggtgattccgttccaagatggccaaatagggacagctctggtctacagctcccagtgtgattgacacagaagatgggtgatttctgcatttctaactgaggtacctggttcatctcattgggactggttggacagtgggtgcagcccatggaggcagagccaaagcagagtggggcattgcctcacccagaagcacaaggggtcaggtgatttccctttcctagccaaggaaagccatactttcaccaaagacagtgcctgaaaaaataggaaacttccacccaaatactgtgcttttccaatggtcctagcaaatggcacacaaagagattatatcccatgactttcttggtgggtcccatgcccacagacccttgttcactgctagtgcagcagtctgagatcaacctgcaaggcagcagcctggcagggggaggggcgtctgccactgctgaggcttgagtaggtaaacaaagcagtcaggaagcttgaactgggcggagtccaccacagctcagcaaggcctctgtctctgtagactccatctctgggggcagggcatagctaaaccaaaggcagcaaaaacttctgcagacttaaacatccctgtctgacagctctaaggagagcagtggttctcccagcacagtgtttgagcttggagaacatacagactgcctcctcaagtgggtcactaacccccgtgtagcttaactgggagacatctcccagtaggggctgactgacagctcatacagccaggtacccctctgggatgaagcttccagaggaaggatcaggcagcaacatttgctgttctgcaatatttgctgttctgcagcctccactggtgatacccaggcaaacagggtctggagtggacctccagcaaactccagtagacctgcagctgagggagctgactgttagaaggaaaactaacaaacagaaagaaatagcatcaacgttaacaaaaaggacatccacaccaaatcccatatgtaggtcaccaacatcaaacaccaaaagtagattaagccaaaaagatggggagaaaccagatcagaaaagctgaaaattctaaaaaccagagtgcctcttctcctccaaaggatcgcagctcctcgccagcaatggaacaaagctggatagagaatgactttgaagagctgacagaagtaggcttcagaatattggtagtaacaaacttctctgagctaaaggaggatgtttgaacctatcacaaggaagctcaataccttgaaaaaagattagacaaatggctatctagaataaacagtgtaggaaggagcttaagtgacctgatggagctgaaaaccatggcacaagaactacatgacacatgcacaagcttcaatagctgattcaatcaagtggaagaatgggtatcagtgattgaagatcaaattaattaaataaagtgagaagagaagtttagagaaaaaagagtaaaaagaaatgaacaaagcctcccagaaatatgggactacgtgaaaagaccaattctacgtttgattcatgtacctgaaagtgacggggagaatggaacgaggtagaaaacactctccaggatattaaccaggagaacttccccaacctatcaaggcaggccaatattcaaattcaggaaatacagagaacaccacaaagatactcctcaagaagagcaaccccaagacacaaaattgtcaggttcaccaaaattgaaatgaaggaaaaaatgctaagggcagccagagagaaaggtccggttacccacagactgaagcccaacagactaacagcagatctcttggcagaaatgcgacaagtcagaagagagtgggggccaatattcaacattcttaaagaaaataattttcaacccagaattcatatccagccaaactaagattcataagtgaaggagaaataaaatcctttacagacaagcaaatgctgagagattttgtctccaccaggcctgccttacaagagctcctgaaggaagcactaaacatggaaaggaaccaccagttccagccaccacaaaaacatgctaaattgtaaagaccattgatgctaggaagaaagcccatcaactaacaagcaaaataaccagctaacatcataatgacaggatcaaattcacacataacaatattaaccttaaatgtaaatgagctaaatgccccagttaaaagacacagactggcaaattggataaagagtcaagacccatctgtgtgctgtattcaggagactcatctcatgtgcagggacacacataggttcaaaacaaagggatggaggaagatctaccaagcaaatggaaaggaaaaaaaaaaaacagtggttgcaatcctggtctctgataaagcagactttaaaccaacaaagatcaaaagagacaaagaaggccattacctaatggtaaagggatcaattcagtaagaagagctaactatcctaaatatatatgcacccaatacaggagcacccagattcataaagccagtctttagagaagtacaaagagatttagactcccacacaataaaaatgggagactttttagacagatcaatgagacagaaggttaacaaggatatccaggacttaaactcagctctgcaccaagcagacctcacagacatctacagaactctccaccacaaatcaacagaatatacattcttctcagcaccccatcacacttattctaaaattgaccatatagttggaagtaaagcactcctcagcaaatgtaaaagaacagaaatcacaacaaacagtcttgcagaccacactgaaatcaaattagaactcaggattaagaaacttactcaaaactgcacaactacatggaaactgaacaacctgctcctgaatgactactgggtaaataacgaaatgaaggcagaaataaagatgttctttgaaaccaatgagaacaaagacacaatgtaccaaaatctctgggacacatttaaagcactgtgtagagggaaatttatagcactaaatgccaacaagaggaagcagcaaatatctaaaatcaacaccctaacatcacaatagaactagagaagcaagagcaatacgcattcaaaagctagcagaaggcaagaaataactaagatcagagcagaactgaaggagatagagacacaaaaaaccctttaaaaaatcaatgaatccaggagctggttttttgaaaagatcaacaagatggatagaccactagcaagactaataaagaagaaaagagagaataatcaaataggtgcaataaaaaatgatgaaggggatatcaccaccaatcctgcagaaatacaaactaccatcagagaatactataaacacctctatgcaaacaaacttgaaaatctagaagaaatgagtaaattcctggacacatacaccctcctaagattaaacaaggaagaagatgaatctctggatagaccaataacaggctctgaaattaaggcaataattaatagcttaccatctaaaaaaagtccaggaccagacagattcacagctggtttctatgaggaggagctggtaccattccttctgaaactattccaatcaatagaaaaaaaaggaatcctccctaactcattttatgaggccaacagcatcctgataccaaagcctggcagagacacaacaaaaaaaggagaattttagaccaatatcactgatgaacatcagtgcaaaaaacctcaataaaatactggcaaactgaatccagcagcacatcaaaaagcttatccaccacaatcatgttggtttcatccctggaatgcagggctggttcaacatacacaaatcaataaacataatccatcacatacacagaaccaaagacaaaaaaaccacatgattatctcaatagatgcagaaaaggcctttgacaaaattcaacaaccttcatgctaaaaactctcaataaactaggtattgatgtaacatatctcaaaataaaaagaggtatttatgacaaacccacagccaatatcatactgaatgggaaaaaagtggaagcattccctctgaaaacttgcacaagacagggatgcccactgtcaccacttctattcaacatagtgttggaagttctggccagggcaatcaggcaagagaaagaaataaaggtattcaattaggaaaagaggaagttaaactgtccctatttgcagatgacaaaattgtatatttagaaaatgccatcgtctcagcccaaaatctccttaagctgataatcagcttcagcaaagtctcaggatacaaaatcaatgtgcaaaaatcacaagcattcctatacaccaataacagacaatcagagagccaaatcatgagtgaactcccattcacaattgctagagagaatcaaatacttaggaatccaacttaaaagggatgtgaaggacctcttcaaggagatctacaaaccactgctcaatgaaataaaagaggacataaacaaatggaagatcattccatgctcattgataggaagaatcaatatcatgaaaatggccagactgcccaaggtaatttatagattcaatgccatccttatcaagctaccaatcattttcttcacagaattggaaaaaaactactttaaagtatatatggaaccaaaaaagaccccacattgccaagataatcctaagcaaaaagaacaaacatggaggcattatgctacctgactttatactatactacaaggctagagtaaccaaaacaccatggtactggtgacaaaacagatatatagaccattggaacagaacagaggcctcagaaataacaccacacatctacaactatctgatctttgacaaagctgacaaaaacaagatatggggaaaaaattccttatttaataaatagtgttgggaaaactggctagccatatgtagaaagttgaaactggatcccttccttacaccttacacaaaaactaactcaagatggattaacgacttaaatgttagacctaaaaccataaaaaccctagaaggaaacctaggcagtaccattcaggacataggcatgtgcaaggacttcatgactaaaacaccaaagcaatggcaacaaaggcaaaaatagagaaatgggatctaattaactaaagatcttctgcacagcaaaagaactaccatcagagtgaagaggcaactttcagaatgaaaaaaaatttttgcaatgtacccatctgacaaagagctagtatccagaatctacaaagaacttaaacatatttagaagaaaaaaaacctcattaaaattgggcaaataatatgaacagacacttctcaaaagaagacattcatgcagccaacagacatatgaaaaaaatggtcatcattaccggtcattagataaatgcaaatcaaaaccacagtgagataccatctcacaacagttagaatggcgatcattaaaaagtcaggagacaacagatgctggagaggttgtggagaaataggaatgattttagactgttggtggaagtgtaaactagttcaaccattgtggaagacaatgtggtgattcctcaaggatctagaacaagaaataccatttgacccagtgatcccattactgggtatatacccaaaggattataaatcatgctactataaagacacgtgcacatgtatgtttattgcagcactattcacaatagcaaagacttggaaccaactcaaatatccatcaatgatagactggattaagaaaatgtggcacatatacaccatggaatactatgcagccataaaaaatgagttcatgtcctctgcagggacatagatgcagctggaaaccatcattctgagcaaactgtcacaagaacagaaaaccaaacaccacatgttctcactcataggtgggaattgaacaatgagaacagttagacacagggtggggaacatcacaccctggggtctgtcatggggtggggtgcagggggagggatagcattaggagaaatacctaatgtaaatgatgagttaatgggtgcagcaaaccaacatggcacatgtatacctatgtaacaaacctgcacattgtgcacatgtaccctagaacttaaagtataataataaaaaataaaaaaaagtactactaaaaattatggaacataggagttatctgtacattgaagtttgcataaaacatgtttctttaaggttaaattcagattttatttactttgtgttggaggaatatttcaacagtgatgctgtgttcttctgtgtgcattagcacatcataaaaatttgtccagtgcagttaatggttaatgattcacttgcttaaatagctctctgacagattttttcactcttcagttaattatttttctcttcattattaagtatctttatgcagctgatgtgtataaaacgctatacttaatctggcagctgcccttttttcttattttttcttcatatttttctttggaaaatgaaggcttttatctttgtttacaggtgagaaaaacttggaaaacccaggcttttccacttactggatgtgttacaaaatatccttcttgggccaaaaacatagacagtattgctgagcttgttagaaattaaaaaaatcagactttatgtcggatcttctggaaaaaaaaaaaaagaaaaaaacctgtataacaaggtcttgaacttattgtacatatcaaaatttcagaggtgtcttgtagctcaatatgtctttttccatctgaaaaatatgcacaactcattcagtatgatgtaaatatagcactgaaaagtgtgtatgttgatgttcatgctcttaattttatactttgttagctacaataacatcatatatgaactgatgtggatcttatgctgttctttttttctcagagttaaaaaatacattagagaatatttctttgttggagattattttcttggataatttaattctataagtaagaaccagttccttttactttccaatttcaccttcagtcaaaataaaaactctgcccatggccacttggtaaaaatgtgtgtgtgtgagtgtgtgtttgtttcaggggccattgcaatttagagatgtgcttacagaattatctctggaggagtggcattgcctggatactttacagcaaaatttacatagcgatgtggtgttagagaacaacataaacctggtctttcttggtgaggataactttaatacataattcataatatactctaaaggttttctttctcttttttgtggaatgttttttagtaatgtattcattgatcaaagagtttcagaacccattttccagaaaatctttagaaatttttcatttagaaaagaatttgttcaagatgttttgtgttaatcaaaactttacacattcctgagttgagctatattcttcactctaaattagtgataattccagaaatttggtggcataaaatattgttgtccccacctgaaaatctaattatcagcaacaagttttgattctgtagtaccaggtagtaaaattaaaaaacctacaagtaggctgggcgcggtggcttatgcctataatcccagcacttcaggaggctgaggcaggaagatcatgagatcaggaattcgagaccagtctgaccaacatggagaaattccatttctaataaaaatacacaattagccgggcatggtggcacatgaatgaaatcccagctaccctggagactgaggcaggagaattggttgaacccagaaggcagaggtttcactgagccaagatcgtgccattgcacttcaacctgggcaataagggggaaactctgtctcaaaaagaaaagaaaagaaaagaaaaactgatgaattcaaagtgttttctgggagccaagatggccaaataggaacagctccagtctacagctctcagcatgagtgacacagaacacgggtgatttctgcatttccaactgaggtaccaggttcatctcactggggagtgccagagagtgggtgcaggatactgggtgcactgcaccgtgtgtgagccaaagcagggtaaggcatcccctcacccaggaagtgcaaggggtcagggaatttcctttcctagtcaaagaaaggggtgacagacagcacctggaaaatcgggtcactcccaccctaatactgtgcttttccaatgagcttaacaaacggcacaccaggagattatatcccacacatggctcagagggtcctacgcccatggagccttgctcattgctggcacagcagtctgagatcaaactgcaaggcagcagagaggctgggggaggtacgcccaccattgctcaggcttgagtaggtaaacaaagctgccagaagcttgaactgggtggagcccacctcagctcaaggaggcctgcctgcctctgtaggctccacctctgggggcagggcacagacaaaagaccgcagtaacctctgcagacttaaatgtctttgtctgacagctttaaagagagtagtggttctcccagcacgccgcttgagatctgagaatgggcagactgcctcctgaagtgggtccctgacccctgagtagcctaactgggaggcatctcccagtaggggtggactgacacctcacatggccgggtactcctctgagacaaaacttccagaggaacaatcaggcagaagcatttgtggttcaccaatatccactgttctgcaaccactgctgctgatacccaggcaaacagggtctggagtggacgtccagtaaactccaacagacctgcagctgagggtcctgactgttagaaggaaaactaacaaacagaaaggacatccacaccaaaaacccatctgtacgtcaccatcatcaaagaccaaaggtagataaaatcacaaagatggggaaaaaacagagcagaaaaactggaaactctaaaaatcagagtgcctctcctcctccaaaggaacgcagctcctcatcagcaatggaacaaagctgagcggagaatgactttgacgagttgagagatcaaggcttcagaagatcaaactactccaagctaaaggaggaagttcgaaccaatggcaaagaagttaaaaaatttgaaaaaagaattagactaatggataactagaataacccatgcagagaagtccttaaaggacctgatggatctgaaaaccatggcatgagaactacgtgatgaatgcacaagcctcagtaaccgatgcgatcaactggaagaaagggtgtcagtgatggaagacgaaatgaatgaaatgaagcatgaagagaagtccttaaaggacctgatggatctgaaaaccatggcacgagaactacgtgatgaatgcacaagcctcagtaaccgatgcgatcaactggaagaaagggtgtcagtgatggaagacgaaatgaatgaaatgaagcatgaagagaagtttagagaaaaaagaataaaaggaaatgaacaaagcccctaagaaatatgggactatgtggaaagaccaaatctatgtctaattggtgtacctgaaagtgacggggagaatggaaccaagttggaaaacactctgcaggatattatacaggagaacttccccaatctagcaaggcaggccaacattcaaattcaggaaatacagagaacgccacaaagatactccttgagaagagcaattccaagacacataattgtcagattcaccaaagttgaaatgatggaaaaaatgttaagggcatcccaagagaaaggtgggttacccacaaaaagaagcccatcagactaacagctgatctctctgcagaaactctgcaagccagaagagagtgggggccaatattcaacattcttaaagaaaagaattttcaacccagaatttcatatccagccaaactaagtttcataagtgaaggagaaataaaatactttacagacaagcaaatgctgagagattttgtcaccaccaggcctgccctaaaagagctcctgaaggaagcactaaacatggaaaggaacaaccagtaccagccactgcaaaaacatgccgaattataaagatcatcaagactaggaagaaactgcatcaactaatgagcaaaataaccagctaacatcataatgacaggatcaaattcacacataacaatactaatcttaaatgcaaatgggctaaatgctccaattaaaaggcacagactgacaaattggataaagagtcaagacccatcagtgtgctgtattgaggaaacccatctcatgtgcagagacacacatgggcttaaaataaagggatggaggaagatctgccaagcaaatggaaaacaaaaaaaggaaggggttgcaatcctagtctctgataaaacaggctttaaaccaacaaagatcaaaagagacaaagaaggccattacataatggtaaagggatcaattcaacaagaagaactaactgtcctaaatatatgtgcacccaatataggagcacccagattcataaagcaagtccttagtgacctgcaaagtgacttagactcccacacaataataatgggagactttaacaccccactgtcaacattagacagatcaacgagacagaaagttaacaaggatatccaggaattgaacacagctctgcaccaggcagacctaatagacatctacagaactctccaccccacatcaacagaatatacattcttttcagcaccacaccacacctattccaaaattgaccacatagttctatggaagtaaagcactcctcagcaaatgtaaaagaacagaaattataacaaactgtctctcagaccacggtgcaatcaaactagagctcaggattaagaaactcactcaaaaccgctcaactacatggaaactgaacaacctgctcctgaatgactactggctacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacacattcaaaagctagcagaacgcaagaaataactaagatcagagcagaaccgaaggagatagagacacaaaaaaatccttcaaaaaaatcaatgaatcccagagctggttttttgaaaagatcaacaaaattgattgaccgctagcaagactaataaagaagaaaagagagaagaatcaaatagacgcaataaaaaatgacaaaggggatatcaccactgatcccacagaaatacaaactatcatcagagaatactataaacacctctatgcaaataaactagaaaatctagaagaaatggataaattcctggacacatactctctcccaagactaaatcaggaagaagttgaatctctgaatagaccaataacaggctctgaaattaaggcaataatcaatagcttaccaaccaaaaaaagtccagaaccagatggattcacagctgaattctaccagaggtacaaggaggaactggtaccattccttctgaaactattccaatcaatagaaaaagagggaatcctcccaaactcattttatgaggccagcatcatcctgttacaaaatcctggcagagacacaacaaaaaaagagaattttagaccagtattcttgaacattgatgcaaaaatcctcaataaaatactggcaaactgaatccagcagcacatcaaaaagcttatcctccatgatcaagtgggcttcatccctgggatgcaaggctggttcaacatatgaaaatcaacaaacgtaatccagcatataaacagaaccaaagacaaaaaccacatgattatctcaatagatacagaaaaggcctttgacaaaattcaacaatgcctcatgctaaaaactctcaataaattaggtattgatgggacgtatctcaaaataataagaggtatttatgacaaacccaaagccaacatcatactggatggacaaaaactggaagcattccctttgaaaacttgcacaagacaaggatgccctctgtcaccactcctattcaacatagtgttggaagttctggccagggcactcaggcaggagaaggaaataaagggcattcaattaggaaaagaggaagtcaaattgtccttgtttgcagatgacatgactgtatatttagaaaaccccatagtctcaccccaaaatctccttaaactgataagcaacttcagcaaagtctcaggatacaaaatcaatgtgcaaaaatcacaagcattcttatacaccaataacagtcaaacagagagccaaatcatgagtgaattcccattcacaattgcttcaaagagaataaaatacctaggaatccaccttacaagggatgtgaaggacctcttcaaggagcactacaaaccactgctcaatgaaataaaaagaggatacaaacaaatggaagaatattccatgctcatgggtaggaagaatcaatatcatgaaaatagccatactgcccaaggtaatttatagattcaatgccatccccatcaagctaccactgactttcttcacagaattggaaaaaactactttaaagttcatatggaaccaaaaaagagcccacattgccaattcaatcctaagccaaaagaacaaagctggagacattatgctacctgacttccaactatactacaaggctacagtaaccaaaacagcatggtactggtatcaaaacagagatatagaccattggaacagaacagagccctcagaaataatgctgcatatctacaactatctgatctttgacaaacctgacaaaaacaagcaatagggaaaggattccctatttaataaatggtgctggaaaaactggctagccatatgtagaaagctgaaactggatcctttccttacaccttatacaaaaattaattcaaggtggattaaagacttccacgttagacctaaaaccataaaaaccctagaagaaaacctaggcaataccattcatgacataggcatggacaaggatttcatgtctaaaacaccaaaagcaatggcaacaaaagccaaaattgacaaatgggatctaattaaactaaagagcttctgcacaacaaaagaaaccaccatcagagtggacaggcaacctaaagaatgggagaaattttttgcaacctactcatctgacaaagggctaatatccagaatctacaatgaactcaaacaaattcacaagaagaaaacaaaccccatcaacaagtgggcaaaggatatgaacagacacttctcaaaggaagacatttatgcagccaaaaaatacatgaaaaaatgctcatcatcactggccatcagagaaatgtaaatcaaaaccacagtgagataccatctcacgccagttagaatggcaatcattaaaaaggaaacaacaggtgctggagaggatgtggagaaataggaacacttttacactgttggttggacggtaaactagttcaaccattgtggaagtcagtgtgacaattcctcagggatctagaactagaaataccatttgacccagcaatcccattactgggtatatacccaaaggattataaatcatgctgctataaagacacaggcacacgtatgtttattgtggcactattcacaatagcaaggacttggaaccaactgaaatgtccatcaatgatggactggattaagaaaatgtggcacatatacaccatagaatactatgcagccataaaaaattatgagttcatgtgctttgtagggacacggatgaagctggaaactatcattctcagcaaactatcacaaggaccgaaaaccaaacactgcatgttctcactcataggtgggaattgaacaatgaggacacatggacataggaaggggaacatcacacactggggactgttgtggggtgggggaagggaggagggatagcattaggagatatacctaatgctaaatgacaagctaatgggtgcggcacaccaacatggcaaatgtatacatatgtaacaaacttgcaagttgtgtacatgtaccctaaaacttatagtataataataataacaataaaagtgttttctaaatatttagaaatttctgttttaacttagtatttttgtattaatttactagaatattttatcacaccctctcagctgagcacattactagcttgtaattggagaatatgagcaagattcatattatttatttatttatttttatttttttgagacagagtgtcactttgtcacccaggctagagtgcagtggtgcgatctgggctcactgtaagctccacctcccagattcatgccattctcctgcctcagcctcccgagtagctgggactacaggtgcctgccaccatgtgtggctgattttttgtattttttagtaggtacagggtttcactatgttagccaggatggtctcaatcttctgaccttgtgatccacccaccttggcctcccaaagtgctgggattagaggcgtgagccaccacacccggtctcatgttatttatttttaataaaacaggtattgttgtctccaagccagacctgatcatctgtctggagcaaggaaaaatcctttgagtatgaggagacatgagatgattgccaaacacccaggtgggtgcaagtgaaagtgaatacaacagacgacacaggtaagagatcccaaggtgaaagagaaagccagtacttaaaatgtgatttgggaagctgtgttccaaaggaaatagttcctgggcggttgttttataatttttctctcacaaagggacatctgctgtcttatgctttcaaattctctaaggattctacttttctttcagtgagcttccttcaagttcacagtgaaagccaaagtcttcttcatggcatataagacactgcacaatcttgctgcttttacattgttttgatgacacaaaattatctgcatgattttaagaaactaaaactattctcaaagttctctttttgcattttgaaatgtgcgagagtagtagtttctgttgaatttttttcattattctgcacatttccattctgtttttattactatatagtgttgaaatatagttggaaagtataagtatgatatccttctgctctgttcttttcatcaagattgctttggctaatcagtttattttagtttcatgtaaattttagaattgtatttttcattactgaaaaagacaccactgcaattttaataggaagtttattgaatctatagatcactttagataatatggaactctaataatatttattctttcaatccatagacataaaatactttataatttatttggaacttctctaatttctttcactgattttttttggtaaaggtttttcatttcattggttaatttttttctcagaaattatttaatgctataacaaataagatttttttgtcctatttttatcagatagtttgatttaagtgtataaaaccgtacatatacttgtatgttagtttcatattttgtaatttactgagtgtatttattagtttagataggatttaatgtactgtttattagtttttaaatataatattgtatgatctacaagcaaaaactttttagttttcttaaattttaatggatttttttttatttctttgagtaaatcttctgccacatacttccagtgttacactaaaatagaagcattcacaatgggcacaatatagttttgcattggtgtctgaatttgatggagcaaagacctattcaagttttcataaactgatttcagaaggtaaatatcttcttctgttggacccttagggtgatgagatgccctctgaatttgtagtgaagaagggttgtagcttggtcaccaggctgctgggtctgcattagggtccacctttagttggcttgttacaggggcttgggttgttataattcccattttatttttggacagactgaatatccttcagagctttgctccataaggcagacactagggcatgtttttgcaattggctctgcatatggtgggccttgtatcaggatgtggatgggtgtggctttcagtgagtaccagagagcatttcctcaggtaaccgtgtgggttactatataggcagaactgaccataaactgtggctcaggtaactgaaactgagtcatggaactgcctcagtgaccccagtaaaggccaaggtctgcatgcctggatgcatgactgtaaatgggcaccttcctccaagtctctggaatagcaggacctctgtcagactgtggctgggaggagtttgggatggttacagagtaagtttagaattctcaatggaaccaagttgggtgaaccctatcctggtctgtagctaaaacaggggtcctgtagtatcccacgtgagtgagggcctgccttctgaatagaacacttctcaaacataagctttaacagcatttcacaactgcatccctggatgtcaaatctctcttagaggtacttattttggagatggtgtcttgctacataacccaggctggtctcaaaatcctggcctgaactagttctccaaccttaacgtaccatgtagctgtcattacaggtgtaagccataatcctggttctctcataaaggcatttttgtcaggggtggctgactttttatgccataagggaatatgaaaatagggcacttttaatcttttcatcttactgatgtcactgtccttttacatttttactttttattttctatttcaaatttgtctataattttggattcagtcatttagcacatatgctagaatttgcatggtatacctgaagtaaatgagatattagtaggcaccccatatttactaaaatagttacttataaatttatgtttgctccgggcaaaaaggaattataggattttcgtctactattttcagcctatatctaaataataacatagttcatttcctaatatttgttttacatatcagaggatctaaccctattctacaaaatatatatatatttttctatatttaacaatggaaggttattatttgcttttaaagttggaatacagcagtttcattttgtgtaagaatagcatatatttaaaacaaaaagcaactctagtttcttttaaatgctaatttattaaaagtttgtcattggagtcttctatttataattatactgcatattttctgaaattttagtgccacacagtgcatgccaatgattcaaaatacaggtatatgatgattacatagtagcagttgaatatcacagttacctacacaatttttttttttttttttttttttttgagaaagagttacctctcttacccaggctggagtgcaatagtgtgatcttggctcactgcaaccttcatctcctgggttcaagcaattctcatgcctcagcctcccaagtagctgggattacagggatgtgccactatgcctggctaatttttgtatttttagtagattttgggtttcaccacattggctaggctgcttttaaactcctcacctcaggtaatctgcccccctctgcctcccaaagtgctgagattacaggcatgagccactgcacctgcctgacaatttttttttgatgatacatcaatgtggcataccagattttgtgagtaaatatttctcttattattgttttgaagttctgtgtatcaggggtcccgcccccaatatttcaatgtatgttctttctattttccataagtgtcagctggttgaaaaataaagagaaagagtacaaagagaggaattttacagctgggccaccaggggtgatatcacatatcggtaggaccacgatgcccacctgaaccttaaaaccagcaagtttttattaaggattttaaaaggggagggagtgtatgaacagggagtaggtcacgtgcttcaaggggcaaaaagcagaacaaagatcacatgcttctaaaacaggaccagagcaaaatcagaactcctgataagggtctatgttcagcagtgcacgtattgtcttaataaacatcttaacagaaaaaaagggttcgagagcagagaactggtctgaccaaaaatttaccagggtgtagtttcccaatcctagtaatcctgagggtactgcgggagaccagggcatatctcagtcattatctcaaccacataggacagacattcccagagtggccattcatagacctccccccaggaatgaattcctttcccagagtattaatatcagtattccttgctaggaaaagaatttagtgatatcttccctacttgcacacccatttataggctctctgcaagaagaaaaatatggctctttttgcccaaccccacaggcagtcagaccttatggttgtcttcccttgttccctaaaaatcgctgttattctgttttcaaggtgcactgattgcatattgttcaaacatacatgttttacaatcaatttgtacagttaacacaattatcatactggtcctgaggtgatgtacatcctcagctaatgaagataacaggattaagagattaaaataaagacaggcataagaaattatgaacatattatttgggaagtgatagatgtccatattaaaatgaaatcttcacaatttatgttcctctgctgcgactccagctggtccctctgtttggcatccctgacttcccacaatatctctccctttctttttatataaatgtaccaacatcgcatgcaatgttcaagagtcactagctgatctccaagccaaagtatagattgtcttaaatcattaatttgattagataatttttgatcaatgccttgttgagaattccacatttggttggaatttgcttgccaaagattaacaaaatgggccgtttgaatagattggtgtaatgccactccggcagtagtggccagtgcagtgactataaataggcccatgatcacagtgattaaagtgaaaacaaatctcttagattttttgagaattctttgtaacacttcattcattaaatgtactgagagggaagattcccagtgtctgggtaaagttaccgaatccagattccttctcgagctcgaagccacattacacttctcctggagtcaaaatgggagttaacacaagtgtataaatgacaattaatgcattggacagtttgtgtgtccaaattttgatatttcccactaacagcacgtaaggaggcttaacacaactttgtataggaatagtcaggctggaggtaaacaaagcagaacattgatactgagggagagtagaggtggtggcaacgcccaatgttgtctgccataaagaagcaatccgaggtgcccagggatgctgaggaagtagaggggcatacctgggtcaagaagaattatcataatgccaattggagtcccataaaggaggatcagcatcaaaaagaggaaaagggttcaaaggggatttatcatggggttcagagtcatggatgcaaggggcagtagtggggataacagacagaaaagtttacccttcccatactcacagtccagacatggcaatagccaatttccaaagttctgagtgttccaggctcagaatggggaatatcatatgaggcctcggaggggtaatgcccttatcttcccattttaagggaaagaatgagctgaacttcctatgtaaagtagaacgatgatcctcgtcctcccaataagaaataaaataagtagcctccaggcattcccttccaccagaggagcaattgttttttaaatagccctttggtgcccatcctattactaaaccatatgcgtcattttttagtactactacatgtgagttaacacagtcttcccaaattaaaattttagatgggccctcaaaatttttaggacatggttttcctacaggtttatattgaaagtttggggtatctcctattactccccctttcatttgtcttaaaggagaaagagagaggctggagatcaaatgtccctgttctcttgtagctaatctctccggaagataagcagcccagatttgagcttgtagatgaatacaaccatctacatgtgcatgtccaaggcacagaggagggtatttataacccatggtaacattaaattcagtgctttcttctcctggttgagtggggcaatggtcatctgtagctccatgtatccacacactatcattagtatagatttctgcaggagcattcatccaggtgagaggtcgaataagtggaagaaaaggcacataagcccaataagaataattttgtgtagcaggtaaatcattttgaggggaaactgatgagacagaaagtttaagaagaattattaaataaaacctattgtaagcaagatcctgtgctgaaggaggaagagaagaacagagggatgttattttcaggctaatagaaatggtgagatttttaggtttagaagtggcattaattagaggggtctccgttgccattagggaggattgaaccagacccattttgatttggcatgccagtttttgagaagtcggcagagatctcaccaggtatgaaggcggtctctgacttggatgtcttttccctgtggctttctttgtcactattcacacgaagtttgagtctctcagtgggcacccagacaggggattgatctcctggtgaaacacaagcataccctcttccccatgttataattgttccaggttcccaggtattggtttgggagtttttccgtaacactggcttgccttcatttagggagaattttttgcctgtataatggcattcagctgcagtcagagttgtctttaggaacatttagaaagtttaaagtaaacaatgctaaatgtaattgggagtggggagtggttaaattatgcttttgttgctcagactgtttggacaattgagtttttaaagtgcaattggcctgttccaccacagtctgtccctgaggattgtaagggattccggtagtatgggaaattccccttgttgcataaataaatcaaaagacttacatatccaggggtgttgtctgtttttatctgacatggaagccccataactacaaagcaagaatacttatgtcttttaacatgggcagtgccttcccctgtttggcaagtagcccagataaagcctgaaaagatgtctacagaaacatgcatatatgaaagtctgccaaaggagctaacatgagtcacatgcatttgccataagtcattaggagttaggcctctgggattaatgccagattcctgatttggaagtacaaaaacttggcactgagggcagcagtggataataagcttagcctctttccaggtgagagcaaatttatattttaatccagtagcattgacatgagtgagattatggaactctgagcttcttggtttgcaaaagagaccggtcaaccttttgattaccagcaggcatgggtcccagtaaagtggtatgagatctgatatgtgtagtatagaaagggtgtctacactggcgaaccacctgttgtaaacttgaaaataaaaaaagccaattcagaattatcaatatgtttgatagtagcgatttctatatttttagtggcatgtacaacataaacagaatcagagacaatatttaacagtttggggaaatcctgtaaggcaataattacagcaattaactctgccttttgagcagatgtgtgaggcgtagaaataagcttgtctgcaggacacagataaccagcatttccgttactggagccatcagtgaacactgtaacagcctcaggaatgggctgatctttggtctattgagggaccacccaataagtcatttttataaaatcaaacaatttttttgataatgattgacaataacacagataaaatcagtcaagtgaatttgccacagtatggaatgttgaaaagcagcctgaactttaagccgatttaaaggaaccacaatagatttggatcaaatccagaaattttaagtgatctacaccaagcttgtccaattagattggctatttggtccagataaacagacaaagtttttgacacagaatgaggaagaaaacaccactccactaaatcattatgttgaacaattagcccagtaggggagtgcaatgaagcaaaaaccagaagctgaaaaggctgagatggctgtaccctagacaacagggcagtttggattctttcttccatgaattaccgttccagtgaagcctcaggggtcaaagtcctgagactgtggagattggaatctccacacagtatagaaaacaagttagacagtgcatattttggaatgcctaaggtagatcttaaataattaatgttacccaaaagtttttggaaatcatttaaggttttcaaagaatctctcttaatctgaactttttgaggttgaatatattctttattgaccaccattcctaaatattgagcaggagtggtcttttgaattttatcttgagtgatgtgtaatccagcctcagtgacatggtggctcaaaaattgataacagtcaattaattctttatcagtgggggcagcaattaatatatcatcaatataatgaagaatataggcctggggaaattgagctcacactggtgaaagcacccatccaacataaagctggcagatggtagggctattcagcattccctgaggaagtactctccattgataatgagctacaggctcctgattattgatagatggtacagtaaaggcaaatttttcacaatccaatttatgtaaagcaataaaaatactttaagatcaataactatgagaggaaattcttaggtattaaagcaggggcaggcatgccaggttggatggctcccataggtttaattacagcattaatggaccttaaatcagttaccatccaccacttgcctgatttcttttttactagaaacacaggagaactccagggggaaagagaagattccacatttccaagttgtaactgttcagaaaccaattgagttgaagcctccagttttttttagagagtggccactgatcaatccaaacaggtgttttagattttcattgtaaaggaataggattaggaggcatggcagtggccgccattaaaaaggagaacctaaaccagcgctgtcttcttttacagtaacttgaagaggtttagcaattccttcatgttttggactgaaaccgagtctgggaacaaaccccatgttttccattatatgttgactgggagcactataagagttatgctgaatattaatttcagctcccccttgtgccaacaaatctctaccccaaagattaatggggattggcatgatataaggctgaattgcacccttttgaccatcagggccaatgcaaggcaagataaatgtgctctggtgaacttcatcagcttttccaacacctactagtcccatgttagtgggatgtttaagtcaagaggaaggccataaattagaggaaatattagaaatgtcagccccagtatctactaggccctcaaacttttttccttgaaggcgtatggtgcaggtgggccattgtttagaaattacgttaatcaaataagtggctttttcaccaccagagcccatcccagggccccgtgtcttatctcctttgtttaaacaatattaggtagtgaaagtaattgagcaattgactcactggccggaatggaaacaggaaccttggcagacaccataagtttaatctcatcagaggaatcagaattaatgagacaagtatgaactatgatacctttagcagaggtggataccctacatcctacataacaccaggcccaccgaaccttgagataaagggccagtgacccctctggggacaattaaaggcaaagaattaggtagtaaatttagaggaatggtaatacagagatcgacccccctgacccctactgtggaggtagacaagcactgtactgagatagaagaagaggatgggacccatctgggttggctgtaggtaaatttgtttgtgctgggggctacgttgggaccacttgaagtggaaatgcaacattggtctgagtctgaggtgtcccatttgatattggggtctgggactggccccacttcccatttccctggttctgtggcaagggatttgcatctatatcagacttagaggggcaagtacttgcccagtgtttatctttagacaacatgggcaaacagtagtaggagaatttgactgtgtttgttgagccagcttggctgcttttaagtttttaacaggctccaagaaaagaataagttgagacagtttgactgccatccttcatggcctgtgcccacagaatagctttgtgggtctctgatccaatgccttcccaagctttaatatatgcaggcaacacctcatgatcaggaaaattttgtctttggatggaacacatggcaattttacattcatggttcacattctcaaaagctaacatatgaaggagaataccttgagcatgctcatgagagacagatttttcaacagcatcttgtaatttagccaaaaaaatgagggtataattctgaccttgtttaacactagtaaatgaaacaggagcttggcctggggtgtgtaatttatcccaaactctcatacacaacttcgttacttgttccatggtgagagcatcaaagcctaattgaacgctagtgtcagagtaattatcagagcctgtgagctgagcctgagtaattagaatgccatcagcccaatttagttgagcctgcagacgggcctcctctgaccaccaggtacagaattgtaaatgctgagatgcagttagaacagcttttgccaaaaagtcccagtctaaaagaagcaaaatgacctcagtacaaagagtctgtaataccattttaacatatggagaactaggaccatactgaataaagagatccttgaattcttttaaaaaggtaagattgagcagtgcataccaaagcacttgtaccccttgagcatcaggaggttccagcatgaccggataagcctacatctctaatccacttgtttctttgttctggtgtaataagtgttgcattaaagtttcaagaacaggcacatgagacggagttggcatagaagtgacaggaaaagtatgtgcagataagagaaactgaggttgaggaggtcagactggtatgagagtgtgagaaaggggcattgggggagcacaagaggcagaagcatactggtgattattgtcccagtcctgtgcaactagagtggcaggagtgtccttgcatgaagaagcgtatagagaagcaggctgagtggatggcaaagtgactgattgagggaccaaaatgacaggagggtgaggagctgtggtggatgggggagggcctacagaattacaggtaaattatagtttggtcctggagccattaggggtctccggaggcaaagcctgcaaacgtttgaagagggaagagttagcatagatatggtcctggctgtccaagttggggccacgggagctacaagtaccggctcttcatgaaaagaaataagatcatcaggggagatgttaagccaaagtcactggagttagatattgaattctcaacattgtcaggtcagggaggagtaggcaaagggagaggctgagcagataatgaaggccgagtgggagaggaaagctgaggaagaggtagagggttgccagatttagaaaattgtggtaactgcaggggacacgggattggtatgtcattaggacaccaggtaccaagtcccaatcaccccaaacagtgatggcaacataatttcctgtcaggaccagttcccagaattttgcaccaacatgatcccatagttccacatctaacgttcccttttcaggaaaccaaggacagtattcttccactgccctgaatagggtgaccatattttccttgggcaccagaactccaccaagttttaacaggagtttaatatagcagagataagcaaaatgtttagactccatgtgacccatagttaccgcagacaatacacagacaactcaccaatcgtcagggagtcaaacaagcatttctgtggactggaccaatgaacattcctccacacctaccaaagggaatcaggttcccacatgcacttaggaaaaagaaaacaacattggcacaccagttattggggaaaaccacccccaatacttcaacatatgttctttctattttccataagtgtcggccggctgagaaataaagagaaagagtacaaagagaggaattttacagctgggacaccaggggtgacatcatatatcagtaggaccgtgatgcccacctgagccttaaaaccagcaagtttttattaaggattttaaaaggagagggggtgtatgaacagggagtaggtcgcatgcttcaaggggcaaaaagcagaacaaagatcacatgtttctaagggaacaggacaagggcaaaatcagaactcctgataagggtctatgttctgtagtgcatgtattttcttgataaacatcttaacagaaaacaggatttgagagcagagaaccggtctgaccaaaaatttaccagggtgtagtttcccaatcctagtaatcctgagggtactgtgggagatcagagcatatctcagtccttatctcaactgcataggacagacattcccaaagaggccatttatagacctccccccaggaatgaattcctttcccagagtattaatatcagtattccttgctaggaaaagaatttagtgatatcttccctacttgcacatccgtttataggctctctgcaagaagaaaaatatggctctttttgcccaaccccacaggcagtcagaccttatggttgtctttccttgttccctaaaaaccacgttattctgttctttttcaaggtgcactgattgcatattgttcaaacacacatgttttacaatcaatttgtactgttaacacaattatcatactggtcctggggtgatgtacagcctcagctaatgaagataacaggattaagagattaaaataaagctaggcataagaaattatggaggtattatttgggaagtgataaatgtccatattaaaatgaaatcttcacagtttatgttcctgtgctgcaactccagccggtccctccatttggggtccctgacttcccccaacgctatgttagtgagttttttcagggtaggttacttttttttttgttttgagataaagtctcgctctgtcacccaggctaaagtttactggcacaatctcaaatcactgcaacctctgccttccgagttcaacccattcttctgcctcagcctccaaagtagctgagaatacagatgcatgcaagcccagctaatttgtgcattattattgtagcaggacaagctgcagacaaaacccttcagacaccaagttagagaagaaagggctttattcggccaggagctttggcaagactcacgtctccaacaactgagctccccaagtgaggaattcctgtcccttttaagggcttgcaactctaatggggtccatgtgagagggctgtgatcaattgagcaagcaggggtatgtgactggaggctgcatgcactggtgattagaatggaacagaataggacagggatcttcacagtgcttttcttgtacaaataactgattaggtcagggttgtctgcttatggatttcatttctgctttttagtttttactgctttctttggaggcagaaattgggcataagacaatatgaggggtggtctcctccctattccccccctttgagaatctcagtagtgggagttctcactttcattctggctacccgtgtcttcttacaaggcagatcgatagtgattcaaatagtacacttgtgctgaaacattttggtgaactaaggtagcagtgaagctttttatcatttgaaaaagtacaggtagcaaacaagggagcagtaagcaggttcctattactattataactcttattataacagttttaaatgctcctagcactggaaaccattttctaaacttggcaccaggatcaaatccatgccacatttgcacaggcacatgtgccagttttgtcatatctctaactatgtcttcaattacttgcccttggtcatctatgtgtagacctcaattagtaaggttaaatttcccacagacccctccttcagctgctagtaagtagtcgagagccaatctatcttgataggtaggatttctcatctgagtttcttgccaggccagaatagtcaaggctctgccagttttattagtggttatttctaagacagcttgtaaccatatcatttggttgagcatgtaaatggggttgtagtatccccacgagccgtattgtgcccaagtagcaggcccataatattgtgtgattctctcagggagccattcatcatcttgccaattccctatggctatgcttctcttttcatgagaagcatagacagggaagccaggagttcacctgtctttatgggcaataggaagaaagattgtttaatagtgccaataacacaactacctgcccactggttgggtaatttggcataagctctatgcccacatatccagtataatccagtgggggctgtccagtcctggtgggactctgggtgggtctacacggtttgcaactttgggaatttactaaatggattcctttctgtgtgatttgaactgtaccaagtgactgtttttgtggtaccattatacaatttatgtcccagacaaataagttgtcctatgggatgagtgaattattttccttctctagctatgcaatattgtccaataattgaggcttttagggcccagaaattatcagggtgattcttttgagccaggaattcaacaggaactgggtctataggtactaatccttgggcttcccatggccaatgatctcccattacagttcctccacacacataacatgaagtgttattgagagactgggctatgtgctcagataattgcaaaaacaaatttcttgtttttctgggaatttttggtactggtacatttagttcatcataggaagtttgaaacactgtctcaggagagcgtttgtaaacttctcctcaaactaagatatttacttgaggatcccatccagacccgtcaattcctaaggtcacacactcctcttttttccagtgaggatcaaggggatttgttattactagctctgtggggttacattttcccttaatacaggaaaggctattttttccttcctgaaagtggactggatccttttcattttttatccaagttgcccaagtgacacaagaccaatatccacattcattgccacacaatcctaattcatgacaaatgtactttttttcagtcatatagcctttttcccaactaaaagagcgaccttgccttcctaacttattgctattaatgacagcactggcatcaaatctcaagattatgcgtttgggcacccctttttattctgttgtggtcaatactttacttgtatcatttatgagtccccaccagacttcagtccttaatctttgttaaaaaactgtggacatgggaggctcagaacggtcataacacacatctggccagtcttttcctgggctacataccttgtactgagtgccattatataagcatgttccttttaaagtccctagacattcatagtaactatagaacagaaagattgttttaacttgttgccctacctcggtaacctgatgtatacactgagagcagtcctccatgtggggaaaatcagtggaagtttttactatacaagcccaaattataaggaagatgagtcccacgatgatcctcctcatgctttggccgtgcatagaccagtcagcttctgggtgtgactggagcagggcttgtcgtcctcctcagagtcactttgtagggggtgtccgggctcggttttgcctcccaggtttcagcggctgcaggtttcacacagctgtggtggatccaggctgggattccttctacctttacagctgtgggggtggtcaggatgacggtctgaggtcctttccaccgtggcctcaaaggggctatgttgcagtctttgatccaaatgcaatcacctggagagaaaaggtgaactggggagaataagctgatgggacatctctcatttacccaagttgagattgtttgtgtaatttttcctaaagcctgtagctgtcactgtaattcaatttcacctaactctcagggaatgcctggaagcccccatagtataggaggaggtctatgatacagtatttcataaggggagtatcctgttttcttagaaggagtgcatctaattttaaacaataccataggaagggcctgtatccactttaatcctgcttcctgacatactttccctaaactatttttaatagtccgaatcattggctcgacctttccggaactctgaggtcggtaggtggcatgtagcttccaagtgattcctaatgcctttgctgtcttctgtaccaagtcagccacaaacactggcccattatctgagccgattcataagggcagtccaaacctaggaataagatctcagagaagcacacaggttaccttgggggccttttcagttctttttggataagcctccacccacccagagtaagtacacacaggaaccagcaaatacttgttacctgcacatttctgtgaaatccacctgaggatcctgaaaaggagctgctacataagcttgtatgccaggcagaacagtgagacattgcctcatattgtgctgtcggcaagtaacgcactgtttggtactgctttggcaagggctgggaagcgtgagatgtagaagtaccagcctaacaatttttcaaatgactcttgacctagatgagtggtttcatgcatggccaatacaattgtggctcccagcaactgcagcacagctactctcccatctggcagtctgatccatcctccttttattacttgcccccttctgtgtggaagaagtctttttctttcttaggtaggtaccaggtcaggtatttgagggagtaagggggctgctactgatgcctagtatggggtagatgctgcttttcgagcttctgagtcagctcgggagtttcctaaggccactgaggtggagcctcactggtattccctgcagtgcatgactgccaccttctgaggtttccacactgcctccaataattgtagaatttcttgttgatattttatgtcctttcccccagagtttaacaggcccttttccttatataatgctccatgcacttggagggttagaaaggcatgtctagagtcaatgtagatatttacagtcttaccttcactgagttctagagctcgagttaaagcagtgagctcagccttctgggctgaagtgccctgtggcaatggtttggtttcaatgacagcatccaaagttaccaccgcatattctgcacatctttctccttgtgggttgatgaagctactcccgtccaaatataactccaagtctactgatgcccatggctggtccctaaggtcaggtctgctagaataaactgagtccaacacctctacacagttatgctcgactgggctctctgatactgggagcagggtggtgggatttagggtgttacagacttcaatgtttatgtggggattttcacatagcaagctttggtacttggttaatctagcatttgttagccaatggtgtcctttggtgttcatcaaagttaccacagcatgggggcttttatattcagatttggcccaagggttagtttatctgcttcttgtgctaacagggctgttgctgccagggcccttacacatggtggccagcctttggagaccccatctagttgttttgagagataggccactggccttggccaggaccccacagtctgggttaaaactccaactgccattgtttctctttctgacacatagagtgcaaaaggctttgtcaaatctggtagtcccagggctgggaccaatgtaagtttttcctttaacttacaaaaggcttgctgttgtagaggcccccattcaaaaggctcccagttgcccccctttgtaatgccgtacaaaggtttggctagcactgcaaagtttggaatccataatgtgcaaaaccccacagctcccaggaattcccttacttgccttctggttttaggttccggtaggctgcagatgacctgctttctttctgaccacaggctgtgctcccctttccaaatagtgaatcccaggtagcgtacctgctgtctgcagatctgagatttcttcttgggcaccttatacccacagtcctccaggtgctgaaacagggcatcaacccttttgagcacccaactgccatggagtgtcccagcagaaggtcatccacgtacaggagcaagacatagcttaggtctttagcaggaaacttttgcaagtctcaagtcagagcctccccgaagatagtaagggagttcttgaacccttggggaagccagttccaagtgtactgagtagtgacacctgactgtagatcttcccaccgaaacgcaaacagcttctggctctcaggagctattctgatgctacagatggcatcttttaagtccagatgggtaaaccagatgtcctcagccggcagcagccctaacaacgtgtaagggttaggaactgttgggtgcagagtcactgtagcttggttgaccaagcgcaagtcctgtactggttggtagtccttggtccctggcttagggactggcaggaggggggtgttccatggacactggcaaagaactataattccataggctttgaagcacctgagatgaacccggattccttcgagagcttccctgggaagggatactgctttcatctaatcagttgggcccaggcttaacttctatgagtatgggggcttggttggccgccagtcctggaggattatcctctgtccattctcaagaccaacgctcagctagagctggttgtatctcttcccattcttcttcccaggggactgtaaggacaatgataactcctgttcccagtaactttagctgtaaagagccgtgttttgtaaaggagatggtggctgtcagcttgctaagcaagtctcttcccagcaagggcaaggaacagccaggcatgtacaagaactggtgaactacttcatgtcttgccaccgagtaggtccgtggcagacagtaagtctacttagtagaaactcctgttgctcggattatatcaatggttttcttggacaagggggtgaccggggtggtcaataccaaatgttcaacacctgtatcaaccaaaaacttaatatctttgcccccaattgtaatcctgaccgtgggctccttgggggtgattgagcccagtccccttcagtccaatagcccttcagccagattgaataaagctccctcatctttatctgaggtcttttgttctgaatcatgttgcttttccttcagttggggacacttatttttccaatgtcccattttcttacaataggcgcattggttacattgcaagcgtgggtgattagacagggtattattcccagaacccccctttccctctccttttgggggaattcccctgatggccacagccagtaagttggcgtttcgcctggcctggctttcaccttccttacggctttctctgtggcttgttgcatctctattcaaacacttgattggctatttccagtaactgtgagatattcatacacttaagcccagcctgtttctgcagttttctcctgatatcttccacgctttgactaactaaggccatgttgatcatgtgctgattttcagggctatctggatcaaaatgagtgtacatactgtaagcctcacaccgtctttcatagaattgcgctggactctcctctttttcttggatgacctcagagatcttatttacacttgtagccttttaagcccctttctttagaccttctattcatgcatcatggtactgtcttagcctctccatgtctggtcactagttcaggtcccattgggggtctgttcctggcagctgaattcttatatattcttggggattttggtaatccactgggatgtgctcctctggccacttagttgccacccggagcacccttagcctttcatcaaagaggtacatgaacagctggtggcaatcagcccaagtaggattatgagtgtgtataatagtttggagcaagtcaattaaagcttgaggcttttcagtgtaagcagcagtattatttttccaattgatgaggtcagcagaggtgaaaggttgatacacaaagtcacgcctttccaccatgtgtccatcctcatctaccccagtatatcactgctgtctcaggggcatttggattccagtcttgggccgtaagtgagctgccaagggaggagtttctcccgtggcttcacttcctcttttgtctactctgggtggtctaggagtgtggctatctggtggaggtgtgggtgctgtgggctcaggagtgggaagcccttcctcttgcaattctgaccatgattcttctggtattgggtcagacagggcttttggtgccggcttccctcagcaggtggagtgagaaccttccttaactaactgtccctttgctactagtactgctgctgcctgtcctcttaactactgtggggggtccaaaactagctctaaccgagaatctttatacaggaactgatcggggtgccctggcttgtaggttacactgtgccataccttcaatacaagggacctgttcaggcttccttctgatggccaacccacctttaatgctggccagtctaactcacacaaagttctaagttttcttggtgtcatagtaactccatagtctcccttaaatccctttttgaaatttttcaacatagctcctagtggggtgggcctactttgtgcctgacccatgtttcctcgagacaaaacactgcgcttacaccacatgcacaccacaaaacaaaaacaggtaaaaagggcacacacacactttttcagtttacaccaaaccagaatcagaaccaaaatcagagtatcaagaaatccaagccaggtcaaaaccaaaacctaagtatcaagcaattcaactcaactcaaaaacaaaaaacctaagtgctggtatgggcacgtcatgggtgatcaggccacgcttccactcaaatggagtaggcaagttccaaagactagtcttaccaagtttcagatgtctggattccaagtgccagttccttcctgatgttcagccactgcagtgatcctccatgggggcctgccacacactgctctggtgaggcattccactggcgcagttgcctacccgggagcactctcaggatccgcgttgctcaagctggccagagtcccctgcagggatgcttcacagggcaggcctaagctgcctaagtggctgtctcaatggtcctttaatcacctgcttcccagtcagggaaccaagaaatgtagcaggacaagctgcagacaaaacccctcagacaccaagttaaagaaggaagggctttattaggccgggagctttggcaagactcacatctccaacaaccaagctccccaagtgagcaattcctgtcccttttaaggggtcacaactctaagggggtctgcatgagagggtcatgatcaattgaacaagcagggggtacatgactgggggctgcatgcactggtaattagaacagaacagaacaagacagggatcttcacagtgcttttcttatacaaataaccaattaggtcaggggtcgatctttaactaccaggcccaggttttggtgccaggctgtctgcttgtggatttcatttctgccttttagtttttacttcttctttctttggaagcagaaattgggcataagataatatgaggggtggtctcctcccttattattagagaccacatttcaccatattggccaggctggtcttgaactcctgtcctcggtgatctgcctgccttggcctcctaaagtgctgggagcacagtcttaagccaccgagcccagcctcagtgtaggtttcttaacatcagtttattgtgtttattgggtttacttacgtattataaatttagacaattttcaattctgcttgtactctttaagtcaacttgagtttcaactgaaaaataaataatgcatgtgtatcccaatcagattacatgtgtatgcattgtcacacatgtccatgtgaagagaccaccatacaggctttgtgtgagcaataaagctttttaatcacctgggtgcaggctggctgagtccgaaaagagagtcagcaaagggagataggggtggggccattttgtaggatttgggtaggtaatggaaaattacagtcaaagggggttgttctctggtgggcaggggtgggggtcacaaggtgctcagtgggggagctgctgagccaggagaaggaatttcacaaggtaatctcattagttaaggcagaaacaggccattttcacttcttttgtgattcttcagttacttcaggccatctgggtgtatatgtgcaggtcacagggtatatgatcgcttagcttcagctcagaggcctgagattcttgtcttcttatattaataagaaaaataacataaaatagtgttgaagtgttggggcagtgaaaattttggtggggtggtatggagagataatgggggatgtttctcagggccgcttcaagcaggattaggggtggcgtgggaacctagagtgggagatattaagctgaaagaagattttgtagtaagggcaatattgtggggctattaaaaagagcatttgtcatatagaatgattggtgatggcctggatgcagttttgtatgaattgagaaactaaaccaaagacacaaggtctgaataagagaaggagcaaaacaggtattaaaggactaagaattgggaggacccaggacatccaattagagagggtccaagggggttcagagtaattacttgtttggttggtgagttttggggctctattcttgacagagtcctttttgttaagttggaggctgagcttgctgaggtatgttctgaaaagaccattaatccattctacctttcctgaagattgaggacagtaaggggtatgaggtttcaatgaataccaagagcctgagaaactgcttgggtgatttgactagtaaaggctagtccattattagactgtatagaggtgggaaggccaaactgaggaattatgtctgacagaagggaagaaataacaatggtggccttctcagaccctgtcgggaaggcctctacccatccagtgaaagtgtccacccataccaaggagtgttttcatttcctgactcggggcatgtgagtaaagtcactttgccagtcctgggcaggggtaaatccccgagcttgatgtgtagggaagggagtgggcttgaataatccctgaggagtagtagaatagtagatggaacactgagaagtgatttccttggggatagatttccatgatggaaaggaaatgagaggttctaagaggcagtctagtggcttgtaacctacatggaagaagttatgaaatgactacagaatggaatgggtctgtgaggctggaatgagatattttccttggtccaagaatcatttgccttgtgtgggaagagattgataggtgaaagtttcagtgggggagtaggtgggagtgaccagataagaaggagaaaaactgccatgagggatagaagttggaatgctagctgctttttagctaccttatcagcataagcattgtcctaagtgatgggatctgatgccttttgatggctggttttttagctaccttatcagcataagcattgtcttaagcgatggggtctgatgccttttggtggcctttgcagtgaatgactccatcttcctttggaagtaaagccgccttgacaagagtttttattaaagaggcattaataatggaggacacttgtatagtgagaaaacatttttcagcctatataacagcatgggggtgcaggatatggaaagcatgtttagagtcagtataaatattgatgcatagtccctttgcaagattgagggcctgagttaaggcaacaagtttggcttgctgagaggtagcacagaggggcagagcggtagcctcaatgatagacatggaagatactatagcatagcctgcctttgctggtgagtggcaattaggcctggtggaactgccatcaataaaccaagtgtgatcagggttaggaacaggaaagaaggaaatatgaggaaatggagtgaatgtcaggtggatcagagcgatacagtcatgtgggccagttgtggtatcaggaataatgtgggggccagcctaaaacagtaaggtcaagttgtttggacagaaaggctacacagtgcagtcccagctcttgtgtaagaattttgaccacacagccctgtacttcggctgcatgtaatgaaaagggttgcgatgagttaaggagagctagtgtgggagtagcttctagggctgcttttaaggaatggaaagaggagtggtgaaaggatttaggatctgtggggtcagctaggtttgctttttgagtttatacaatggtttagtcaggatggtaaaactagatatccaaaggcagaagtacctaaccatgactaggagggaaaggagttgttgttttctagaaggggttggggtttgggagattagctggacacaatcggtagggagagcacatgtgttttcatgaagaattatgccgagataggtaatggatgagaaagaaatttgggcttgactgaggtaatgggagctgtctgtgaagccttgcagcagtacagcccaggtaatttgctgagcctaatgggtgtcagcatcagtccaagtgaaagagaagagaggctgggatgaagggtgcgaagaaatagtaaagaaagcatgtttgagattcagaacagactaatgggttatggaggggttgtggagggaggtattgaggataggaaagtatatggttttgacaccaatgggtggataggcaagacaattggttgataaggtacagatcctgaaataacctgtaagtcttgtctgggttttggacaggtaaaatgggggaattgtaaggagagtttataggctttaaaaggccatgctgtaacaggcaggtgataacgggctttaatcctttggggtaagggtgattaggttttaatgggatggtaagaggtgcatgaattgtcaccaaggagggagtagaggtgtcctatacttgtggattaaaatggggagatacaaggggaggatgtgaaggaggctttgaactggggaaaaggatggcaatgaggtgtggctgtagcctaggaatagtcagggaagcagataatttagttaaaatgtcttgacctaataagggagctgggcaggtggggataactaaaaaggagtgcgtaaaagaatgtggtccaagctggcatcagagttggggagttttaagaggtttagaagcctggctgtcaatatccacaacagttatggaggcaagagaaacacgcccttgaaaagaaggtaatgtggggtgggtagcctccgtattgattaagaagggtatggactcactttccactgtaagagttacctaaagcatctgtgatggtccaggaggcttctgaggtgattaggcagtgtcagtcttcagccgctaagccaagaatatctgggaaggagtcagtcagagagccttgggctagagttccaggggctctaggagtggctgccaggcgagctggacagtctgattcccagtggggtcccgcacagatgggacatggcttaggaggaatcctgggctgcaggcattccttggcccagtggccagatttctggcacttgaagcaagatcctgagggaggcggtcctgtaggaatgcctgaccactgtggcttaggcattttgaagttcttgtgtgctggaggtgtggctgggttttgtctcatagcagaggcaagtaatttttactcttctctattattgtacaccttgaaggcaaggttaattaagtcctattgtggggtttgagggcaagaatctaatttttggagcttttctaatgttgggagtgggttgggtaataaaatacatattgagaataagacggccttctgccctttctgggtctagggcggtaaaccatctaaagttgttgccaaatgggccatgaactgggttgagtttctatatttgatgaaaaagagcctaaatgctaactgatttgggaaaggtcagataaagaaaaaggagtgttaaccttggctatggcttcagctccagccacctttttaagaggaaattgttgggcaagtgggagagggctagtcatggaatgaaactgtaagccagaccgggtgtgaggaggggaggtgataaaaggattatagggtgggggaacggaggctgatgaagaactgggacctggcttggcctggcgaggagcagcttggggaggagaggacaggtgggtctgtagaaaaggaagattgaaaagactcagtgatgcttggggttgggactgaagggacaggtgggagggaaagaaggaggatttgtgatgagtcgcattgggaacagagattagggagggaccaatgtgtaaaagaatgcctggacatcaggcatctcacaccatttgtcttttttgacaaaaatcatccaggtcttgtaaaatggaggaatcaaaagtgccattttctggctatttagaaccattatagagtttgtattggggccaagtggtgttgcagaagaaaataagatgcttaggttttaggtcaggtgagagttgaagaggttttaagtttttaagaacacaggctaagggagaagatgcaggaatggaggtcagaatgttgcccatagtgaaggatgtaagtttaaggagaaaggtagagacatggagaagagggtggtgagcagccctgggctgcaatatgggtgagcatccaaagcaggtgtccccgcaattaacttgccaccaagggaatgtgggtgaatgaccaaggcagatgtccccacggtgatcagacgccaatgaaatgtgggtgaataatcaggcaggcatccccacagtgattaaacaccaagggaaaactgtcttcctgagtctaagactggcaccggagttttgggtccacggataaaatgtgtctcctttgtctgtactagagaggaaaaagaactggagttggaaggacagggagattgaagggtagcaagagaggctggagaagagagtgaaaagaccgcttacccgatttgaaattggtgagatgttccttggactggttggtctgaggacccgaggtcataggtagatttcctcacggagtgagggcggggacaggcctcccgaaggattacctctgtcctgggtttttggcaccaaatgtcatgcgtgtccatgtgaagagcccaccaaacaggcttcgtgtgaacaataaagctttttaattacctgggtgcaggcaggctgagtccaaaaagagagcgaagggaaataggggtggggccattttataagatttgggtaggtaatggaaaattaccgtcaaagggggttgttctctggtgggcaggggcgggggtcacaagatgctcagtgggggagcttctgagccagaaggaatttcacaaggtaatgtcatcagttaaggcaggaacaggccattttcacttcttttgtgattcttcagttacttcaggccatctggatgtatacatgcaagtcacagtggatatgatcgcttagcttgggctcagaggcctgacatgcgtgtttatctataaatacgatgccaattttacttatggcttatctcatattctttgttagctgattttcgatggtagttttatcttgtctaagtgagtagtcgtggagatagtcattatcacgatgtgtttaatgatgaatatatattttctttttgtgagagaaacacttttgtgatttgaagttaatttttaaaaagatttaccattctgtatttttgtcagtttttccttgaaaacgttgttttaaaaacacataacataaaatttaccatcttaaatttattgaagtgtatatttcacagccagctgtggttgtggctctcatctgtaatcccagaattttgggaggtcaagacaggaggatatctggagctgaaaagtttgagaccagcctggggaatacatggagacccctctccataaaaaaaaacttaatagtagccaggtatggtggtgtgcagctgtggtcccagctacatgggagattgaggaggagtcaaaattgtgcctctacactccagcttgggtgacagagtgagaccctgtctcaaaaaaaaaaaaaaaaaaatgctgttcacttcaggcatgttaagtatattcacattgttgtgcaaaagatttctagaaactttacatattgcaaaactaaaactcagtaaccattaagtaacaacatctcattttaccctctctccagcttttggcagacaaaacttccactttttgtttttatgattttgactacttaagatatctcatataagtggaatcatacggtatccataattttgttactggattaattcaactgacataatattctcaatgttcatcttaaaatgtgacaagattgttctttttaaggtggaataatattccatcgcatgtatatgttacattttttgatacgtttataaatcaaggaacatctaggttgcttcagacttttggcttttgtgaatactggtataataaagatgaattttcaaatatgcctcccaggtccagtgttgcattttttttttttttttttttcccgcagacggagtattgctttgtcgcctaggctggagtgcagtggtgtgatcttggttaactgcaacttctgcctcctgggttcaatcgattctcctgcttcagcctttcgagtagctgggattatagatacccaccaccacacccagctaattttttgtacttttagtagagatggggccaggctggtctcaaactcctgacctcaggtgatctgccccctcagcctcctaaattactaggattataggcttgagccactgtgcctggccttcgttacatattttggatatagatttataaatgaggaacatttataatttttaaaataatggctgcatctttgttttccaccaacattcaatatggatttcatttttattgtatcatcaacagatttggtgttttaaaaaaatttatcatggccatattaatgggtatgaggtgattttgtttgtcattgtggtttttttttcatttctttacaaattagtaattttatgtgtcctttcaaatgctttttctcatttgtgtacttttctaatgaaaatgttgtttgtccgtttctaaatcaagttattcaaccttattttttagttttaagagttgtttatatattttgaatattaacttctttcatgtttaatttgcaaatgttttcacctattttctaagggatgtcattactcttgaattgttttttggtatgaagaaattttgaagcctattgtagttaaaacttttctgttatttcatttgctgctcatgtatttaattttgtatctaagaaaatggtgccaaggccaatgtcatgtctttttcctgtagtttttctaaaagatttgttagtttttttatgtctcagcattttatttaaaatatatttttgtatcattctaggaaataatccaacttaattttatcagtgctgatattcagttttcaacatcatttttttgaagagattatttctattttgtgctcatggcaacttcgtggaagatcatttgatcatatacagaaggattcatttctgagctctctattctgttctttcatctgttcatctttgtttctgtatcacattgtttatattctttagcttttaactgtaggttgtattgacatctttgaaaaataacattttttgacccctgagcaagaatatgttgatgaagagtgtgtttcatattcacaaggttttgaatttgccagtttgacttttgcttttaattcctagtttcattcagcttttgttggaaaacacacagtgtataattttagtgtttttaaagtgatttgttgttgttgttttgagacaagatcttactgtcaccaggctgcaatgctgtggcataactttggctcactgtagcctcagtctcctgggcttgaatgatgctttcacctcacttttctgagtggctaggactacagtcatgcactaccatgtctggctaattgtttgcttctttgtagtgttaggatctcactatgttgcccaggctggtctcatacttctggcaccaatggatcctcttaccttggtctctcaaagtgttaggattataggcaagagccactgcacccagtcagtattttaaaatttaataaaacttgctatgtgtcctaacggaatacaccagatgcaaatagaaatattgcatattatcttggttttgactggagagttttgtgtgtgtctgtgaagcctagttggtctataatatggtttggatgtccatgttctccaaacctcatgctgcaaaataaatcctcaatgttggttgtgagacctggtgggacatgtttttgtatgagggcatatttctcatgaatggcttggtacatcctcttggtaaacaaaaagtttacactccattaattcaaatgagagctggttcattaaaagaacctggcttcttcacctcacacttgctctgtctcttaccatataatatgtccagttactttttaccttctaccatgattttaagcttcttgatatcctcaccagaagcagatgctgacacacacttcttatacagtctgccaaactgtgagccaaataaacattttcctttataaattatgcactcccatgtgttcctctatatgcaaaataactaatatagtctataatgttgtctcagttttctgtttcttattttttatctgaattctctatttatttcttcaaatggggccttgatgtctgcaattattatgtcgctatgtatgtcttgcttcacttttgtcaatatttgctttatatattttaaagcccttatgttatttacacatatacatatagatagataaatactataaattcctgctaaatcaactcactttaccataatataatatcaatcattgtctcatggtagtacttaaagcatattctgcccaatataattatgaccacctcactcacttgtggttactatattcatggaatatacatttttttattctgttactttcagcctatttgactcaatgattaaattagtctcttgtaggcagcatactgtatgctttataaaaaaccactcaggcattctatatctttttctttatataattttatatatatatatatacacacacacacatatatatatatacacaagtgtatgtatatatatatatgtgtgtgtgtatgtatatttttttccagatggagtttcactcttgttgcttagactggagtgcaatggtgtgaccccagttcactgcaacctctgcctctcaggttcaagcaattttcctgcctcagcctcccaagtaggtgggagtacaggcgcctgcaaccacacccaggtaattttttctattttaagtagaaatggggtttgaccatgatggccaggctggtcttgaattcctgatctcaggtggtctacctgcctcggcatcacaaagtgctggtattacaggcatgagccaccacatccagccttgtgtattttggagatagtgtctcactctgtcaaccaggctgatttgctcggttcactgctgcctgaatctcccaaactcagatgatcctctcatatcagcctctcaagtagctgcattacaagtatgtaacatcacacccagccaacttttttttttgtattctttgtcgagacagattattgccatgttgccgattctggtcttgaactcctgggatcaagtgatcagcctatcttggccttccaaagtcctgagattatatttcattttattaagtagtttaatacgtttaaatttaaaatgattccttaaagaaatgaagttgttatttccagatatattgttattgtttcatgtgtttctagtagtatatttttctcatttccttttttactctctttaattttgtactggcatgctttgattattttttgttttattttagatactttctttaaacagaatctttgcaatcatcttgaaaactgtagattacatacatcttacagttaaagcaatatattttaatctcatgacaacttcaattgaatacaaaaactgtgcctctatattttccagtttgttgttgatttttttttattaaaatgtgcatcattcttttatttttatttatttattttttattgatcattcttgggtgtttctcgcagagggggatttggcagggtcataggacaacagcggagggaaggtcagcaaacaaacaagtgaacaaaggtctctggttttcctaggcagagtgtttgtgtccctgggtacttgagattggggagtggtgatgactctcaacgagcatgctgccttcaagcatctgtttaacaaagcacatcttgcaccgcccttaatccatttaaccctgagtggacacagcacatgtttcagagagcacagggttggggttaaggtcatagatcaacaggatcccaaggcagaagaacttttcttagtacagaacaaaatgaaatgtctcccatgtctactactttctacacagacacagcaaccatccgatttctcaatcttttccccaccttgcccccttttctattccacaaaaccgccgttgtcatcatggcccgttctcaatgagctgttgggtacctcctcccagacggggtggtggccgggcagaggggctcctcacttcccagtaggggcggctgggcagaggcgcccctcacctcctggacagggcagctggccaggcggggggctgagccccccacctccctcccggacggggcggctggccgggccgggggctgagccccccacctccctcccggatggggcggctggccgggcgggagggctgagcccccccacctccctcccagacggggcggctggccgggcggggggctgaccccccccacctccctcccggacggggcggctggccgggcagaggggctcctcacttcccagtaggggcggccgggcagaggcacccctcacctcccggatggggcagctgaccgggcggggggctgacccccccacctccctcccagacagggcggctggccgggcagggggctgacccccccacctccctcccggacggggcggctggccgggcggggggctgacccccccacctccctcccggacgtggcggctggccgggcggggggctgacccccccacctccctcccggacggggcggctggccgggcagaggggctcctcacttcccagtaggggcagccgggcagaggcgcccctcacctcctggacggggcggctggccgggcggggggctgagccccccacctccctcccggatggggcagctggccgggcggggggctgaccccccacctccctcccggacggggcagctggccgggcggggggctgaccccccacctccctcccggacggggcgactggcctgacgggggctgaccccccacctccctcctgggcggggtggctgccgggcggagacgctcctcacttcccagatggggtggcagccgggtggaggggctcctcacttctcagatggggcggttgccaggcggagggtctcctcacttctcagatggggcggccgggcagagacgctcctcacctcccagacggggtcgtggccgggccgaggtgctcctcacatcccagacggggcggcggggcagaggcgctccccacatctcagacgatgggcagccgggcagagatgctcctcacttcctagatgggatggcggccgggcagagaccctcctcactttccagactgggcagccaggcagaggggctcctcacatcccagatgatgggcggccaggcagagatgctcctcacttcccagacggggtggcggccgggcagaggctgcaatctctgcactttggggggccaaggcaggcggctgggaggtggaggttgtagcgagccgagatcacaccactgcactccagcctgggcaccattgagcactgagttaacgagactccgtctgcaatcctggcacctcaggatgctgaggctggcggatcactcgcggttaggagctggagactagcccggccaacacagcaaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagcacagtccagctttggcttggcatgagagggagaccgtggaaaggggaggagagaggggagaggggagacgggagaggggagaggggaggggagaggggaggggagccggagtcactcttgttcgaacgcctccaacactatgactaagtaaaggagaatttctgttgttgattttaaaattattctatatggtgtatctattaacatttatgcggatttccatatttttatattctataaaagtactttaaaggttttgtgtaccatcattttgttagtttgttttgttttgttttgaatcgagtcttgccctattgcttaggacggagtgtatagatgtgatcttagctcactgaaacctcggcctcccaggttcaacaattatcctgcctctgcctccctagtagctgggattacagatgcctgccaccaagcctggctaatttcttgtattttttagtaaagataggctttcactatgttggacaggctggtcttgaactgctgacctcaggtgatccacctgcctcagcctctcaaagtgctgggcttacaggtgtgagccacagcacccagctggaaattactttttatctcactattcatagcatttcatatcaatacaaagattgacacatctagatataaatatacatagggagataaatactcacatagagaattctataaatatttctatctaaacatttatgtatacaaaacatgttccccaaaagacatttttaatcttttagcatgcactgaagatgctgatgtagaattacttcttttttcttttgctaaataacatgtcagaatggaacatagttatacaattttgtttatgtaaatatcaacaaagctctatcttcaaaggcaggccacagaaataagctgaaaagaaagtcatgtaacacatctgtccaggacagtatttcagcactctgcatgtctcctcattctgtgcatgttgtgttcacacctaccatttggggcctgtctcgacaaagccacagtcaccatttagataatttgataattgtatacacctgggctgagctacttggctggttgggatcacctgggctgtgcaaactggctgattgcaatcacctggtttctgctaatttgcttaatttatctcagcttcaggggtagaatacggagatgtcatctgacctactttatttctgaggttttttttaagggtcatatgcagaaataaacatttcatagacatacccatgtgactcattttgtgtgtatatgtttatcgagccacctattttgtatctatatgtacagaaagaagcctataaaataaacttgatctgaggctatttccattttctttacctacaggttaggtaaatcagtcagctactgagctcagtgaagatttattcaaaccaagccacacaccatattacattttttcataaatgtaaaaatatctttaataacctggaacctgggtgtttttaattctcatcccattaaaccagccccatgaggttctgttcgtctatctaggaactgccagaaatgcttgacatcagtgggctgagccttcctcacaaagcagatttgacctggcaaataagagccacctgtggcacttcagtgaatgttcactatcacccatttgaaatgtggccaagtaccatgtaccattatatttgcttccatcatcatcatcatctatcttctaaaaagagacctagacttctttttcattaccataaatacctgacttctgcctcaaagacaaaaagacaagagtgtgattttacatcacacactcttggaaataaatacagttcttgtcttgatgaaagttctaaagagaaagaataagtattctcatatttaggttaggacctttggactggggctggttcatctctgaccctacatacaacaataaaagaaaagtcaatcctgacatggcagtaaataactccaaaggccttagtaagtattcatcttccagaagcgcacaacaaagcccagtgcttcctttgaatatattaagtgcagcaggatgtatatcagagcattcctctatttctgtactattctagatatagtattctatagggaaaagatttttatacatgtatgaaaggtttttgtattactgtttgtagcaatagctatcaatacttccacattcaatgtctttattctgtatgaatatatataaagattgttccagcttcatatatatatacttatacatattaggtatgtatatgaatatacatacatggtagatacataaacacaaacatatgaatgtgtctttgtaaatattaatgtatacatataatattctcccactttttaaattatagagcgtatactaaggatgcaggtgtagaattaattgccttctgttttgctcagtagcatgtcagaataaaacatagccatacaatgttgtttatagaaacataaaggttcagcttcaggtttcaggccttgtaaagctgtgtggtatatactgtccaggtgagcaaataaggccctgcatttctttttggtgtgcatgggctatttacatttaccattttgggcatacctgaatgaatctgtagccactagttagataattagctgatcgggatcacctgggctgagctaattggctaattgaattcacctggactgatcagttggttgattggaatcacttgggctgagctaattcactgattgaaatcacctggactgagtgaatggtggttcaaaatcacctgtgctaaactaatgggctcatcagttgagctaactggctgattggtatcacctagaataagatagttggctgttagaaatcacctgggctaatcagccgggctgagctaatttgctgattggattctcctgggatgtgctaatgggctgcttggaatcccctaattggctgatttaaattatctaagctgagttaattgattcagaaaagttgaacactgagctgggccggtggctcatgtctgtaatcccagcaatttgggaggccgagtcaggcagatcatttgatgtcaggaatttgagaccagtctggccaatacagtgaaaccctatctctactaaaaatacataaattagccaggcttggttgtgggtgcctgtaataccaggtactggggaggctgaagcagcagaatcgctttaaccagggatgtggaggttgcagtgagccaagattgtgccattgcactccagcctgagcaagagtgaaactctgtctcaaaaaaagaaaaaatatctatctatctatctatctatctatctatctatctactgtcagaggatgataacttgaagtattttagagatgttaagaatctgaaattatttttacttttagtttttataaatgtttcttaagcatttttaatttccaaaaaacttgtaaataatgttgtcagtttaatttttctgaagaatttaaatagagtcaaattatacatatcaaaaaatctacttttctggtagtagatcagcttaattttcagaacaaatgtgttaaacttcacgagattttatgctgaccaatttgatcagtagcctctttcatacaactgggagagatgacaccaagatgtagcattcatgttgggtgagagactaaatgactaccagtagctagataatttctgttttactaataaatgtttattttcatttctatattgtctcaagttatgttaacaataaagtaataacctttatccaggaaattttgaaaacttattttttaatcagccataacagtaagcaaagacagagaaatgaaggtttttaccagtcataatttatatattaaaattaaaatacttctagaaataaagaaggaaaggaagaaagaaatatacaaacaaatgaaaagcagcctggtcaacatggtgaaagcctgcctctactaaaaatacaaaaattagcctggtgtggtggcatacacttgtaatctcagctactcaggaggcttaggcatgagaatcacttgaacctggtaggcagagtttgcagtgagctgagattgtaccactgcactccagcttgggtgacagaatgagactccatctcaaacaaaacaaaacaacaacaaaataaaagagaaggaaggaagttgattactcacaatagctaaggtttgaaatcaacctaagtgttcaccaataggtgaatggagaaagaaaatatggtatatatacacaatgaaatgctattcagcccttaaaaataagaaagtcttgctatttgcaacaacattcatgaacctgaaagatattatgttaagtaaaataagtcagcacagaaaaaaaacaaaatcctcgttttttttttttttgagatggaattttgcttttgtcacccaagctggagtgcagtggcaccatctccactcactgcaacctccagctcccaggttcaagagattctcctgcctcagcctcctcaggacctgggattacaggcatgtgccaccacacccagcaaatttttatatttttagtagagataggatttcccccatgttggccaggctagtctcaaactcctgacctcaactgatccacccacctcagcccctccaagtgttgggattacaggcgtcagtccctgtgcccagcccacataatcctatttctatgtaaagtgtaaaaaaaaaaaaaaaattaaactcatagaagcagatggtacaataataaaacaaacaaaaaatcccctataaggttttttgtctggttaagagagcttcttcaggatttttcaggggttatattttcttttattttccacattttcctgttcttcagccaatggatgaaaaaagatacagagaagacacatttaccttttatccgcttcacttccattcactattattcaatgtggatacagatgagagtagcagttttctagtaggacagccacttctctgcaataaacaaaaaactgaaaaaaaattagcatatgcatcagtaacccttctagtaaaataaagattaattttgttgatttctattgagttcctgtaatatttgatcaaaagctagcaaaagcacagtagaaaaggaaaattgttctaaataagaatattgtgaatggttattttgtcaatataagtaaaaatatgacctcacactaatagtctcacctatagttgtacaacatcaaatgctaatttttatttaaaattttatttcatataagtattcaatttatatcacctgcctctgctatttcaatgcctccttcactttatatcagtgaaaaacaggccagcaggtcctaggaaagcacgtcgtgctattgctactttaacaataaacaggtcaagcatggtggctcatgcctgtaatccagcactttgagaggccgaggtgggtagatcacagggtcaggagctcgagaccagcctggccaatatggtgaaacaccgtctctactaaaaatacaaaaattcccaggtgtggtggctcacgcctgtaatcccagcactttgggaggctgaggctggtggattgcttgaggtcatcagttcaagaccagcctgggcaacatggctaaacctcttctctactaaaaacacaaaaaattagctgtgcatggtggtgggtgcctgtaatcccagctacgcaggaggttgaggcaggagaatctcttgaacctgtgaggccaaggttgcagtgagccaggatcatgccactgtactagaccctaggcaacaaagtaagactcctctcaaaacaataaaatcagctgggcgtggtggcgggtgcctgtagtcccagctactagggaggctgaggcaggagaatcgcttaaacccgaaagccagaggttgcagtgatctgagatcataacactgcactccagcctgggtgacatagcgagactctgtctcaaaaaacaaaaaacaaaaactgatcatgaatagcacttttttggttgctacacacgtgtcaaacactgttatttggcttaaggtactggtttttttttttttctttttcttttttgagatggagttttgctcttgttgcccaggctggagtacaatggcacaatctcatctcactgcagcctctgcccacaaggttcacacaactcttctgcctcagcctccccagtagctgggattacaggcacctgcaaccacacctggctaatttcttgtatttttagtagagatggggtttcaccatgttggtcaggctggtctcgaactccagacctcaggtgatccacccgcctcggcctcccaaaatgctgacattacaggcgcgagccaccacattcagcctggttttctattttttttttttttttttttttttgagacagagtctcatctgtcgcccaggctggagtgcaatggcatgatctcggctcactgcagtctcttcctcctgggttcaagtgattcttctgcctcagcctcccaagtagctgggactacaggtgcatgccactatgcccggctaatttttgtatttttagtagagatggggtttcaccatgttggccaggctggtctcgaactcctgacctcttgatccacccacctcggcctcccaaagtgctgggattacaggcatgagccaccgcacccagccctattttttttctaaatttactggtaatataaaattcttcgctaagaagacatgatcttattcaaatgttttatgagatttcattgatgtctgaattatctggaatattaaaatttttcatgaactcaaatcaagtactatacataatcttttagtaaaagcttttctgaggcagagtaagatttataacattttattatcatatggaagaagtgtattaaccatgttttcagtaatcactctgaacacagcattctcagttcacagtgtaaaaagtgaagtagaggttcctcttcaaagacttttctacctaattatgaatagtaacttctcttagaagcaaagtttattcaaagacctgtgctaacattcttaaatatctgctaagcacaattaaaaaatcaatgtactttatgttcttagctcccacaatttagcctaaatatttgccctggcatgcttatactaatccaagcaagcattaggtcatagcctgttcctcctccttatttgaaggtatttttacctttctcagcattccacaagttacttcctccttcctttgttctcctctgcctttgtctcttttaaaaagttctaagttgctaaacaattgggacatacagaatgtgaggtcccattccagccaatgaaaaccagacacagcagtagggtggacacgtcaagttataaatgactctgtctcctctgttcagtgtactcgtggcaaaactgctttctgcaaaaagtaaaaatggccttgctaagaaaaattaaatttattttcaagtgctatttctttacagctccagagaacaaacatttctaaaaccattatggaccctgagtaattcagggggaattggtatctctgtaaagagacagtaaggaaatgctgagtggaggcaccacactgcacatcaatgctttccacatgcacccaatagagtcttaatttaattgggctgttatttgcatagctagataattaccaactttagtcatactattttttagcaactaatggcatctgttacccattaattttatacatttgcttttttgaaaaacaaatcttttgttaattcactctaaattgagactacatttacaatcttcagtttttcagtgttaaagcaaatcagagaagagcaatgtgtgtacataatgtgcattttcctgcctaccaaaattattctggctgggaaaagtggctcatgcctgtaatcccagcactctgggaggctgaggtggatggatcacctgaggtcaggagttcaagacaagcctggctaacatgatgaaatcccatctctactacaaaaattatccgggcataatggcgggtgcctgttatcccagctactcaggaggctgaggcggaagaatcacttgaaccagggaggtggaggttgcagtgagctgagcacgtaccattgcagtgcagcgtgagtgacagagtgagaatccttctaaaaaaaaaaaaaagaaattctttcttcaattacttggaaaccctgggaagcccctataaaatactccctttgaatactttagccaggatttcagatttcaaaaggtcaaaaacaatcattgagcaaagcttaaatcttgcctttgtttcttgttagtcatctggccatttctgtaagtacggcaattatgcgaagccattgaaaaaatgtggtcttggtaaattttattccatttcaaatgttttctctaatgttaccttggtcatgtgaatctaaaagaaactatctacataactaatcatggattcaaaaaatattcatattaatgtgtttacagtttaatcttgtattacagtatagtagaatcctctataattagaagttaattatttataaattcattgtttttaaggtttttcaaatatgaaaacagacaattaggtatactttttgaagtaagttcaattttaggacattacccactggtcttcatggcatttctgtaataaatagtgtaaacctgtgtcaccagaatggtgcagacatgctgattgaattagaatgagttcagccttgttggtagactattggtatcccagaggctgatcattcactacagcttactaaatactgttccataatgccagtgagcacttttacccaggttacctttttcctcccattaatgtggacctgttgtggtctcctgtttctcttaagctatcccagatgagaggtgattatttcttgaatgaatgagattcccttttttttccctctgccatagaatcctcttatgttccttactggaagcaacatggaggaggcagaaatgatggcaagatacaaacatttttcccgccatgtggccaccataagcagcttacaacatgttctacctagaagtcacttactttcaggccagcaggggtgtttttctgtgatgtgtctctttctcttaaaagcacctctgattaagtttagcacaatcaggataatctccattttgataaacacaaagtctacggatgagtaacctaatttcataagtgatttcccaccacagtcacacattttttttacactcaagaggaaagtatgacacagcacgtgtgcaacagactggtaatccagggtattatcttagaatgttgcctacccacctaaataaatgtttaaaatcatcttttgctgggcacggtggctcatgattctaataccagcaccgtgggaggctgaagcaggcagatcatgaggccaggagtttgggaccagcctggccaacatgatgaaaccctgtctctactaaaaatacaaaaattagtcagacgtggtggtgcatgcctgtaatcccagctacttaggaggctgaggcaggagaattgcttgaacccaggaggtggaggttgccatgagctgagatcacgccactgctctccagcctggaagacagagcaacactccatcatggaaaaaaaaaaagagtctttctgctgcttttgttatctacataaacaaagatatcaactggatataataattaactactttttagttttattcattacaaataactatttttctggcttaaattattttttatgcaccatttatacattcacacacacatagaacaataaaaatatatccaattattcaattttggttgaatgttcattcaaataagtgttaaaaatgatttttttttcctgttttaagagggcttttattattgtactcaagagagttgtttctggagacaaagttgcctgtgctttaataggcagactctggggagaatccgaatcacaggccagaacattttatattaataaattcaatacaaagcagaaagtatagatttgctttcaccattttaaaagtgtttagttttgttaatcacctaaataacataatttgttttgttgcagtaattgcttttattctgaaaatatgtacaaacctatactcacacaaaaacactcaattcataattttcttacacctcaggtttatcttcagagtaatatgtgtatatttaactctatgtaaattaaaactaaaagtctatgtgtttgcaggcagagaccacatgttcaaggaaaactatattacaagtatttataatttttcaggactcagaaatgtatggattttatttttattttattttttgagatggagactcactctgtcagccaggctggagtgcagtggcatgatctcagctcactgcaacctctgcctcctgggctcaaacgattctcctgcctcagcctcctggcatgtgccaccatgcctaatttttgtgtttttagtagagacaaggtttcaccacgttggccaggctggccttgaactcctaacctcaagcattccacctgtctcggcctcccaaagtgctggaattacagatgtgagccactgtgcctggccgtattttatttacatttttgtataattattatgatcatagaaataattctgtagtcaataacaatttaattgtacattttaaaatgaataaaagcatataattacactattggtaatacaaaagataaatgctagaggtgatggataccttatttaccataatgtaattactacatattgtaggcctgagtcaaaagatgccatataaggcataaatatatacacatattatatacccacgaatacaaataaaaaatttaaataataaagagtcaaaatttaatctatgggaacaatatttaactcatttgcagtttaaagccactgacagtgattactaaagatgttattttacaatgtatgaaatagtatattcctacaatattgtacctacacccttgagtaaagtgggatacagttagtggcacaataatggttcattaaacgcacggtagtcttaccatggtaaaaataaaataaaattaagttcacaaataatctaacaaacttttttttttttgagacagagttttgctcttgttgcccagactggagtgcaatcgcacaatcttgccccactgcaacctctgcctcccaggttcaagtgtttctcctgcctcagcctcctgagtagctgagattacaggcatgcaccaccatgcctggctaattttttttgtatttttagtagagactgggtttctccatgttggtcaggctggtctcgaactcctgacctcaggtgatctgcccaccttggcctcccaaagtgctgaaattacaggcatgagccatcaagcccggccctaacagttttaaaatgcactgcattttattacataaaagtacaagtagtaaagtaatatactcatttattttaatatacttttaattatttctttgtgtcactataataaagtattgctctgaacatttacgttatacattacttaatagaattttactacaaacagcttctccacttgtattttcattatgcgtcttacattttaatgttcttactattt

SEQ ID NO: 656 - DNA, 140434 bp, Homo sapiens
tcttatacatttcagatctgatgcaaaaagagaacttaaaatcatgcagatatttttgtgtccccaaaacaatggaaaagcagccagattgagcagactcatatgtcataaagaggactttggttctcactgtgaacttgaaagaagctcaacaaaagaattcttagagaatttaaaagcatgatacagaagatgtcccttggtgagaacaaaattaaaaaccaaccaaccaaacaaacaaacaaacaaaaaacagctgcccaggaactatttcctttagaacacagcttcccaggtcacattttaaggactggccttctcttggatgttgcgacctctcatctgtgtcatctgttgtattcattttcacttgcacctacctgggggtttggcaatcatctcatgtctcttcacggtcagaggtttttttccttgctccagacaggtgatcagttctggcttggagagaacaatacctgttttattaaaaataaatagcatgaatcttgcttatattgtttaattacaagctagtagtgtgctcagcagagaagatgaaataaaatattctagtaaattaatgccaaaatactaatttataacagaaatttctaaatattaagaaataatttcaacttgtaggtttcttttgttttgctcttgttgcccaagctagagtacaatcactcaatctcggctcaccgaaacttcagcctcccaggttcaagcaattctgctgcctcagcctctggagtagctgggattacaggcctgagccaccatgcctggttaattttgtattttcagtagagatggagtttcttcacgttggtcaggctggtctggaactccggacctctggtgatctgcctgcctcagcctcccaaagtgctggcacccggccaccacactgggccctgcttataggttttttaaattttactacttggtactactgaatcaaaaatggcttgtgtcaatgagattttcaggtggggcaacaatattttatgccactaaatttctggaattaccactaatttagagtgaagaatagagctcaactcaggaatgcagaagtttggattaaggtgaaacatcttgcagaaattcttttctacatgaacaaattctgaagattttctggaaaaaggccatctgaaactcttatgcaaagaataaattatttaaaaacattccactaaaaaagaaataaaacttttagggttttttgtgaattatgtatttaagttgtcctcaccaaggaagaccaggtgtctgtagttctctaacatcacatccctatataaattccgctgtgcagtgtccaggcaatgccactcctccagagagaattctatggccacatctgtaaattgcaatggcccctgaaacacacacacacacacacacacacacacacacatttttaccaagtcgccatgggtggaatttttgacttaagatgaaatgagcgagtaaagagaactgattctgacttataggactaaaattatccagtaaaacaattttcaacacagaaatattccctattatattctctgactctgagaagagcagcataagatctacaacattatttcatgtatgatatttttctaaataataaagtataaaattaacagcatgaacatgaacatgtacatttttgagtgctatatttacatcacatggaattatgaatatttttcagatggaaaagacatgttgagttagaaggcacctctcaaaattttttttttttttttgagacggagtctcgctctgtcgcccaggctggagtgcagtggcatgaactcggttcactgcaagctccgcctcccgggttcaagccattctcctgcctcagcctccagagtagctgggactacaggcgcccgccatcatgcctggctaattttttctgtattttttagtagagacggggtttcaccgtgttagccagggtggtctcaatctcctgacctcatgatccacccgcctcggcctcccaaagtgctgggattacaggcgtgagccaccgcgcctggcctcaaattttaatatgtacaataagctgaagaccttatgcaggtttttttttttttccagaagatctggcataaagtctgattttttgaatttctaacaagctcaccaataatgtcaatgtttttgtcccaaaaaggatattttgtcaaacatgcagtaagtggaagagcatgtgtttttcccagttttcctggcctgtaaacaaagagccttcattttccaaagaaaagtatgtagaaaaaaaaaaagctgccagatttaatgtgatggtttatccacatcagctgcataaagataattaataatggggccgggcacagtagctcatccctgtaatcccagcactttgggaagccgaggcaggcagatcatgaggtgaggagatcaagacaatgctggccaacacggtgaaatcttgtctctactaaaaatacaaaaaattagccaggcatggtggggggcgcctgtaatcccagctactcgggaggctgaggcaggagaatggtgtgaacccaggaggcagagcttgcgttagctgagattgcaccactgcactccagcctgggtgacagagcgagactctgtctcaaaaataaaaaaaaaagataattaataatgaagagaaaaataattaactctacagtgaaaacaatctgtcagagagctatttcaccaagtgcattataaaccattaactgcacaaggacaaattttcatgatgcgctaatgcacacagaagaacacaacatcactgttgaaatattcctcccaaggaagtaaataaaatctgaatttaatcataaagaaacatgtttatgctaatttcaaagtacagaaaactcctatgttctgtaatgttcagtagtaattttaaggagacttcatttagcacccaagagatcaggtatctcctaataatttttttcagaactttctgagtaataaatgccattccatataaataagtattgtcttaatcctgttctgcataaattaatgaaacacacagatggagcctcaacattacacgttctccatctttactaaggacaaaagttttccccaatagaaatcttgagtagccgcatctttccatgttcaacagccacaaagggaacatttttaatattgcagatcataacttattgctgagaatcctgcatggcatataagaagctatgacacagagaatgcagagaaagctctgggatatagaagaaaaattattttttcagagacccttgactatcgtaacaattttaagtagttaaaccaaacccagggagaaaaaacacaagtagagaagtaaaggtttgtgagtgctacatgcatggcagtccaggaggcagagtgaacacagctcttcatctgagacatgtttacctgaagagaagcctttttttttttttcacctcctcctctggaattccttgtcagatgagattctctggccaaattacccctgcatcttgagactatgcctttaaatgtgtcagtaccacatgtttacctgctagcatgacatcaactggcagaaaaagacagaaaaagtccacccatttctgttttttacaacaaaaagattcaagaacaatgagatgctccatgaagataaaaatataagtttctcctttcatgtcctctggtgccctttctgccacagacaccagcaatttctgctacagtaatggaaatatgtgccacactgacctgcccctaccaaaaccaaacagaacaggtcctgtgcgcaccacttagtgcaaaggtggaacttcttaactctcatgaaagtattttgagaccctcatacctgattctggcctccccttagagtcacgtgaagcccttcattaaaacaacgtggatacttccacccagaacaataaacagaacctgtggggaaggcacaagagatttctgcaaattggccatgtgatcctaatgagaagcctgggctgataaccactaagctaagcattgcctctcaagctttaagaagcttataaatcacttggtaattttgactccactttatgtgattctgtaggtttgaaaagggtccataaatgggtgttttaaacaagtcccctgtcaatgctgatgttgcttctccttggctcattattagcattagagaaagcaggaatagcagagggtcccttacacttagaactcttgtcacaaccaaatacttctggtacaaataaggacaacacatctatgctaaagttttatattctttgctgggtctttaaagtttacagaggaaacagaaggcagcaatgtctggataagtctgcatttaaaaaacatgtacacatgtacaaatgcaatgtttattaagcaggtactttgtgctcaagagtatgatacagagcactatgctgggcataacatattatgtgatttaattcttgtaacattcttggagctagtactcagggtttaataatttccaggatttagataaagggcagagaatttttactgcctcttctgtttctctgttaccaaatttttttaaacattgtaaagaataaaagctaaatatatacagatgaaagagatatagaagagtttattgtagtttagagaaaattttattctgtttatgtttacttttctgtgacttgtggagcaactactggatctgcaggaatagaaaacaagttgctaaatagaatgtctctgccaacactggttttaacagaaaatttaaaaactaagactctacaatacatactttatttttcccatttatctgcttttgggtttcaggaaattggattcaccagccaaaactctgatatcttctaatcagttctgtgaggcaagactccagagtagggtcagacctaaataaggcctccaaaaagggtgaatctgaacatgtctgggacaaggtgaggatcctatagaattctgttctctatgccactgtggtactaacagttttctttttttctaatcttacctaaaagaaaaaccccagagtttctgtaattttaatattttctagcactgctctgtcaactttatactgtatactaatatgcaatttaaacaattctcttaaggttttctagggtaattttataagaaaatcagtgtgtacacttacgaaggtaaaagaacagaaattatacggctgggcacagtggcttacacctataataccaacactttgggaggctgaggtagatggatcatgaagtcaggagttcatgaccagcctgactaagatggtgaaacctcttctctactaaaaatacaaaaattagttggctgtggtgggaggcactgtaatcatagctatttgagaggctgaggcaggagaatcgcttagacccaggtgacagaggttgcagtgagccaagatcatgacacagcattccaggctgggtgacagactaagactccatctcaaaaaaagaaaaattaattataacaattctactgttcattaatatcccttcaggtggtaggtaccatgactgcttcatgtatttttttttaatgaccataagaaatggaagcaactagtttatctacttgggtctccagatctccttgtttatcatccaagtaccaggaaactggagaaactctcatccctgtacaaaccaaagacaactcttgtatgatgggttgaacaaacacagaatgactcatttttctttacactgagacagaagcagaattaaccactcttgtcagcctgacacaattctactctggacatcctcaaatgcctcaaagaaacctaggtgattgtgagggaattcccagtgacccagggctgatggcccaatgataagccaggctggagcgactcaggctgattctaaatagaaaataaaactgcgttggtggagccccagaacctgggtcacctgtcctgatatgctagcacttgggtaaaagacagaacaaaaatactctactccagtatcccattttacaggtaaacatagttgtggtcatggctctggatactttgtggcctgatctctcactcctaagatgattatttacacttacagattctgccatcagattctatttcctcctggagcctctcacatcactgtagcaggtcaatgaaaaagatgtaaaaaaactcaaaatgccacactctgaaatgggggctgtaagatgtctatcttgacaacttacaatgcagaaaataacttttgttaattttctgtacattccatatccaaagtctggcactttttaaatcccaggcagaggccggacctaatctgtagattctagataggatcaacctggctctgcatcctttggtgttacagcaaatggagtacaatcaaaggagagtaccctcatagaggctgctctagaacattctaagtgataagtctaaataaaaaaagctgacatatcaagaatataagtagacagtttatttggtttaagcttaaggattataaccagggagcaaagattcaagttgcctgaaatctacactttgattagcagcagttacaagatttgtaaagacaagagagggacatagagtggtctgatacaaagttgtttgtcagaagtttttatttatttagataaataatattgattattgattagatatatatcattattgtttagggtatagaatatagtatccaatgtggcattgttaatttactttatagctacttgtggcaatagtgaacagtttcaagggatgaatacatagttcaaaggggagagaaagatgttaactgctctttcattttaacatctctctgagtttgataaccaaaagtgcttgcactttttagataaaagttttttatttcccaaatctcaagatctggattcaaaatatggagctacagatttaggtcctgaatggcaggagtagcagcaggtgttacttgcacattagtgagcatttcagcaagagtagaaaggggatagtggagactttcttgtctacatgtctactcaattcacatgttactccagttcagtttgttggccccacggtctctgaatctgtttaaggtctgaaaatacaagagtcattgaaagagaaaaaattattgattgcttccctgtgaaatttgtagaaatctgatctagtctctctagcagtgactgtaaaggactctagataccaaataggcagggacacaattctgccttcatatttaggggacagcatgcactttgctgcacaagtgtgagttgactggaagcctgagaggaatagtcccctctagagtaagttccggttggcaccttatttgtgtttatatcatgtctggtaattctagacagtgtttggaaacaataattaaaagacagattttatccagctccagagaaactccacaataatagaacagaaagaaaatggttttattacacaattgaacttgaatgtgacatgcatcatggtcagtctgcttaagagactgcaaagatagaaagatggtcaccaatattagtccccaagcagaagaatttccagcaccatgtcatacatagttcatcctaaattcacctggagattgaagaggccatctgtgtatactaattgcttatattcaatgacaaataaacttttcacatcttcataacaggaggtagtttagcagcttgaagccaggtgcctgctgaaggtagcctcttactctgctacaaaaatggttgaatagggttcttttttgctatttacattttagagctgtggttctgtactccctgccactgggctacagcactcctgcttgctttctcctggttgctagtatgctctcttgacctctaccatgtgccactgaggcacagcccagagcacagctcacattttatgtgaatcccatttgccacagcagcactttagtgtcacatcagatagtgaagcctgagctgcaggaggagagcctgcaggcctcctgggtagaattacacattcacaataatggaaatgagagcagtgtttcaacctcagtttctacttataatggtgacaaggaaaaaatactgctgaattttcagcatgactcaagatagagatagctccaaaagttctcactatgacagcccacctcattcagaaaaaaatgggatattaatagggtttctgaaacagacacctaaagctttggagagacaaacagatctccgtctgagcaagattgagagaaaaaagctaaaactatcttaagaaaaagctcagattagatgtaagattgatgatgtcagccagaaaatattcccctgaaagcaatttctctctaaacacccaaagtgcacagctactctctgcatgagaaacattagcattatgaagaaaggggcaaagtctcagaagaattttatagtttcttttctatctctgctgatccatcatctcctagtcattgaataggggttctgtattgaaatacatctgacaacttcccacaacaccttctgatgaagaaatagaatctgactgtgttcatttattggaatatattagaacttgcaacatagctaactgaagagctactatggtttttggtggccacatcacctgtctttatttgtcatgtaatagcagcataccaatttagtgaaataaaagatattaaaattttgtttactcataattatccctattgaataaagtaataaacatgtcacactaatatctacttactgtgacaatttggtaataaattttctttagatattagatataaatatcagtatgaataattttaataaactagtaataatatatgtagttttaaaaattgcaactatacttcagttaaaacactttatatttcaaaagtataaattacaatattaaaataaccatgtaagtgattcattcaaagtaagtattgcggctttatattcatgttactgtagaaaatactgtttatggctcatgccttgtccacacttcgggaggctgaaatgggtgggtcacctgggtcaaaagttcaagatcaaactggagaacatggtgacacccatctctactataaatacaaaaacttagtcaggaatggtgatgcacacctgtaatcccagctactcaagaggctgaggcagaagaatcgcttgaacccgggaggcagcggttgcagtgagccgagatcatgccattgcaccccagcctcagcaacagagtgagactctgtctcaaaagaaaaaaaaaaagagaatactgttaaatgtatataaatgcaggttgtctacaaacattacgtataactatgctaattattctgaagtaataaatagaaagcaaggtacaactactgactccactgttaagtttatacactagactgttcttgtttttgcagtgcaagtacttcagcctgcaaatattggataatttccttagatcatcaggtttctgtcaaagaaacgtagtatcttttattgtttaccattctgtgttactaaatttaatcctatctttgtgctaagcttttttgtgctctaaaattagcttttacctaaacaaatctgtgtctattttaaaggactaaaaatgaaaaaaataaagttttcagaaccaaaaacaaaccaataaatctgaagtaccagataacgataatctggagtcagaaaaatgacaaaaggggatgggcatggtggctcacgcctgtaatcccagcactttgggaggcagaggtgggcggatcacaaggtcaggaggtcaagaccatcctggctaacatggtgaaaccccgtctttactaaaaatacaaattagccaggtgtggcagcatgcgcctgtagtcccagctacttgggacgctgaggcaagagaagggcatgaacctgggaggcagatgttgcagtgagccgagattgccccactgcattccagcctgggtgacagagcgagactctgtcttaaaaaaaaaaaagaaaatgaaaaagaaaaaatgacaaaagacattatttagctgttaatatgatttacatacatttcaaaaaagcagagaaaattgtctatatataatctaaatcccttaagcaaagagggaatagcaaaatatttttttggaacttattgaagagttttgaactcttggacatctgaaatttgcacactctatgcacttgacagaatgtttatgaaggaaaaaccagaaaagagaaagatgttataaaaaaatccatgagtgcacaagaccaatgcaacagaatagagagcccagaaataatgccaccctcctacaaccatcagatttttgatgaagctgacaagagaaatgtgggaaggattctctatttaataaacagtgctggaataactacctaacattatgtagacgactgaagctagacctcttcattataccgtatacaaaaatcaactcaagataaattaaagacttaagtgtaaaacttaaaattatggcggggcgcggtggctcatgcctgtaatcccagcactttgggaggccgaggcgggtggatcacgaggtcaggagatcgagaccatcctggctaaaatggtgaaaccccgtctgtactaaaaatacaaaaaattagccaggcatggtggcgggcgcctgtagtcccagctactcgggaggctgaggcagaatggtgtgaacccgggaggcggagcttgcagtgagccgagattacaccaccgcactccagcctgggcgacagagcgagactccgtctgaaaaaaaaaaaaaaaacagaaaccaaccaaacaaaaaaacccttaaaattatgagaaaccctccaagataacctaggaaataccattctagacatagaaactggcaaagacttcatgaggaagctaccaaaagcaactgcaacagaggcaaaaattgaaaaatgggacctatttttcaattgtgaagatcttaagagcttcttcacagcagaagagattatcaacagagtagacaacctacagaataaaggaaaatatttgcctctgacaaaggtcgactttccagaatttattaagagcttaaacaagtttacaagaaaaaaacaagcaacctcattaaaaagtagacaggacgggcacagtggctcacgcttgtaatcccagcactttgaggggacaaggagggtggatcacttgagaggagttcaagaccaacctggccaacatggtgaaaccccgtctctactaaaaatatcaaaaattagctgggcgtggcggcaggtgcctgtactcccaactactcaggaggctgaggcaggagaatggctcaaacccaggaggtggaggcagaggttgcagccagctgagatcacgtcattgcaatccagcctgggtgacaagagcaaaactgttgcaaaaaaaaaaaaaaaaaaaaaaaaagtaggcaaaggctgggtgcggaggctcacacctgtaatcccagcacttttaaaggctgaggtgtgctaatcacctgaggtcaggagtttaagatcagcctgataaacatggataaatcccgtctctactaaaaatacaaaattagctaggcatggttgtgtgcacctgtaatcccagctacttgggaggctgaggcaggagtattgcttgaacctgagagtcaaaagctgccgtgagccaagatcgcaccattacactccagcctgggcaataagatcaaaactctatctcaaaagacaaaacaaaatgaaacaaataaataaataaataaaactaatgtagaaacagaaaaccaaatgcatgttattatttaagtaagtgctaaataataagaacacatgaacacaaagaggagaacaagagacactgaggcctagttgagggtggagggtgggagaactaagaggatcagaaaacatacctgtttggtactatgggtaggacctcaatgacaaaataatctgcacaccaaacccccatgacataattttagctgtataaaaaacccacacatgtacaccgaatcacaaataaaacctaaaagaaaaaaatactccaaggtgggggagagtgcaatgtaggtgcatggactgcttttcactatagatagtagcccaggtggggctgtactctgatttatttctgtgtgaatgcaggtagatgaaattacaaacaggtggcccagaccctaggctggtggagaaaacaggttgctgctgcaaatttagtatctaggggtggggatatgccaggagacttgtagagatttttgggttcttggcaagaaacactaggatcaaaaatgccatggtgaagttcttgagggtggtgccgagtcctgggagaagtgtggatacctcaatttctagtgtgtgtgtttgtgagtgggtgggaatcctgtagtagcagctgcaagaaaaggggtctgtcataagagcttcttctgagttttcagtcctctgtcaccctgggagaagacctggaatcacaggacaatgggcaatgtgacagcctgtgtacaggagagcagagcctcccatttctaaacacccagagctttgttccagtccaggcctctgtgatatcttttttctggcaccaaatctgtagagtttgctgagcatcaaacaattctccaacaactaattgtctaacatttaaattctgacaccacccagagtcagcacagaccctgattcagggctcagttccacaacattgtcctcactgcagatgccagtcacaaaccccatgggcccatctacgcttctgagctactgtttgaaaactggggactcccaaaacctccctgaagttcaatgatttggtagagctactcacagaactcatcaaaacactgtagttatgtttaccggtttaatatataagatgcagcccaggaaaagccaaatggaagaaatgcatagaacaaagaaaagagatggggaaagatgaaacacatagataatcatgaaaaatgtttgtgattaataaaattctccagccgggcacggtggctcacacctgtaatctcagcactttgggaggccgaggagggtggatcacgagatcagagatcgagaccatcctggctaacagggtgaaaccccatccctactaaaaatacaaaaaattagccgggagtggtggcaggcgcctgtagtcccagctactcaggaggctgaggcaggagaatggcatgaacccgggaggcagagcttgcagtgactggagattgcaccactgcactccagcccgggtgagagatcgagactccgtctaaataaataaataaataaaaaataaattgtccatcctttgtgtactccaggaacagtttatggaaacacccttcaccttatgacttcaatggtgctcttttttcttacctatcacacaggcaaacacactctctgcacattttctcctatttctcattataaaaatcagctgattttttcttcagtggtcaattttttttttttttggtgtgatcgagtcttgctctgctgcccaggctggagtgcagtggcgccatctccattcagtgaaaccttcgcctcccaggttcaagaaattctcctgcctcagccttcccagtatctggcactacaggcgcccgccacaacgctcagctaatttttgtatttttagtagacacagggtttcaccatgttgggaaggctggtcttgaactcctgacctcaggtaatccgcctgccccggcctcccaaactgctgggattacaagcgtgagtcaccacccctggcctaaaataaagtaattcttaatgaaatttacttaagtttatctccctccgtcaggctcctgaactttgagctaccctcggtctgagtcgacatacaaccccatttacgtccctcctaagaacatgctgatttcagggtaagacattctgtgatctaaaatctgaccttttcaccctccatttgccattcccttcccacctcctttctaatcttgtttaatcctccttaggaaagaaagtccttttgtgcctacagttttgcaagccacaaagaccttatagtaagttgatactttctcctattgcaatacttttttggaattcattgttttacataaatctaacgttgttatcttacaaagtctaaaacttgcctcaaaacaaaaacttcattatcagtaagaccctcccagtttcctttcatcttaatcttaactgcatctgcctgtggggctccagctttccagggctctgtagcttctctcaggataaaggctctttccatagctggggtgagcaggctgggacatctgcagggaagtctccccagcaaaaaaagaactgggcctttaataacctcctgttggccgagtgcgctggctaaagcctgtaatcccagcaatttgcgatgccgaggcgggcgaaaaacctgaggttgggagttggagtccagcctgaaaaacatggagaaacctcctctctactaccacacaaaattagccgggtgtgatggcgcaggcctgtaatcccagttactcgagagcctgtggtaggagaatcccttgaacccgaggtagaggttgcggcgagccgagatcgagccattgcactgcaccctgggcaacaagagctaaactccatctcaaaatttaaaaaaaacaaaaaacaaaataaaaacacctcctttttgcagccttaatattagccttagcttggaattactaggttcaagcttcagtttccatgtcagtgttattcacctggtttttgaaactaagtgtttgaaaaatccagtgaaattactcaaacatagtgtttacataaacggagattttaagatactttttaaaattttattaaacaggagtctcgctctctcatgcaggctaatgtgcaatgacgcgatctcagcttactgcaacttccgcctcccggtttacataaaggaaggaaattttaagatccttacttttttttttttgcgatggagtctcgctctgtcgcgcatattggaatgcgacggcgcgatctcggctcacggcaacctccggctcccgggttcaagcaattctcgtgcctcagcctcccaaggagctgggattacaggcatttgccaccacgcctaattttcgtatttttagtagagacggtgtttcgccatgttagccaggctggtctagaactcctgaccacgtgattcgcccgccttgctctttgaaagtgttgggattacgggcgtgagccaccgcgcccgaccaggaagtggttttttaaccctaaggcagttttgtttttgtgttcttcccctattgcctggggtcagaccagatcatctaaactgatcccgactggcttagaccccaactttttccaaataggataaacggagatttgcagggaaagaagagggaagaaggcgtagtattgatttacaatttttacaatttatgacctggaagttgagtctttcaagaggaacttagttgtcctaacaaccctttacctcaagggatccgcccgcctcagcctcccaaaatgtgggattacaggcgtaagccaccgcgcctggccccataaatttttaatacgagaaaagagaaactgtgaaccccacggaccaaagctcttcccattcgggaacccgcaccccgagtcaagattctcccctaaagaccctctcgtggttcctgcacaatctgggagatacccggagctgtgggtgcagagctgcccagagagggctccaggccggggcacactcgctgccaagggaagagtcaggacgcccgggaccggcttatagagcacccgccatcttttttttttttttgagacggagtctcgctctgtctcccaggctggagtgcagtggcgcgatctcggctcactgcaagctccgcctcccgggatcacgcaattctgcctcagcctccctagtagctgggactacaggcgcccgccatcatgcctagctaatttttttgcatttttagtagagacggggtttcaccgtgttagccaggatggtctcgatctcctgacctcgtgatccgcccgcctcggcctcccaacgttctgggactacaggcatgagccaccgcgcccggcggagcagcttccatcttatggatggtggggactaacgccaagctgggcaaggagaactcagggcacagattgtggagctgactgcggggagccctgagtcccgccactgccacttcccatcaaccagtccctcccctctctggggatgttggaccggtactcttaccatttctagacttctagggggtcctggctcttggctgtggatctcccaatacctgcaggtcaaagggcctcagaggctgggcctctatgagcagagaacacagagcagtgaacaagagatctggagctccagcggcagcaagagacaaaggccgcgccataccagaaagccgtcctcttcgctccagctgcctgcctgattggagggtttccagaccagcctccctgattggattatgcttaaggctctgccccctcagtacctgagtgacagaagatgtaatcagattctgggctgagtgaaggagtaacagcctaagatgcagcctttccagacagggcttcctccctgagctgagccaggctcaccccagagaagggaacaattctgtatcttttttactctctctgtttttgaatgtattcaaaaggtgagcaggagtatttttctgtcatatgaataatacataatatttttgttcaagagaaaatcaacttttactttggtaatagtgtattatcaatactaaagctaattttaataaaaccttataaataaatcaaatttgccacttttaacctctcgagatttacacatatattttgtaatctcttgtaatttttttaactttttatattttatttttatctacattctattttttcaatttgaaacaacctttaagtaatttcaaattgttgtaggagatagaaagaaatcatttaaggccaggcacagtggctcatgcctgtaatcccagcactttgggaggccaaggtgggcagatcactttaggtcaggagttcaagaccagcctggccaacatggtgaaacctaatttctactaaaaatacaaaaaattagctgggcatgctggtgcacacctgtagttgtagctattccggaggctgaggcaggagaatcacttgaatccaggaggcggaggttgtgtaatggcccaaggggtacaccttgccctttggtttagacagagctgatttatcaagacgggccttttgcctagacagagcctattaattaagacaggagaatttgtggaggaaaagttaaatattaaatttgaactcaattgaatgtggacacagacaatggtcactaagtcccagaataggttgtgtgagccccttgaggcatttatccagtgctgtattggagaaatctgtaattcaatctattcccatacatttattattgaaaaacaataggcaatcacaaaaacaaattggcctttttgtgttccttgggcctagtcttgaaaggctgtcataactgggccttatgccaaacaacttgctacaaaaagagctagggtcccagtgtagcaggacaagccacagacaaaacctctcagacatcgagttgtagaaggaagggctttattcagctaggagcatcagcaagctgctgttttaaaatccaagctctctgaatgcacaatttctgtcctttttaaaggctcacaacactaaagatttcacatgaaagggtcgtgattgatttgagcaatcaagggttacatgacaggggctgcatgcaccggtggtcagagagaaacagaacagggcagggagtttcacaatgttcttctatacaatgtctggaatctacgaataaaatcagtttttaagttatgagttgattttttattattaggtttaggccaggcaggcccagggctgcctgtctttaacttcacttccttgtttttttcttaaaacaggtactgagtataaaacaataaaacaatatgagtgggtctctctcttccctcatttcctctctttgagactctcacttttttattagtgggagttctcactcttatttttgctacttatgtctttttgtgcaatagattgatagtgatttatacagtatgcttgtgctgaagtattttggtgaactaaggtagcgacgaagttttttatcatttggagaaatacaggtatcagacaagggagcagtaagcaggttcctgttactattattactcttattataagagttttaaatcttcctatttctggaattaatttctaaacatggctcttggattgagtctgtgccacacttgcacgggtacatgtgctagttttgttatatctttaactatatcttcaactacttgcccctgatcatctgtgtgtagacaacaattagtaaggttaaattttctacaaacttctccttcagctgctagcaagtagtcaagagctagtctattttgatagacagcatttctcatcagagtccctcatggggcaagaacagtcaaggcttgaccagttttattagtaataatttttaaaaacagcttgtaaccctatgatttggttgagcctgtagatgggggctcgatatccttatgagccatcttgtgcctaagtggcaggtctatagtattgtatgattttttcagggggccattcattatctttctaatcacctatggctatgcttcatttttcatgggaagcatagactgggaagcctagaaattcacctgtttttatggacagcaagaagaaatggacagcttaatggtgccaattacacagctacctgtctactgatcaggtagcttagcataagctctgtgtctatagatccagtataacctggtgggggctgtccagtcccgtggaattctgggtggacttaacaggctgcaactttggaaatttactgaatggatttctttctgtgtaattggaacttcaccatgtaactgtttttgtggtattattacacagcttttgtcctaggcaactaagtcaacttacagaatgagtgaattttgttctttttctggatatgcaatattgtccaataattgagacttttagaacctagaaatgatcagggtgattcttttgggccaggaattcatcaggaactgggtccgtaggcactaattcttgggcttcttatggccattgatcttttattacagtttatttacaaacataacatgaagtgatatttagagattgggctacatgctcggctaattgcaaaaacaaatttttagtttttcctggaatctcaggtactggcacatttagttcatcatagaaagtctgaaatactggttctgaagagtgtttttgaacctccttttattagcatgcttatactaggatctagtccttttccatcaatgcctaatgttacattatattttttgttctactttgggtctgaggggtttgtgattatcgattttaaaaggttgcagctcctacttgtgcaggaggggctgacttttcctttttggagctaaacaggatcttttttatctttttttcaagtagcctaaatgacacaagactagtattgacacatcttagataaatatgattcttgacagatatatacatttttttttactgtgtaacttttttttctaatttagagaactgcatcttattccatgctgcttactatcaatagcgcacaagcaccaaattttaaggttacatttttggggacccctctttcttctgttctagctattactttacttgtgtcacttagaaaaggaccagtcctaaattttattttaaaaatgctgatcatgggaagcttaaaatgggtcataacatgcatcaggttatttcttgggctacataccttggatagaatagcattatacaaacaagtttcttttagagtcctggtacacctacaataactataaaataataggactgtagcaatcttttgtcttacttcagtgacttgatgtatatactggaaacagttctcagtctgaggaaggtcagttgaagtctttactgtacaagtccaaattttaaggaaaatgagtgctgcaatgagtttcttcatgctttggctatgtgtggaccagtcagcttctgggtgtgactggagcagggtttgtggtcttcttcagagtcactttgcaggggttggcgaagctgctcctatctatgtacagctcctagtctactgatttttaagggtagtctcggaggttgggcccactagaataaaatgagcctaatacttctacacagtttatgtttaactgggctctctgatactaggagtaaggtggcggggttagggtgttgcaatcttcaatggttgtgtggggattttcacagagcaagctttggtatctagttagtctagcattcattagctaatggtgtcctttggtatttattaaaatcaccacagcatggggggactttatgtttaggttttgtctaagagttagcttatctgcttcttgtggtaacagggccattgctactagggcctttggacatgggggctagcctttggaaacccaaactagttgttttgagagattggccactggccttggccagggcctcacagtctgagttaaaactctaactgccattttttttttctttctgacacatagagtgtaaacagttttgtcaggtcaggtagcctcagggctgtggctgacaagagttttttttttttaacttgtgaaaagctcattgctgttggttgtaatagatgtagtttatctaatctacatttttattgactgtcatctcctaaaatattgacttaaatcctgtaactatttgatttcaggctttaaattgatctggtattccttgcggggctctaattgcatctaaatagatgtgagagttgaaagacctataagggcttctcctgctttatgatgtcctattatttatttatttatttatttatttcctctggttgatgaaatgccagtgtgaaagggatagccaaatggactaaaacacaaatgccactctagttattcggcagagtgcccagtaaaggtctaccacaataccaccacacatccgctcaaggatgaagaagggctgactgattgataagctcttgaaaattcttaagctcactgtatcctttcaggtctctaaggaatgctaagtcttagtgttcctaagtgttaggaagtgaacttagtgttgggagatggaagctggatggccttcggggactgacctgcagggacttcagaatatagcagagagaacttggcatgacttattactctagactgtagaatcctggaaaagagctatcatgcagcctatgcctggtcaactggaggaccacattagtggaagggggacaatcagggcctctggcctgccatgtgcacaagcataacaattgcttttgtttaaggtgcagatggaatatgtgatctattttaaccaggaatttgcatcttggtatgctgtcttaattgccaaagtttgttttaactctttaacttttatgatcctctagtaaaatgaacgtctcctttagcaccaatttttattagtttttagactaaagaaagctaaacaccactttatatttaataatgtttcttgtatgatttttataccagataagctaaattttacctttatattagtgtgttattaatattaatcttaattttaacataaccttgtagacatatttatcaaatttttcatgtttgaccataagttaagattttatagactatttttaaccttttataatttttgttaaagagcaggtgatgctttaagaaaaacctgttgcatttttactttaatgtccagttcacagaaaaactggatgatactgttttaactttagctaatgtgttcacacacagaattttctttataattaacattttaaaacttgcttaaacttttaaaacaataatttttttaaccttttaatgttggtaaaaatctacattcttatgcccttttataatctttttactaaaggtatattttacttttcttatacactttgcacataaacttttttttaaatagtacttaggaggctttattacttttaaattatataacatttttgaataaatttttttataacactttttctttcacaactttcaccaacaattcttcaacatgtctcaactttttgacttattacaaacatttattttttctttaaacaactagttaatttatttcaggacaagaatttaccatataacactctttttacataaattctacctcccccccccctttttttttttttgaagataacaattcctttttttaaagcgaactttctttatgtctttggactagactgtctaaggccacaagattagaagttaccataatacacgttacactgttaacttttagcaaacttcacttttgttgaaaactttgtaagtttgggatttcatttaccctttgctattaataagaccttgtttagtttaaattaacttggaattggtataggtggcctttttttctctctgccggtctttccttgcctctgccagccgcttatgctgctgttctcttaattactgtaggggggaagagggtctaaaaccagctgtaactgtctatgtatggaaactggtctgggtgccttggcttgcagattacattgtgtcatacttttgaaacaagggacctgtccaggcttccttctgatggtcaacccacctctaatgctggccagtctatttcacacaaagttctaagttttcttggtgtcatagtaacactgtaatctctattaaatcttttcttgaaatttttttaacatagttcctaatggggtgggcttacttatgcctgacctatgcttctttgagacaaaacactatgcttacaccacacacacaccacaaaacaaaacaaaaaaaaaaacaggtaaaaagggcacacacacacttttgcagtttacaccaaactaaaatcaaaaccaaaatcagagtatccagaaatctaagccaggtcaaaaccaaaactaaagtatcatgcagtctaagtcaggtcaaaaccagaacaaaagtgccaatgcaggcacactgtgggtgatcaggccactcttccattcagatggggtggggcaagttccaaagactaatcttaccaagtcaagccaagtcaaaaccagaacaaaagtgccaatacaggcacactgtgggtaatcaggccacacttccactcagatggagtggggcaagttccaaagactagtcttaccaagttacagatgtccagactccaaatgccagttccttctgggtgttcagccactgtgttaatcctctgtggggacctgctactcgctgctctggtgaggtgttccgccagggcaatttcctacctgggagcactctttggatcatgtaactcaggctggctggagtcccccgcagagatgctccacagggcaggcttaagccacctgaggggctgcctcagctgcccatcagttacctcatttcccagtcagagaaccaagaaatgtagcaggacaatccgcagaaaaaaacctctcagacactgagttgtagaaggaagggctttattcagctgggagcatcagcaagctactgctttaaaatccgagctctccaaatgcacgatttctgtcctttttaaaggctcacaacgctaaagatttcacatgaaagggtcagattgatttgaacaagcaaggggtatgtgacaggggctgcatgcaccagtggtcagggaggaacagaacagggcggggagtttcacagtgttcttctatacaatgtctggaatctatgaataacattgatttttaagttatgagttgatttttaactactaggtttaggccaggcaggcccagggctggttttgggcctggcgccaggctgcctgtctttgatttcacttccttgtttttttcttaaaacaggtactgagtataaaacaataaaacaatatgagagggtctctctcttccctcaccagagggggccaaagttttatgagacatctcctcatctgtgcacagatgggtggcggactctggagtccaggctgttgcttcccattctagtggtgaatcttccatagtctggtgagtgtaaatatatatacatctctttttccttctcctattcccattgcaatttgcttttatcaatctgcttattacattgatttgcttattatatctgaattgccatttatgtgggataaagtttgtttacccttaaaggtattgtgtgtgtgtcttttcttctccccttctgtgtttcccacacagaacatttttgtcattacaaacagaaatcaaaaacaaaagtgtgctgcttcttggccagaaggacagggctgatggctacgggacttcccataacctgggatgagaactcccgcagttctccccctttgtgatcgaatggtccaggggaactgacctttgtgagaactgggaatcttaattagtgcaatttaaacctttgcctgtgcatgaagtgctgcaggagattccagtcagcaaaggagctgctgagttgatctcccggagtggatggtgtttgcttactgcttataagttaatgtatcaagacaggggatggttgctacaagagaaatgtaagctggaaaagaaaaatgctagtctgacttccagactggccctggcccaatgccaggcctatgtcttgactgatcaggctcaaagatatccacctattgatgaaaaaagcagctgtccaaatggccccatcatggtaaaactgaagaactagttagctaggcttggagcaggtaaaaacccagctactggccaggcacagtggctcatgcctgtaatcctagcacttttggaggctgaggtgggtggatcatgaggtcaggagattgagacaatcctggcaaacacggtgaaacccagtctctactaaaaaatacaaaaaattagccaggcgtggtggtggctgcctgtagtcccagcaacttgggaggctgagacaggagaatggcgtgaaccagggaggcagagcttgcagtgagcagagattgcaccactgcactccagcctgggtgacagagtgagactccgtctcaaaacaaacaaacaaacaaacaaaataagcaaaacccagctcctgtctcaaggatgggaaattaaccttagtaaaattcaaggacctgcacaaagtgtacaattccttgacatcttatggaatgcagagaaatagcccattttaccaaaggctaaggctaaaataccagaatttgcaacccctagcaccaaaaaggaggaccagaaatttattggtttgtttggattctggaaacatgatattccccacttgggtaacattttacaacctctgcatgtagtcactaaaaaacactatgactttcactggggagagaaagagagcatggcttttaacaagctaaacaagtggtgcaactggccctggatctgtggcccatatgggatgggccagtagaactgcaagtaactgtcccagatcaacctgctaatttgagccttaggcagaaacctttcgggtttgggacccagaaactgccagaggctggcaaagcttatacccctttgtagaagaaattgttagcttgtgattgggctttgctgaaaagagaacaccactgcttcaaccttgatgtctttatgaggcctgaaattcctatcatggcttggtgtcatgaattccccaaaacccaccagataggacatgcccaaggaagtagcatcataaaatggaaatggtacatacaagaccaggctaagccaaaaccaaaggggttatcacttttacatgaggatgtacgaaacttgtccgctcaaaaaaccaccaaactatcctgcagataggaaagaaaccccccccacaatccacccaaaggggccaatcttttaaataactaagcccaaatgatcagaaacatgcttaatttatggatggatccacaaaatacattggtgggacccaatgctggaaggctgtggcttctgttaatcctgttaaaacataagcattactggccagatgcagtggctcatgcctgtaatcccagcactttggtaggctgagttgggcagatcacgaagtcaggggttcgaggccagcctggtcaacatggtgaaaccccatttctactaaaaattacagaaattagccagggtggtggtgtgcacctgtaatcccagctactcgggggagtgaggcaggaaaatcactggaatcccaggaatcagaggttgcaatgaaccaaaatcacaccactgtactccagcctgtgcaacagactgagactcaatctcaaaaagaaaaaaaaaataacaaacaaacaaaaacataagcattcctgatgaaggaagtggtgggagcagccagttagctgaactagtatccatattctaagctcttcaggaagaggccagagagatctgtcacttgtataccgactcttggtcagtagcaaatggtcttactacctctatgctccaatgacaacaaaacaaatggctaattgggaataaaggggcttggggaaaacaatactggaaagatatctcaatcctggcacagactaccattatcactgttttccttttttttttttttttttctttaacgcagagtctagctctgtcaccaggctggagggcagtggcacaatctaggctcactgtcacctccgcctcccagttcaagccattctcctgcctcagcctcccaagtagctgggattacaggcacacgttgccacccccagctaatttttgtagttttagtagagacaggttttcaccatgttggccaggatgatcttgacctcctgacatcgtgatctgcccacctcagcctcccaaagtgctgggattacaggcatgagccatcgttcctggccctttttccatgttgatgctcatgggtctctgctttcttttgacagaccatttaattagcaggaagatcaacaggccaaaatttccaccataactgtaaacttgaatgtgcatgaatggaatacaatgtgttcaagccttgcaatgagaggcattataatgtatggtgctataattggtagtgattaccggggagagttaaaggacattttatacaataccactccagatttttttgctataagaccgcagatgcctgttgctcaattattagtggtaccttgtcaacaattatcccgtgaggaaatctctgccccaacagaggctacatacagaattgggggattcagatccactcctacaggtagcttaaatcctggagccaatatatggatacagggttcaacagatcctgcccctaaggctggtgaccttgtagctatgaaagcagaaaatgaaggcatagtacaatttcctaaagatgaaaaacaatatgttcccctctgtttttgttattacaaggaataacctatctactaatggtcagcacctgtgtctttgtgtctaaagccaagaataaattcatttactaggtagccactgctgcaacaaaagccaatcacagagaatgttggctgtacatcgagttgccagaggctgccaggaatgggctaccttgaagaatcgtccctgacaatatttctgaatggctatgtcgttatcaatggggccacaacaacaacacttgtaatccaacctggacttcctttcaccacactaagcaatctgtctttgcccaggtcagacaaaaggtgaactccaccctcaccttccatcaaaagccttggtattttgcccaatattcctggaacggtatatattggaaacctgctgtgctggtggctggattccacacagcccctgcttcatctggaggccttaaatggctcctctaatgttactctggggtttctccagacaattgtcaacacatactccaaatcaacaacattgcccccaatgaaccacaatctctttcctattttaataacacattagtacagtatgtttacagtaggtccatggctgtcccctggggggccctctgggtatgcagatcctgtgggtgttggtacctgcccccacactgggcagggagatcacttgtgggtggccattaattccattcaccatccgggataatatccccctcccaagtaatctggatgcttacaaacaccactggttatgaatgtgccggcctccttggtggcgataccttatcacagtattctcccctgccgctagaacaatcctgcttcaccaacaaattaaaatattaagcttatatgtagaaaaagctcttaatgatagtagcactggacttatgctgttatcagatgaatttgctcagctgcgtactgttgtgttgcaaaatcaaatggcattagatatgcttaccgcagcccaaggaggggtttgcgccttactgcatactggatgttgtgtgtatatccctggcaattctcacaatattagtctccttgcaaagccatgagtatgtttttttttttaaattgtgcttttaattctcctatgcttaccctgtatccataatctatgtcaactatgagttccccatgtatctataacggtattttaatacaattgagtaccgaattgaggccgaatgttgacgaaaagttaagtattaaatttgaactcaattgaacgtggacacaaataaaggtcaccaagtcttggcacaggttgtgtgagcccctttgaggcgttcattcagcactgtttcagagaagtctctatttcaatctattcctatatgttagttattgtaaaacaatagccaatcacaataacaagttgacctttttgtgtttcttgagcccagtcacaaagggccctcgtgactgggcttcatgccaaacaacttgttacaagaagagctagggtcccagaccacactaaagcttcaagaaacctctcctagtctgtgcaaggactgttggctgactctggagcccagactgttgcttcctggtctggtgataaatcctccatagtctggtgagtgtaaatatatatatatatacacacatatatatatatattcccttctccccttcccattgcaattttcttattatataaatttacttactatatctgcattgccatttacgtgggataaatcttgtttatctttaaaggtattttgtgtgtatgtcttttcttctccactcactcatttcctgcaaagaacaccatatttctcagagcctttgttggttcctttttattattttttctttaatcgtgtctgcatgccttattttagcaaagtggtcttcaaactctgatatccttcttctgcttggtcagtttggctattgatacttttgtatgcttcatgaagttctcgtgctgtgtttttcagctccatcaggtcatttatattcctctccaaactggttattttagttagcagttcctctaaccttttatcaaggttcttagcttcattgaattgggttagaacatgtttctttagctcagcagagtttgttgttaaccgtcatctgaaacctacttctgtcaattcatgcatctcattctctgttcagttctgtacccttgctcaagagacattttgatcatttggaaaagaggcactctggcctttcagccattttttgttgattctttctcatcttgagtttgtctagtttcaatcatttgagggtgctgacccttggatggtttttttttttttttggacacagtctctgtcacccatgctggactgcagtggcaccatatcagttcactgcaaattctgcctccaaggttcaagtgattctcatgtctcagactactgagtagctgggaatacaggcatgcacaaggatgcctggctaatttttgtattttttagtagagaggaggttttaccatgttggccaaagtattgggattacaggtgtaagccactatgtgcagccttggatgaggtttttgtgggtacttttttttcttgttgatgctgttgttgttgctttctgtttgtttttctttcaatggtcaggtccatcttctgtagggttgctgcagtttgctagggttcacttcaagccctatccatctggttcactcccgtgcctagagatgttactcaaggaggttggagaacagcaaagaagaatgtctgttccttcctctgtcatctctgacctcaagagacacaaatctgataccagtagaattgctcctgtatagggtgtctgacaattcctattgaaggtggaatggggagcagatggggagcagaacccatttaatgaagcactttgactgtcctttggtggagggaggtgttttgctgtgggaaaatccactcatctgggctgcttaaatccctcaaaactagcaggaggaaaggctaagtctgctggtccacagagactgcagccacccctcctgctagggttctgctctgatccttgttatttctttttttctgctgggtttgggtttggcttgttcttgttgctctagttctttgaggtgttatcttagattgtctacttatgctctttcagactttttagtaggcacttgatgctatgaacttcccttttaacaccactattgctgtatcccagatgttttgttagattgtgtcattattattgttcagctcaaagatttttaaaatttccatcttgatttcatacaacaatcattcaaaaacaggttgattgtaaattttatgttttatttaatttccatgtatttatttaatttccatgtatttgcatggtttgagggttcatttggagttgattttcacttttatcccactgtagtctgagagagtagttgatataattttgattgttttaaatttattgagacttgttttgtggcccatcatatgtctgtcttagagaatgtttcatgtgctgatgaataaaatgtatattctacagttgttggttagaatattctgtaaatatttgtcaagactgtttgttctagattatagtttaagtcctttttttgttgttgttgtcattgactttgtcttgatgacttgtctagtgctgtcagtagagtattgaagttcctcatcattattgtgttgccatttatcccatttcttaggtctagtagtaattttttaataaattgggagctccagtgttaggggcatatatatttagaattgtgatattttcttgttggactagtccttttatcattatgtaatgtcccactttgtctttttctttttttaagtgtttttgctttaaagtctttttgtctgatgtaagaatggctactgttgcttgcatttggggtacatttgcatggactatcttttcccaaccctttaccttaacttcatgtgtgtctttgtgtgttgggtgagtctctggaagacagcagatttttggttattaaattcttatccattctgctattctgtatcttttaagtggagcattaaggccactaatcactatcaattatatcaccatacattataatgtctgtcattgcaaggcttggaacacatagtaatccattcatccacattcaagtttgcagttataataaaaattttggcctgttgatcttcctggtgattaaatagtctgtcaaaagaaagcagagacacataaacatcaacatggaaaacagtgataatggtagtgtgcaagaggattcagatatcttcccagtattgtttaccccaaacctctttattcccaattaaccatttgtttcattaccattggagcatccaggtagtaagaccatttactactgaccaagtgttggcatacaagtgacaaatgtttctgacttcctcctgaatagctcaaaagacagctaactgggagctaactggctgctcccacccctttcttcatcagaaatgcttatgtttttaacaggattataggtcatggccttccaccatcaggtcccaccaatgtatttggtggatgcatcagtaaaccaagcatgcctgtgatcctctggacttagttctttaaaggagttgccccattgtacaagggaggtttccttgcctatctgcatgactttgttggtggtttactgagctgtcaagttttttacaccctcatgtaaaagtgataacccctttggttttggcttagactgatcttgtatgtaccatttccattttatgatgctactttcttgggcgtgccctatctgatgagattgtgtggaactcatgacccaagtcatagtaggaatttcaggtctcataaagacatcatggttgaagcagaggtgttctgtttccagcaaagcccaatagcaagctaagaatttcttcttgaaaggagtataaggttttccagcctctggcagtttctgagtccaaaacccaaaaggtagcctcttcccatcttgtttctgcctaaggctccaattagcatgttgatttaggatagttacttgcagttctactggcatatcccataagggctatggatccagggccagttgacttgcttgtttagcttgttcagaagccatgctctctttctctctccagtgaaagtcatcgtgttttctagtgactgcatgcagaggttgtaaaatgttactcaagtggagaatatcatgtctccagaatccaaacaagccaatacatttctgggcctccttttcagtggtaggggttgcaaattctagtatttcatcttagcctttggtaaaatggatgatttccctgcattccataggatgtaaaggaattttacactagatgcctgtccttgaattttactaaggttaatttcccatccttgagataggagctgggtttttacccactctaaaccccggctgcctagttcttcaattttatcctgatggggccactgggacagctgcttttttcatcaataggcagatatttctgagccttatcagtcaagacacaggcctgacatggggccagggccagtctggaagtcagattagaattttccttttccatcttacgtttctcttgtagcaaccatcccctatcttgatacattaacttataagcagtaagcaaacaccatccactctgggagatcccatcaccatctcctttgctgactggaatcccctgcagcacttcatgcacagtcaaattttaaattgcgctaatttagattcccaattctcacaaaggccagttcccctggaccattcaatcgccaaagaggaaaactgggggagttcccatccctggatatgggaattcctcgagtttccatccctgtccttctggccaaaaagcggcacaattttgttttcgaattctgtttatgatgccaaaaatgttctgtgtgggaaacgtgaaaggggagaagaaaagacacacacacaataccgttaagggtcaacaagttttatcccatgtaaatgggaatgcagatataataagcaaatgatataataagcaaatcaatgtaataagcagatttatataataagcaaattgcaatgggaagaggagaagggaaaagatatatgtatgtgtgtgtatatatatatatattgcccaccagactatggaggattcaccagcagactgggaagcaacagtctgggcttcagagtaagccactagtctgtgcacagatgaggacaggtctcatgaagcttcggcacagtctgggaccctagatcttttgtaactagttgtttggcctaaggttcagtcatgagggctgttcgtgaatgggctcaagtaacataaaaaagtcaacttgtttttacaattgtctattgtttttgaacaactaatatataggaatagatttaaatagagatttctccaaaagagcactggattaaagcctcaaggggctcacacaacctgttctaggacttgttgatcattgattgtgtccacgttcaaatgagttcaaatttaatatttaacttttcctccacaaattcctctgtcttgataaattggctgtgtctaggccatgggcaaggtgaaccccttggacagttacacaactctgccctctgggttcaagcgattctcctgcctcagccttctgagtagctgggactacaggtatgcaccacaacatccagctaattttttgtatttttagtagaaatggggtttcaccatgttggccaggctggtcttgaactcctgaccacaagtgatctgcccaccttggcctcctaaaatgttgtgattacaggtgtgcgccagtgtgccctaaataatttcttttttttttttttttttttgtatttttagtagagacagggtttcaccatgttggccaggctggtctcaagctcctgacgtcaggtgacccacccacctcagactctcaaaaatgatttctttctatctcctataacagtttgaaattacttaaagtttgtttcaagtagaaaaaataaaaagaaagtgaataaaaataaattgtagagttaaaaatattagaagaaattacaaaatatgtatgtaaacctggagtggccaaaaatcatgaatttgatttatttataaggttttattaaaattagctttagtgttgacaatacactattaccgaagtaaaagttgttgaatacattcaaaaagagagagagtaaaaaagagataggacccccattcaatcgctaggagatgagacagcagcagagatggaaaagaaactttataaaattcttctgaaattctgccacctttcttcatattgctcatgtttctcatgctgagagtagctgtgcactttgggtgtttacagagaaatttcttttaagggaatatattctgactgacttgattaaacttacatcttgtcagagctttttcttaggatctttttaactttcgtctctcaaaataatcttgctcagatggagatctgtttttctctccaatgctttttctgtttcagaagccctattagtatcccatggtgtctgaataaagtgggctgtcacagtgagaacttttggagctatcactatctagagacatgctggaaattcagcagtattttttccgtgtcacaattaaaagtagaaactaagcctgaaacactgctcccatttccattattgtgaaggttcaattctatccagggggcctgcaggctctcctcctgcagcttaggcttagctctctgatgtgacactagagtgctgctgtggcaaatgagattcacataaaatgtcagctgtgctctgggctgtgcctcagtggcagatgatagaggtccagagagaacactagcaaccaggagaaagcaagcaggaattctgtagcccagtgccagggagtacagagccactgctctaaaatgtaaatagccaaaaagatagaacactattaaaccatttttgaggcagagtgaaatcctaccttcagcaggcacctggctttaagctgctaaactacgtcctgttatgaagatgtgaaaagtttatttgtcgttgaatataagtaattagcatacacagatggcctcttcaatctccaggtgaatttaggatgaactatgtatgacatggtgctgtaaattcttctaattgtggactaattatggtgaccatctttctgtctttgtgatctgttaaacagattgactatgatgcttgttacattcaagcttagttgtgtaataaaaccattttctttctgttctattactgggaagtttctttggggctggagaacgttttttttctgtttcttttttctttttttcttttttttttttttttgagacagaagtctcactctgttgcccaggctggagtgcagtggtacaggtgtgagccaccacacccagcccgatttttctgttaactattgtttccaaacactgtctagaattaccagacatgatataaacacataaaatgccgaccagaatttactctagaggggattttccttctcaggcttccagtcaacttatacttatgcagcaaagtgcatgctgtcccctaaatacacaggcagaattgtgtctctgcctatttggtatctatagtcctctacagtcacttctagagaggctagaccacatttctacaaacttcacagggcagcaatcagtcactttacctctttcatggactcttgtatgttcagacctgaaactgattcagatactatgaagcccagaaacttattcagagtaacatgtgtgcattgagtagacatatacacacgagaatctccactttccccttcctcctcatgctaaaatgcccacaaatgtgcaggtaaaacctgctgcgactccagcaattcagaccttaaatctacagctccaaatttttaatcaaggtcttgagatttttatcttaagttccattttatctgaaaaatgcaagtcttttggttatcaaactcagagagacattaaaatgaaagtgcagttatgtatttctcccccctttgaactatgcattcatctcttgaaagtgttcactattggcacaagtagctataaattaaacaataatcaatgttatttctgtaaataaaaatttctgaaaaacaactttgtatcatcccagtccctgtctctctcttgtctgtagaaatcctcttttaactgctactaatcaaagtgtagattccaggcaacttgaatctttgctcccagattacaatccttaagttgacccaaataaactgtctacttatatttatgttgtgtcagcttttttttcttttctttgaggcagagttttgctcttgttgcctgggctagatggagtgccaaggccctgtctcggctcactgcaacctctgcctcctgggttcaagtgattctcctgcctcagcctcccgagtagctgggattacaggggcctgccaccacaccaggctaaattttgtatttttagtagagaagaagtttcaccgtgttggtcatgctggtctcgaactcctgacctcaggcaatccactcaccatggcctcccaaagtgcttggattacaggtgtgagccacagcacctggctgcttttttttttttaatgtacacttatcatttagaatgtgctagaggggcctctatgagggcatctctcctttgattgtactcctcttgctgtgacaccaaaggatgcagagacaagtttattttacctagaatctgcagataaggtctggctactgcctgggatttacagaaaagggccaaactttggatagaaaatgtacagaaaactaacaaaaggcattttctgcattgtgagatgtcaacatagatatcttacagcctccatttgggagtgtggaattatgagatttttcacatcttgttcattgacctgcgacagttatgtcagagtatccaggaggaaatagcatctgatggcagaatctgtaagtgtaaataagcatcttaggagtaagagatcaaggccacaaagtatccagagctataaccacaactatgtttacctgtaaaatgtgatttttgtattttacctgtaaaatgagtatttttttctttcttttatgcaagagctagcaaatcaggacaggtaatccaggttctggagctccagcaaggcagtttcattttctatttagaatcagcctgagcctctcccgactggattatcattgggctatcagctcagggtcactgggaattccttcaaaatcacctagatgtctttgaggtatttgaggatgtccagagcagaattgtgtcaggctgagaagagtggctaattctgtttctgtcttagtataagagaaatgaatcatcctgtgtttgttcctcccctcatacaagaggtgtcttcggttggtacccagatgagaatttctccagtgtcctggtatttggatgataaacaaggagtaaatctggaggcccaaatagataaactagtttcttccattttatatggccgttaaaaaaaatacatgaagcagtcatggttcctacaatccagaaacttttagtctagactagcaactggataaaaaattgaattgtgcatcatatggttggtccaacaaatagatgtgtccaaaatcttgggctttatttaggccactttctttatattgttgtgacttctgatgtctacatctgaaggcatacttatgaacagccttgttattataatttctttttcttgagaccgagtctgttgcctaggctggagtacagtggtgtgatctcagctcactgcaacctctgctgccctggttcaagtgattctcctgcttcagcctcctgagtagctgggattacaggtgcctgccacctcacccagctaatttttgtattttaggtagatatggggttttaccatattggtcagtctggtctcaaactcctgacctcatgatccactggccttgggctcccaaattgctgggattacatgtgtgaaccaccatgcccagccttataatttctatttcttttactttgcttagtgtacatatttattttctaataaaatttccctagaaaggccaggcatggtggctgaaacctgtaatccaagcactttgtgggggcatagacaggtggatcatgaggtcaggagtttgagaccagcctggccaacatggtgaaacaccgtctctactattaatacaaaaattagctgggcattgcggtgcacacctgtagttccacctactctggaggatgaggcagaagaatcacttgaacccaggaggtgggagttgcagtgagctgagatggcaacactgcactccagcctgggcaacagagtgaaactccctctcaaataaataaataaataaataaataaataaataaataaatgaaaaactagcctagaaaaccttaagggatttgtttaaattgcatattagtacatagtataaagttgacaaagcagtgtctagaaaagattaaaattacagaatctctgggatttaagtttcttttaggtaagcttagaaaaaacaaaactggtggtacttcagtggcatggagaacagaattcaacatagggtcctcactgcagtgtctcagacctgttcagatttatcctttttggaggccttatttaggtctgactgtaccttggagtctggcctcacagaactgagtagaagagatcagagttttggctggtgaatcctgctgtctttctagagctggtgttcacaatttcctgaaacccaaaagcagataaatgggaaaaataaagaatgtattttagggtcttagtttttaaaggctctattaaaaccagtgcttggagagacattctatttagcaactggttttttcccctgcagatccagtaattgctccacaagtcacaaaaaagtaaatataaagagaataaaattttctctaaactacgttaaactcttcctttattatatctctttcacctgtctgtatttagcttttattctgtacaattttattaaaaatttgagaaagagaaatagaagaagaaataaaaatgctgggccctttatctaaatcctggaaattattaaacactgagtaccagccgggcgtggtggctcttgcctgtaatcccagcactttgggaggccgaggcgggcggatcacgaggtcaggagatcgagaccatggtgaaaccctgtctctactaaaaatacaaaaaattaactaggtgctgtggtggatgcctgtagtcccagctactcaggagactgagacaggagaatggcatcaacccgggaggtggagcttgcagtgagccgagattgtgccactgctctccagcctgggcacagagcaagactccatctcaaaaaaacaaaaacaaaaacaacaaacaaacaaacaaaaaattgagtaccagatttcagggcattatgagaattaaatcacataatatgttatgcccagtacagtcctctgtatcctagttttgagcacatagtacctgtttaataagcattgtattagtacatgtgtacatgctgttttttaaatccagacttattcagacattactgccttctgtttcctctgtaaactttaaagagacagcaaagaatataaaactttaggatggagatgggttgtccatatttgtacccagaagtgtttgattgcgacaagagtgctgagtgttaagagaccatgggctgtgcctgctttctctaactaatgctagtaatgagacaaggggaagcaacatcagcactgacaggggacttgtttaaaatgcccattcatggactcttttcaaacctgcagaatcacattacataaagtggggccaaaattaccaagtcatttataagctcgttaaagcctgagaggcaatgcttagcttagtggttatcagcccaggcttctcattaggatcaaatggctaatttgcagaaatctcttgtgccctccccacagcttctgtttattgttgtgggtggaaggatccatgtttttgagtgaagggcctcatgtgactctaaggtgaggccagaatcaagtatgagggtttcaaaatacattcatgagcattaagttccatctttgcactaaacagcagtcacaggggtggtgctgtttggatttggtagggaaaggtcagtgtggcacatatttgcattactgtagcagaaattgctggtgtctctggcaggggagggcacctgaagacagaaaaggagaaatttatatttttatcttcatggagcagctcattattcctgaacttcttctgttttaaatgacagaaatgggtggactttttctgtctttttctgccagttgatgtcatgctagcaggtaaacatgtggtactgacacctttaaaggcatattctccatatgcaggtgtaatttgttcagagagtctcatctgagaaggaattctagagaaggaggagaaagaaaaaaaatggcttttcttcaggtaaacatgtgtcagatgaagagctatgtccactctgcctcctggactgccatgcatttagtacccacaaacctttacttctctacttgtgtttttcctccctaatgattttgatttaactacttcttaaaattcttatgatagtcaagggtctctgaaaaatatttttttcctatatcccagagccctccctacattctctacatcatagcttcttatatgtcatgcaggattatcagcaagaatttatgatctgcaatattaaaaatattccctttgtggctgttgaacatgaaaagatgtggatactcaagatttctactggagaaaactgtggtacttagtaaagatggagaacatgtaatgttacggctccatctgtgtgttccattagctctatgcagaagaagattaagaaaatccttatttaactgggatgacatttattactcagaaagttctgaaaaaaaattaggagatatctgctctctagggtggcaaatgaagcctccttaaaattactactaacaattacagaacataggagttatttgtattttgaagtttccataaaactgatgtttctttatggttaaattcagattctatttacttttttggggaaagaatatttcaacagtgatgctgtgttctcctgtgtgcattagcacgtcataaaaatttgtcctcctgcagttaatgattaatgaatcacttagtgaaattgctgacagatttttttttactatggagttaattagttttctctttattagtaagtatctttatgcagctgatgtgcataaatgatcacatttaatctggcagctgtctttttttcttatgtttttctacatatttttctttggtaaatgaaggctcttagttttgtttacaggcttgaaaaactgggaaaaataccgactcttgcacttactgaatatttgacaaaatatccttcttgggacaaaaacattggcattactggtgagcttgttagaaattcaaaaaattggctgagcatggtggctcatgcccgtaatcccagcactttgggaggctgaagtgggtggatcacctgaggttgtgagttcgagaccagcctgaccaacatgtagaaaccccatctctactttaaaaaaaaaaaaaaaaaaaaaattagccaggcgtagtcacgcatgcctgtaaccccagctacgcaggagacaaaggcaggataattgcttgaatccgggaggtggaggttgcagtgagccagatcatgccattgcactccagtctcagcaacaagagtgaaactctgtctcaaaataaatacatttaaaaatcagactttataccagatcttctggaaaaaaaaaaaccctgcaaaacaaggtcttcagcttattctacacatcaaaatttgagaggtgctttctaactcaacatgtcttttccatctgaaaaatattcacaagtcattttgtatgatgtaaatatagcactcaaaaatatacatgtttgtgttcatgtccttaattttatactttattatccagaaaaatatcattatatgaactgatcttgtggatattatgctgctcttttttctcagagatagagaatacattagaaaatatttgtgttgaaaattattttattggataattttagtcagtcctataagtcagaatgagtgctctttactctctcatttcaccttaagtcaaattaaaaattccgctcatggcaacttagtaaaaatgtgtgtgtgtgtgtgctttacagtgaccactgcaatttagggatgtggctatagaattctctctggaggagtggcattgcctggacactgcacagcacaatttatatagggatgtgatgttagagaactacagacacctggtcttccttggtgaggataacttgagtacataattcataatatatcctaaagattttatttctctttttatttttattttttgagatggagtctcactctgttgcccaggctggagtgcaatggtgcaatctctgctcactgcaacctcagcctcctgggttcagtgattctcctgcctcagcctcccaagtagctgggattacaggtgactgccaccacgctcggctaatttttgtatttttagtagagatgggatttcaccatgttggccacactggtctcgaactcctgacctcaggtgatatgcccgtcttggcctcccaaagtgctggaattacaggcataagccaacatgctcagcctatttctcttttttgtagaatgtttttagacctttattctttgcataaaaaactttcagatcccctttttccagaaaatcttcaaaatttgttcatttattaaagaatttcttcaagatgtttcatcttaatccaaactttccacattcctgagttgagctgtattcttcactctaaattagtggtaattccagaaatttagtggcataaaatatttttgtccccacctgaaaatcgaattgccaccaccaatttttgattcagcagtaccaggtagtaaaattaagaaacccacaaattgaaagtattttctaaatatttagaaatttctgttataacttagtattttgctattaatttgctagaatattttatcacattctctctgctgagcacattactagcttgtaattggagaatatgagaaaaatttatgtatttatttttaataaaacaggtattgttgtctctaacccagacctgatcacctggctacagcaaggaaaagaaactttgaccatgaagagacaggtgatgattgccaaacacacaggtaggtgttttttttgctctcacaaaggggcatcttctgtcttatgcttttaaattctctaaggattctgcttttcttttggtgagcttccttcaagttcacagtgagagccaatgtcctcttcatggcatagaagagactgcacaatctgactgcttttccattattttggggacacacaaatatctgcatgatgttgagaaactaaaactatgttttaagttcccttttttcatcaggtttgaaatgtgtgaaagtagtagtttctgttgcatttttttgttcatttttctgcacagtccattctgtttttattattatgtggccttgaaatatagtttcaaattataagtatgatatccttctgctttgttctttgtcttcatgattgcttcggctattcaaaatttattttagtttcatgtaaattttagaattgtattttccattactgtgaaaaaaaaccacagcaattttgataggaagtttattgaatctatagattactttggataatatggcactacaataatatttattctttcaagccatagacaaaatattttaaaatttatttggatcttctctaatttatttatttttttattgtaaaaatgttttacctccttggttaattttttcctcagaaatttactaattaatgctctagtaaataaacgtttttctttatcagacagtttaagtgcatgaaaccatacatacacttgtatgttaattttatattttgctgatttactgagtgtatttattagtttagataggctttaatgtactgtttatagttttttaaatgtatgattgtatgacctacaaacagcaactttttactcatttttcaatttcaatggttttttttaaatttctttgactaattcttctgttacatacttccagtgctacattaaaatagaagaattgacaaagggcacaatatagttttgtattggtgtctgaatttgatggagcagacacctcttcaagtttttgtaaactgattttagattgtaaagatcttcttttattggttccttagggtgatgagatgccatctgaatttgtagtgaagagggattgtagcttggtcacaaggctgctaggtctgcactagggttcacccttagttggcttgttacaggggcttgggttgttgtaattcccattttatttttggacagactaaatatccttcagtacttttctcagtagggcaggcactacagcatgtttttgcagtcgagtctgcatatgctgggccttaaatcaggatgtggatgagtgtggctttcatgagtatgagagagcatttcctcaggtaactgtgtgggtttctatgcaggaagaactgatcataaactgtggctcaggtaactgaaactgagtcattgaaccacttcagggacctgagtaaaggccaaggtctgcagacctgcctgcatggctgtaaataggtgccttcctctgggtctctagaatggcaggacctctcccagacagtggctgggaggagtttgggacggttatatgataagttcagaattctcagaatctcagtttgggaccaagttgggtgaactctatcctggtctgtagccataaacaggaatcctgcactttcccacctaattgagggcctgctttctgagtagaacacttttcaatcctaagctttaacagagtttcatcactccttccctggatctcaaatctctcttacaggcacttattttggagatggggtcttgctacataacccaggctggtctcaaaattctggcctgaagcagtttttccaccttaatgtacgatgtagctgtcattacaggtgtgagccataatgcctggttctctcataaaggcatttttgtcagggatggctgacattattttgctgtaaggggatatgaatgtaggggacttttaatcttttcatcttactgatgtcactctccctatacatttttactttccattttctatttcaaatttttctgtaattttagattcagatatttaggacaatatgctagaatttgcatggtatgcctgatgtagttagaaaattagtaggtactccatatttactaaaagagttacttataaatgtaagtttgctacaggcaaaaaagaattataggattttcatctactttcttcagcctatatataaataataacatagtttatttcccaatatttgttttacatatcagaggatctaattctattctgcaatatatacatgtatattttctgtctttaacaatgtaagactattctttgcttctaaagttagaatacagcagtttcattttgtgtaagaataacatattcaaaacataaaactaactctagtttttttaaatgcttatttattaaaagtttctcattagaatcttctatttatgattatactgcatattttctgaaattttactgccacacagtgcatgccaatgattcaaaatacctgcatttaatgagtacacagtaacagctaaatattgcagttacccagacaaatttttttaaattatttttttgagatggactcacagcctgtcacccaggctggagtgcagtgctgcaatcttggctcactggaaactccacatcctgggttcaagcagttttcatgcctcagcctcccaagtagctggaattacaggtatgtgccaccacacctggctaatttttgtatttttatgtgagatgaggtttcatcacgttggcaaggttggtcttaaattcctgacctcaggtgatctgcccgcctcagcctcccatagtgctgagattacagatgtgagccaatgcacccagcctgacaaattctttttaatgatacatcaatgttgcataccaggttttatgagtaaactcttctcttattattgttttgaagtttcacattagtgtgtttctttaatgaaggtttctgtttttttgggggggacagagtctcactctgctgcccaggctggagtgcagtggcatgatctcagctcactgcaacctctgcctcccaggttcaagcaattcttctgccacagcctcccaaattgctgggactacaggcttgtgccacaacatctggcagatttttgtatttttcatcgagacagggtttaaccgtattggccaggcttgtctcgaactcctgaccttgtgattcatctgcctccgcctctcaaagtgctgggattacaggcgtgaacccccgtgccaagcctcatttatatttcaaatagggtctcacttggttaaccaggctgatttgcagggctcactgctgcccgaacctcccaaactcagatgttcctctcacttcagcttctcaaatagctgggttacacatttttgccgtcacacccagcttgcttttttgtattttttgtagagacagagttttgccatttgcccaggctcctgttgaactactgagatcaagtgatcagcccaccttggccttccaaagtcctaagattacatttcattttattaagtagtttaattaatttatatttaaaataattgcttaaaaaatgaagttgttattaccagttatactgttattgttttatgtgtttctagtagttatatttttctcattttctgttttactttcttaattttcacttaatcttgtactagcatgctttgattatattttgttttcttttgcatactttctataaatattatctttgtaatcagcttgaaaactgaagattacatacaccttaaagttaaaaaacaatatattttaatcttataacggcctccattgaatacaaaaactatgcttctgtattttccagtttgttgttaatattaaaattattattattattttttgagatggagtctccctctgtcgcccaggctgtagtgcagtggaacgatcttggctcactacaacctccgtcgccctggttcaagggattctctgcctcagcctcctgagtagctgggattttaagctcctgccaccacgcccagctatttttgtttgttttagtagagatggggtttcaccatcttgaccagtctagtgttgaatgcctcacctagtttatatggtgtatctattcacagatttatgcggatttacatattgttttttatattccataaaagcactttaaaggttttatgtaccatcattttggtttttttgttttgttttgtttggtgtgggattatttttttcagactgagtcttgctccatttcccaggatggagtgcagtggtgcgatcttggctcactgcaacctccacctctcggcttcaagcaattcttcttcctcagcctcctgagaggctgggattacaggtgcctaccaccatgccctgctaattgtttgtatttttagtatagatggagtttcaccatgttggccaggctggtctggaactcctgacttcaagttatctgcccgcctcagcttcccaaagtgctgggattacaggtgtgagccaccacttccagcctgtaccatcattttgatagtaaagaattccatatgtgtccatttatttacattagtgtatagctttatatttatatatgtttttatgatgctgtccagggtcaatttgtgtttcaacataatggacacattctaacatttctgtatttttagatatagaatctcattatgttgttcaggttgatgttgaacttttggtctccagtgatatgactgctttggcctctgaaagatgtaggattacagacatgaacaattgtgcctgagcctcttgtagtatttttttttacttttttttttttttgagacggagtctttctctcctagctcaggctaaagtgcagtggcacgatcttggctcactgcagttttcgcctcccaggctcatgcgattctcttgcctaagcctccctcccgaggagctggggttacaggagcatgccacaatgcgcagctaatttttttttttttgtagttttagtagagatggagattcaccatgttggccatgctgctctcaaactcctgacctcgggtgatctacccgccttggcctttcaaagtgctgggattacaggcttgagaaaccgtgcccggcttttatttttttaaatttttttaagagtgagtctcactctgtctcccaggctggagtgcaatggcatgattttgactcactgcaactcccacctcctgggttcaagcaattctgcctcagcctcctgagtagctgggactacaggtgtgtgccaccatgcctgggtaatctttgcatttttagtagaaatggggtttcaccatgttggtcaggctgatctcgaactcctcacctcaggcaacccacccaccttgacctcccaaagtgctgggattacaggcatgagccagtgcacccaggcccatgtattatattatgagagacagtgatagttgtgatgaatactctcaccttttattttggaaagtctttatttttatcttctttttgaagtaaagtaattttgaatcgagtattgttagaaattttttttgttacatcaaaattggggaagttttcagtttttttaatcttcgtgtaacctctatattactttttccctatattctaagatttgtttcatgaatacattgatctacttcatggtatccaataagttttatattctatgttttacttttgttccacaattttatatttttgtgttatatatattttgggtatgccacatcacaccagttaattgtattttaattttttagtttatattataattgtatatgacaatttttaactctgtacaatttaagacagtatggagcaaaattaaatatgaataagccatatgtctattgccaatataattatttatatgtttgtttgcctggataaatattatctttgtattttttgtcacttgtatatttattgtgtaggtttgctgtaacagttttttttttttttttggaagagaggtttgctcttgttgctcatgctggagtacaatggtgtgacctcagctcactgcaacctccgcctcctgggttcaagtgattctcctgcctcagcctcctgagtagctgagattacaggcatgcaccaccatgcccagcgaattttgtatttttagtagagacggggtttctccatgttggtcaggctggtcttgaactcctgacctcaggtgatctgcctgcctcagcctcccaatgtgctgtgattataggtgtgagccaccattcccagtctgtaacagttttttaatcctgtctaggtgagtagtcataaaaattctcctgatttcagcatttatttatgtgtgaatctatattttttcggtgggggagaaacacctaaagaaatgtgttatgtgtcaaaaacacataacaaaatttacaataaaatatttctaggctgggcacagtggctcacacctgtaatcccagaactttgggaggccgaggcgggtggatcacgaggtcaggagattgagaccatcctggccaacatggtgcaaccccgtctctacaaaaatgcaaaaaattagctgggcttaggtggcgggtgcctgtaatcccagctactcaggagggcgaggcaggggaatcgcttgaacacaggaggtggaggttgcactgagccgaagttgtgccgctgcactccagcctgggaggaagggtgagactccattttaaaagaaaaataagtatatatatatgtatataaatatatatatgcttctaaatattcagtttggtcatattaattctgttgacattgttatgcaacatatcactagaatatttttatcttgcaaagctaattctcaatagtcattaaacaactaccaattctagggccgggcgcggtagctcacgcctgtaatcccattactttgggaggccgaagcaggcgaatcatctgaggtcaggagttcaagaccaacctgaccaatgtgcagaaaccccgtctctactaaaaatacaacaaaattagccgggcatggtggcgcatgcctgtaatctcagctacttgggagcctgaggcaggagaatcgcttgaacgcgggaggtggaggttgcggtgagccaagatcgcaccactgcactccagcctgggcaacaaggtcctaactcggtttcaaaaaaaaaataataataataaagaaagaaagaaacaactaccaattcttctcattttgtggtacttttcaaacaccactctgttttctgtttctaagagtataattgctttgtatatctcatacaatctctgtctctttgtggatggcttattttattttgcataatgtcatcaatatttatcttaatagttgttagaatattttctgctttttgaaatctgagtgatattccagtatttttatatctactgaatgatttggagacagaaatttgcattgcttttacctattggcttccagtaacaatgttacaatagttatgtgaaagttaatatatgtgctgcattctgttttattagtctacattttcacctttataatcataccgaattgttgtaattctatacgtttttgatgtgtttgaaatcagaaattgtaatgcctccaacattgttcctttttctcaagattgttgggtactttattatctctttagattccatatacttttggagttggtgtttttgtttcttcaaaaatgcaatgagaaatttgagaaagattgtattaaatctgtagattaaattgagcagtatagacatcttcacaatattaattatttcttttttcattgtttgtttttgagatggggttaaattcacccacctcagcctcccaaaatgctaggattacaggcatgaaccactgcacccagcccagttatttcaacaagtgcatgctcaagagtgtgttgtatcatttctatatagatgtaaatttatcatttatttatattattgttttgtactctaattctatttttgtcatagaaaataatctatgaaatttcagttgtaaataatgtgttaagactttgtttttggcctaacaggtggtctataaagaagaatattgtatgagctatcgagaaggctgtgtatcctgatgttgttgaggagtgttctctataccttcattagaaataattgttttttactgccttctagtcctctgttccattactaatattatgtcttgttttattattattacagaaagtggggtattgaaatatcctactataatcatattgctctctctgtattcaattttgttagtatttgcttgatataattgaaaccctaatttgagacacacacagaaaaatacacacacgtgtataaacaaatttgtcataggttcccagtgaatgaatctatatattgtttaacgcccttctttgtctttttgaagttttgacttaaagtacattttataaaatatgacagtttttttacttaagatgtagcttgtgtaatattattttgacctcttctgctgtaatttggttaatatttatataaaaattctacttttgtcttgcaactttcagtcttttcttgtcattagatctcaactgactctttaaaaaggtaagttgagtctgatttttaaaactttttaatgaacctttttattgaaattatgtctcttgaatggaaagataattgtatatatttaaatagttttctgaaagagaaaaacttagttattttaattgttttatttgattattgtatccttgtgtgtcattttctctgtctttttgtgttgttttgatttttatattgacatgctttcagttttctcttattgttttttgtgtatccatatggattttttttagtggtatcttagggaattacctaaaacctctaaaagattcaacaatatattttaatgtagtaagaaattagcttcagttgcatacaaaaattcttattacatctgccttaaactttgttactgactttactaattacattttttatgttgtatattcatgaacagatgcttataatttctatacatttatcttttaaattttaaagaataattaaaaaagttttctgtaccattatgataatgttaagtaagaaattctatttttatgtgtgtacatatctttcccagaaatttatgtattttcatatgattatgtgttgttttcttgcattacgttattttctgtagaagaaactcctttcagcgttcttgatatgtaggacatatgcagtgccaatataattctcaagatttggttattttggaagaacttctttctatttggtagtacaattttgctcttatggtaatactcccatttgacaacttattttgaaattataattttaaaaatatcacagtttccttctgatctgcaaaaatttttttgataaattcactggttatctgatgagactatgcttatagattattattatatttatcttgcagcttgcaaaattcttatctgtgatttttgaaattttgcttatatatgtgtttgttataaatatatgtttgagtgtatcctagtttgttcagctttttcatgtttaccccattttttcttacttttaagaaatttttcagttttttttacatccactattttcattttctgctattttaatattttttgtggttaatctcatttttccgatcttcagtagttgtctgtgtttctatataacttcctggatattattcaatttattttatttatttattattctttttttttttttttttctgagatggggtctcaccctttcacccaagctggagtgcagttgtgtgatctcggctcactgcaacctctgcctcctggattcatgcaattctcctgcctcagcctcctgaggaactgggattacaggcacctgccagtatgcctggctaattttttgtgtttttaaatgaggtgggttttccccatgttggctaggctgatcttgaattcctgatttcaaatgaactgcccatctcagcctctcaatgtgttgggattacaggtgtgagccaccatgcttggcctattttattttatttttgagacagagtcttgctctgttgcccaagctttagtgcagtggcacatctccactcaccgcaaacttcccttcctggattcaagcaattctcctgtgtcagcatcccacgtagctaggattacagtcagataccaccaggcccactaatgtttgtatttttagtacatacagggtttcaccatgttggccaggctggtctccaactcctgacctgtgattctaccaccttggcctcccattgtgttgggattacaggaatgagcctccaaatatggtctgttcaatctattttgaatttttaaaattactttatacatttttaatgattgcttttgaaaattttataatttttttgatggggcaatgttgccttaatattttgtatacattgtaatctttgatcgatatttgaacattaacaaaaagccacctgttacaatctttataatatagctctgtcctggcatagtctgaaatcaattgtcttggctagagattctgggaatttctcaaacctgtttttaggaggtgtcttgtctaaaattttgtgtttattgtttagttaaatcagtttattaatatttcttcttaataatcagtaatcacttgctacacccatttcctgtttggggtactgcagtttctctgcttttgtaacatttaccttaagccttggcagactcaaactgtcattccaacatatatcaccatttctttcagcattttatgttgtgggagaccttaaccagtgccttaaaaagtccctagaagccagaaataaagatgtatgtgccaatatttttcttgtttttttaaaaagaaaccaggagttggcaatttacatttgtgtgtgtgtgagacagagtctcactctgttacttaggctggagtgcagtgacattatcttggctaacaacagtctctgcctccagagttcaagcaattctcctgcctcagcctcccaagtagctggattacaggtacctgttaccatgcctggctaatgctttttatttttagtagagacgggtttttaccatcttggccaggctggtcttgaacacttacttacccttgtgattcaccgacctcagcttcccaaagtgctgggattacagacttgagccatcctgcctggccaggaatgtacatttaaaggcacaatgttatactggagagcaggaagaagtgaagaatatttcttctaaagacagccattagaaatataaagggggttgtagtgcctttacttgcatcatagatcttattgcacacattttgtactagaggaaaaccctgaagcagttgctcaagctttgttcaacattggaatttatattggagaagagtcctgaaatataatgaatttaaaaacacttatatttcaaaaactacagcttagaaaacaccagagagtttatactaaaatatatttttgcagatgcagtaaatataaaaaaaattaatttaaaattgattttatgtaaatatcagagaatttacggtagaataactaaggcactgacatttcagacattacagcaaatcagtgttgagtataaaaactaatctacagctacagctgttagataaattgcttgtatataactttaaaaggagtagatttttgaagcatggtaattctattgaaagtatacttatttgcggccttgagcagtggctcatgcctgtaatcccagcactttgggaggcagaggtgggcagatcacgaggtcaggagatcaagaccatcctggctaacatggtgaaaccttgtctctactaaaaatacaaaaaaattagctggatgtggttgcacacacctgtagtcccagctactcaggaggcttaggcaggagaatggtgtgaaccctggaggtggagcttacagtgagccgagatcacaccactgcactccagcctgggcgacacagcaagactctgtctcaaaaaaaaaaaaaagaaagtatacttattcgcttgaaaaaaattttttgaaaagtgaataatgatgtaatacaggtttcaagttactttatgctgttattttattcctatattattcacacatgaaagcatgtgatcaattgttgatgcatcagagatactagacattgttttttattagttgggcattatttattaccttttctataaaagagtaagaacattaaaatgtaagatgcatgatgaaaatgtaagtggagaggctctttgtagtaaacctctattaagtaatgtataaggtggtggtttgtgttctcatttgtgtaatcctagcctatgacttaatgttgacactttgctttgtcttttggatggcctaacctacattaacatatacgcagaacattttaaacctttttttcaaaaatcataaagaattactttatcaataaacaaaggtaaacaataagctgagggttcagagtaatacttttctacattatagtgagagaaataaattattaattatagtcaaaagtattaaaataaattagtattgcaggctgggcgccgtggctcatgcctgtaatcccagcactttgggaggctgaggtggacggatcacgaggtcaggagatcgagaccatcctggcaacacattgaaaccctgtctctactaaatatacaaaaaattagccgggtgaggtggcaggcgcctgtagtcccagctactcgggaggctgaggcaggagaatggtgtgaacccgggaggtggaggttgcagtgagccgagatcgtgccactgcactacagcctgggggacagagcatgactcagcctcaataagtaaataaataaataaataaataaaaataaaataaaataaattagtattttactaattgtacttttaagtaataaaatgtattacatttaaaaattgttagattatgtgtgaacttaatttttttaccatgttaagcctattgtgcatttaatgaagcattttttttaatgaagcattattatgccactaactttaaactatttctccttacccaagcgtgtaaataaaagatggtagcaatatactatttggtatatagtggaataacatctctagtaatcactttgccaatggctttaaactgtaaatgtattgaagaatattgttcccataggtcaaatttttattctttattcttattgaaatgtattattagtatttatgagtatgtagtatgtgtatatatttatgccttatatggcatattttgagttaggcatataatatatagtaattactttagggtaaataagatagccatcagctgggtgtggtggctcatgcctgtaatcccagcactttgggaggccgaggtgcgtgaatcatgaggtcacgagattaagaccatcctggccaacatggtgaaaccccatctctatttaaaataaaaatattagttgggcacggtggtgcgcatctgtaacctggaatcccagctacttgggaagctaaggcaggagaatcacttgaacctgggaggtggaaattgcagtgagctcagaatgcaccactgcacttcagcctggtgacagagtgagactctgttaaaaaaaaaaggtatccatcacttgtagcatttatccttttattacaaactgtaattatacatttttagtgtataatttagtgagaaggattgcctggtgtcaggatttcaagaccattttgcccaacatggtgaaatcccatctgtactaaacataaaaaatttagttgagcatggtggcacacgcctagaggctgagtcaggaaaatcacttttaactccagaggtggaggttgcagtaaggcaagatcatgccattgcactccagcctggttgacagagcgagacttcatctcaaaaaaagagaaagaaatataaataaaatccttacatttctgagtcctgaaaaattattaaatatttgttatatagttttcttttaacatttggtctctctgcctgcgaacatatagacttttagttttaatttatgtggggaaaagtgagagaaatcagattgttactgtgtctgtgtagaaagtagacatgagactccattttgttctgtactaagaaaaattcttctgccttgagatgctgttaatctgtaaccctacccccaaccctgtgctccctgagacgtgtgctgtgtcaactcagggttaaatggattaagggttgtgcaagatgtgctttgttaaacagatgcttgaaggcagcatgctccttaagagtcatcaccactccctaatctcaagtacccagagatgcaaaacactgtggaagaccgcagggacctctgcctaggaaagccaggtattgtccaaggtttctccccatgtgataacctgagatatggcctcatgggaagggaaagacctgaccatcccccagcccaacacccataaagggtctgtgctggggaagattagtgaaagaggaagacctctttgcagttgagataagaggaaggcctctgtctcctgctcatccatgggcaatggaatgtctcagtgtaaagtccaattgtatattccatctactgagataggggaaaactgccttagggctggaggtgagacatgctggcagcagtactgctctttaatgcattgagatgtttatgtatatgcacatcaaaagcacagcacttttttctttaccttgtttatgatgcagagacctttgttcacgcgttttcttactgaccttctctccactattaccctattgtcttgccacatccccctctctgggaaatgcccgataatgatcaataaatactaagggaactcagaggccacggcaggcaggcgcggttcccccttatgctgaacgctggtcccctgggctgatttttttttctctatactttttctctgtgtctctttcttttccaagtctctcattccacctaacgagaaacacccacaggtgtggaggggcaacccagcccttcaaatttacatagagttaaatatacacatattactctgaagataaatcttaggtgtaagaaaagtattaagtgagtgtttgtgtgagtatgagtttgtacatattttcaggagaaaagagcaataattgcaacaaaatgaataaataaggtgactaatagaaaactaaacacctcaaaaatgctgaaagcaaatctatactttttgctttgtcttgaattcctttattcattttattttattttatttttttgagacagagtttcactcctgttgcccaggctggagtgcaatggcacgatctcggctcactgcaacctccaccttttgggttcaagtgattctcctgcctcagcctcccagtagctgggactacaggcacatgccaccatgcccagttaatttttttttttgtatttttagtggagactgggttttaccatgttggccaggctggtctttcattcctgatctcaaatgatccatccacctaggcctcccaaagtgctgggattacatgtgtgaactgccacattcagtgtgtcttgaatttattaatgtaaaatgttatggcttatggtttggattctccctagaatctgcctattaaagcacaggcatctttgtcttcagaaatgacactcttgagtagaacaataaaaaccctcttcaaacagaaaaaaataatcatttttaacacttattttaatgaaaatttaaccaacattgagtaattggatatatttttattgttttatgtgtgtgtgaatgtataaaatggtacatacaggaaaaataattcaagccagaaaaaagatgtaagttaatatttgtaatgaatgaaactggagagtagttaattattatttgcagataatatatttgtttatgtagataacaaaaggagcagaaagactattttaaaagtttatttaggtgggtaggcaacattttaagataataccctggattaccagtctgttgcacacctgctgtgtcatactttcctcttgagtgaaaaaaaaatgtatgactgtggtgggaaatcactcatgaaattaggttactcaactgttgactttgtgtttatcaaaatggagattattctgattgtgttaaacttaatcacaggtgcttctaagagaaagagacacatagaaaaacaacctgctggcctgattgttttgtgtgtttttctgtgctggcttactttacttggcataatatttttcaggttcatgaatattgttgcaaataacaagactttcttatttttaagtgcagagaagtatttcattgtgtacatataccacattttctttttctattcaactattgatggacacttaggatgattccataccttagctattgtgagtaatccacttccttccctctgttttgttttgtttgagatggagtctcattctgttgcccacgctaaagtgcagtggcacgatctcagctcaccgcaacctatgcctcccaggttcaagtgattctagtgcttcagcctcctgagtagctgaggttacaggtgtgcaccaccatgcttggctaatttttgtatttttagtagaggcaggctttcaccatgttgaccagagtaactttcatttgtttgtatatatttttcttccttttctatttctagaagcatgttaattttaaaatataaattatgaatgttaaaaaccttcattctctgtctttgattactattacaactgatttaaaaataagtttttttgaaattccctggataaaggttattacttcattattaacataacttgagacagcatagaaatgaaagtgaatatttgatagtaaaacagcaattatgtagctcctggtagtcatttaatctctcacccactctttggaacttctatcaagacaagaattctatttttgaaatgcttatgtttttaacaggattataagccacagccttccagcatcgggtcccaccaatgtatttggtggatccatttgtaaaccaagcatgtttctgatcttctgggattagttttttaaacgatttgcgccattggtcggggtgggaagggtggtttccttccatatctacaggacttgctcagtggtttttttgagctggcaagttttgtacatcctcatgtaaaactgataccccctttggttttggcttagcctggtcatgtatgtaccatttccattttatgctgctactttcttgggcatgccctatctggtaggttttgggggaactcatgtcccaagtcacaataggaatttcaggccacataaagacatcatggttgaagcagaggtgttccatttccagcaaagttcaatagcaagctaaaaattgcttcttgaagggatataatctttgctggcctctggcagtttgtaggtccgaaatccaaaagtaccctcttcccatgttgttcctgcctaaggctccaattagcatgttgatctaggacagttacttgcagttctactggcccatcccctataggccatagatccagggccagcttcaccacttgtttagcttgttcaaaagccatgctgtcttcctctccccaaagaaagtcatagcattttctagttgctgcatgcggaggttgtaaaatgttacccaagtggggaaaatgatgtttccagaatccaaacaagacaatacatttctggacctccttcttagtggtagaggttgcaaattgtagtattttagctttagcctttggtaaaatggactatttctctgtattccataggatgccaaggtgttggggtgatcagacccaacaccaggtcataggggctatgaagtctgatagagtcaaagaatgagacaagacaagttaaaagttcatagggtgggtccagggggccaactccaagcatggtggctgtgaagaccccaagctctgggagcccatgctatttataacttataacttattggtaatcaaacaaaaaagcagttggtgaggacatgtggacatgggggtagacaggtgaggatgtgcggatagaaaggtagtggtgaatcaagcgtagctgtgatggttgagcatatgctctgctacttgagataaaggagaacaggttcttctaattcaagacacaatcaatttatggtctcaggagagcaagaagcaatgggccaacgagtctggatacattccagaggctacaaggggttttatgccctgagcctgggttctgtccaagccacaaggggttttatgccctgggcttagactgtagtgtggcagggcagccttccaccctttggcacagagcttggtgttccacaggccacaaggggttttagaccctggaaccaggacatgttccaagactcttttatattatgtcagacaagcaagccctgcctcagctcttctgccaacaccaaggaattttacagtttgtgcaggtcctttgaattttactaaggttaatttcccatccttgagataagagttgggctcttacccgctccaagccccagctaactagttcctcagtttcaccctgaccaggccatttagacagctgcttttttcagcaataggctgatagctttgagcctgatcagtcaagtcataggcctggcattgggccagggccagtctggaagtaaaattagcattttccttttccagcttacatttctcttgtagcaactagcccttatcttgacacattaacttataagcagtaagcaaacaccatccactctggcagatccctcagcttctcctttgctgactggaatctcctgcagcacttcccgcacagtcaaaggtttaaattgcactaatttagattcccaattcccacaaagagcagttcccctggaccattcaaaagggagaactggaggagttcccatcgcgggatatgaggagtcaccgagcctccagccctgtccttctggccaaaaagtggcacacttttgttttgaatcctgttcgtgacgccgaaactgttctgtgcgggaaagaggcaaggggataagaaaagacagacacacaatacctttaagggtaaacaagcttcatcccatgtaaatggcaatgcagatatattaagcaaatgatataataagcaaaaaaaatataataagcaggttgatataataagcaagttgcaatgggaagaggagaagggaaaagtttgtgaagtttacgctcaccagactatggaagattcaccaccagagtgggaagcaacaacctgggctccagagtcggccacccatttgtgcacagatgaggagaggtctcatgaagcttcagtgcagtctgggaccttagctcatttgtaacaagttgtttggcatgaggcccggtcatgagggccctttgcaactgggcttaaggaacacaaaaagattaacttgtttttgcgattgtctattgtttttcaaaaatgaatgtatatgaatagattgaaatagagatttctccaaaacagcactggatgaatgcctctaggggctcacaaaacctattctgggacttggtgaccattgcttctgtccacgttcaattgacttcaaatttaatatttaactttacctccacaaattcctctgtcttgatgaatcggctctgtctaggcaaagggcaaagcgaaccacttgggccttacacaacctttacctcctcgattcaagcgattttcctgcctctgcctccgaagtagctgggactataggagtgcaccaccacaccctgctaattctttgtatttttagtagagatggtgtttcaccatgttggccaggctggtcttgaacttctgaccccaagtgatctgcccaccttggcctcccaaagtgctgggattaaaggcgtgagccaccatgcctgtccctgaatgatttctttctatctcctataactgtgaaatcacttaatggatgtttcaaactgaaaataataaaaagaatgtacataaaaataaaatacaagaagtcataaaaattagaagagattacaaaatatatatgcatatctcgaggggtcaaaaatgagaaattttgtttatttacagcgttttgtttatttatttatttaattttttttgagatggagtctcactgtgttgcacatgctggagtgcagtggtgtgatcttggatcaccgcaacctccacctccctggttcaagcaattctcctgcctcagcctctggagtagctgggaccacaggtgcatgccaggaggcctggctaatttttttgtattttcagtagagacgtggtttcaccatgttagccaggatcgcctcgatttctttctatgtcctatagcagtttgaaattacttaaaagttgtttcaaattgaacaaataaaaataatgtgcataaaatataaatagtttaaaaaattacaagacattacaaaatacgtatgtaaatctggagttgtcaaaaatgacaaatttgatttatatataaggttttattaaaattagctttaatggatactacactattaccaaagtaaaagttgattttctcttgaacaaaaatttgttgtattattaatatgacagcaaaatacttctgttcaccttttgaatacattcaacaggagagagtaaaaaagaaatagaattttcccatgctctgggatgtaagaattatccaatcagggacactgtgctggaaaccgtccaatcaggcacacagctgtagcgaacagcacggcttccgggtttggcggggcctttgtgtctctctgcagcctgagctccaggtctcttcttcactgctctgtgtcctctgcccctagaggcccagcctctgtggccctgtgtcctgtaggtattaggagatccacagctaggacgccgggatcccggaagcccggaaatggtaagaatgccggtccgacatcccgagagagggggaggggctggttggaaccggaaggaaatgtctttggcaagactcagctccagtcagtcagctccacaatttgtgccccgagttctccttacccagctcggcctcagtcctgttcagccataagatggcggctacacagaagcctggccccctgggcgtcctctcttccgtgcgcaatgactgtgtcctggcctggagccctctgtgggcagctctgcatctgcagcgctgtgtctctcccagattgtacagggatcatgagagggtcgtcaagggagaatcctgacttggggttcaggttcatgaatgggaagagctttggtccgtggggttcacagtttctcttttctcctattaaaaatgtatggggccaggagtggtggttcatgcctgtaatcccagcactttgggaggccgaggcgggcggatcacttgaggtaaagagttattagaacaagtaagttcctcttcaaagactcaacttctttgtcataagttgtaaatcaaatttatccctgctttccccttctccttttgttgcaaattgctcgtttaccctatttggaaaaagctggggtctaagccaaccgggatcagcttagattattgggtctgacccaagccaatagaggaaggacacaaaaacaggaactgtgttagggttaataaccccttcctggctgggtgcggtggctcatgcctgtaatcccagcaatttgggaggctgaagcgggctgatcacgtggtcaatgtaaggctcttgtattggtttgaaccgtgagagcgtgccaacagacaacaccaggcagtgtggagcaacatgctgttttagtgagtgccagggtgcaggccggctgaggcctacaatggcgtcagcaccaaatgaggacgaggcaggagttttattgtctccagtaaacaggaagtctcccagtctgatggggctgctacgtagtacccagacagcctctttctcaaacttcagggttacatgtcttctggccagagttgatgtcttccagacggttctcttcctgcttctgctatcttgctggcacacactgctgatgcaggtaggcttgcgccttgggactgggcctgggaagggaggagttactcatcccttcaagctttcagaccccggggagattctttctttcctctctttttggttatagaaagaaagggaaaaggggtgactttctcaataactacttcaggtgtgacatagggggtggcattggaaccttggaaaaaggtgcgtggctgggtttagatgggagctggttaatttttggggtattcttgagagacgggttggtgtccatcgtgttgttgaagcagaagcatcatctggattgtctggcagttaactgtagtttcaacgagagttttaatggcttttattattagtgggataacacaggcgagaaacaggaggaacctaatgataaaggtaactgtccctaccagccttttaaatcctcctaaatgaaagaaccaccctcctaggaggtttgttgggccacatcccttccaggtttagactggtacatgggctacttttctcatgtttgaagtgatttctagaacaacttttctgttatcatctatgttaagacagcaattaggatattaaacttaccacagattccaccctttcctgctaataagtagcctagtgctggcctgttttgataaattgctgtgcgcatttgattttgttgttgtgtgaacatttccaaggctgagaccgtttggttagtgattatctttagaacagcctgtaattattctatttagcatatatatgggagtgcgataacctcatgaaccatcctctgcctaaatggcagggccataatattcgatgatccattgcagaggccactcgtcttcttgcacagggactccaagggtgtcacctgctgttaatgttttggaggaaggagtagccttggagatgagcttgaccctggtgtgatggatccagtgggggagttcttggactctcactacagttggcatgctgagtatgacagtgtaagggcctgtccactttggttgtaccttttggtgagggctgggttggcagataaacatgtctatgcctgcaaggcagttatgttgagaggacaaggaggtgctgacagggagaggcatggcctcatttgctgcttcacgaatgaaagactgtgttggattaagtaggggaggtaattcctgagtggctcggagtctggtaaggatggaggccttaagacaaaagtatggctatgtatgattttgaagggagtataaaaagagggtgcttttggtgttgtgtggagtctcatgagggtgaaagggagatttcttgtccacaactgacaggtttctagagctagcttggtgagttgggttttaaggacagagttgactttttaaactttgcctgaagattgaggcctgtagggtgtatggggaacctatttgattcttaaggatgtagagacaccttgggtaatttggctgataaaggtgagcctgttatcatactggatggatgttgggagtccgaaacggggaattatatgcatgatgagagtttgtgtgatgacatttgcaccttctgaagttgttgggaatgcttctacctacccggagaaagtacagacaaagactggaagatagcggagccgtttatcgggcagcatgtgagtgaagtttacttgccaatcttgcctgggtaccttgccctgggcttggtgggtaggaaaaggtggtggccagggtaagccttggggtgacactaagtggcatatagagcaggacagggtgattccttgaacacagcaggaaagatgaggacaagtgagaatagggtggagaaattgagggagaagtttgtaactgacatggaaagagttgtggagactttggaggatagggattgtttgagattgaggaaggatgaagcacccttccttgacataccatggtccttgcttttgaaggtttttggcctggaagtcctctttttctttggaggagtgaaaaggagggaatgaggacagggacagagcatggctgggtttagatgcgagctgttagcacagtgatgtggggagtttctatgaatagagcatacagttggaggagcagtggggcagagatgagacttagtacactggggtgagctagcatgtctttgatgttatgggttgaataaactgttaggttggcatggagagatagttttaggctttcaagggtgagaacagcagctgccgtcaaggctcagagacaggcaggtcatccaagaactgtggcttcaagctgtttagagagttaggcaacatcctggagggtgggtcccttatactgggttagaacacctagtgcaactctacgctgttcgtcggtatagagggagaaaggtttggtaaggtctgcgtctgggagaacgaggataggggctgagttgagagccttttggagtagacagaaaggttgggtaataggctgtgcagggtttaaaggctcatggagagggcctttagtggcttggtataacggattggcaagtagagcgaaggaggaaacctagagactaaaatatcccgctagtcctagaaaagagaatttcttgctagtttgtggaggcgggagggactggaggagggatatgtggttggttgtgagccttcggtttcgtggggtaagagctaggcctagataggtgactgagggggtgcatatttgagttttaggggagacctgatacccccattctgccaagaagtttaaaagaaagatagtatgggcgttgcagtctctttgagaggggctacacaagagcagatcattagcatattgaaggggagtggatggtgttaggaataaggtacagaggttgcaagccagggcctgcccaaaaaggtggggactgtctctgaaaccctgaggttactacttcaagggtaggtgggcacagcctggtgggcttacctgagggggcatggcctggtgggcttatctgggtatgcaccaggtgaaaggtgggtgtcggggttttcctacgtaaaggcaaagaggtcctgagaatcagggtgtgaaggaattgtgaaaaaaagcattatttagtttaggacagaaaaatgggtgatattgtagggaaccacggaaagtaaagtgtatgggttagaaactactggacatactgggagtacagcttggttaataagcctagggcctggactaagtgataagttccatgtagctttttaacaggtagaatcagtgtgaaaaggggagtttgttgggcagagtaggtgattggcgaggaggcgagaaatgatagggtttaggcctacaagagctgcttgggggttggatactgcttctgtgataggaactgggtggggtttttaagggtaatgtgaacgggggcgtggtgttctgtcactgagggtgtggaagtatcctaaacagtgaggttaactatggatggggaataaggaaaggctgcatgttttaaggtgggaggttggaggagaagaagaaaattagaagcccccgaggggtctgggtagatgcgttgggtactatggggaatgtggaggtggagagtagtgtggagttttgagaggatgtctctactttggaggggagttgggcatgagggcaggactaagaaagagtgagtaaggaaaaggtgtgcagggaccagaaaagtggaggagtggctcatggtttggacacttgtccatcaattcctacaacagactgggaggactgggaaattaggtaaagcagagtaggttgccccagtattaattttaaaaaacatactggcctacctgccaccatcagtgttacccttggctcagatgaagatatggtagttgctgggatgccctttccagggcaccatcagtcttcagcagcaaggctggtgagatccaagtaggaggttttggctggctcaggaagggatgagggcagtgcttctgggggacgctcacagtctgacttccagtggagtcctccatagagggggcacgaactggtgggcttacctgggtttgggcattgtctggaccagtggccttcattgccacacttgaaatgtgcaggtgcaggtggattcctaggggcttccatgtggagctgtggccccatgggcctgcagggcccctgatggcggaggcaagcatttgaaactctgcctgtttttgccttttactttcctcatcatgattgttaaagactttgaaggctaaattaagatctttttgtggggtttgtgggctgttaccaagcttctggcttctgaagcttgtgctgaatatcaggggtggattgggaaatgaactgaaggtttaaaatagtggttccttctgagctggttgagtctacgttgttatattttctcatggcttcaggtaaacaagagggagaaaaagggctgggttttcatcaggacattgggtgatttctgaaagtttttcatagttgactgctttatgggcaccttttgagtcctgcaaggagacacacaatcatgtggtcttgatagtggcatccagggtccctgtcttgataatcctagtgggggtcctggttggggactgcctctgtaccagtagctgggcaagagcctggtgattaattgtattagcatgtgcctgagctagggtccagatagtctcagtcttctggggtgagagttgaagagaggataatgtagaggtcatgccaagttagttcataagactgggtaaggtactgaaattccctaaaataagaggtagggtcttttggaaatgaaccaaatcttttgttaatttgagagagatcagtgagggagaagggagcatgaactctcacaataccttcagctcctgctacttcccaaagggggcactctagcaccgacactgaagtaagggtggggcatgggccaaagatggcacctgagtgagtatggatgggagagaaggaagaagtcggaagtggttcctactgaccatttgaagggagaaggggggttgagttgataggcagtggaggatagataggggtgtaaggtggttggatgggtttacaggcctcaagagagggcggtgggggaggagactgggtacaggcaatactagaattgtcctgaggaggggacgatgtaggaaaagaagtggatactgctgactgggaagatggcagctgagaatataaagaggaggcttggggggttatagaagacagttgagagggagaggtaggggctgtgaggggtggacagcagtctgctggatccagtaagaaaaaagacgtagggttgggaggagaaaggtgatcaggtcggtgagaatggagaagtatttgaacaagtgagcaagaattgcagaggtcttgttgtgatctgagtgcaaaaaggcctggacataaggcatttctgcccatttttccagcagtcagcaataattgctttaatcagttaaaattgtaaagtcgaatgttccatttgtgggccatttggacccattatccaattcataatgtggccagactgaattgcaaaaaaagacaaggtgcttagggcagatatcttgcctgaggcctaaggtttgcaggttttttacaaggcagcctagaaggctgtccttcagaatggaaaactgggaattttctataatggagggtaggcactagagaacagagaaaaggagaccgtcctggatagccggatggagacaataaaaggagcagttgtcatcactgcctttttcattcctggaacgggatcagatggcttagaggggttcccctaaggccagatgatcagctagtgcctgacacatgccagagccttcttggaccaacattggatttttggacacaagaaccaagagaggccatacagatttttccctgttaagcgggctcccacagaaagctaccagtaggtgagatcactgactgatgtgcatgtacagagaggcaactggaggctgaggagcttcttttgtccagctgctgtggcctgctctccagggcagaggggtaggtccatggggatgcagacatcagctctcctgggttttggcaccaaaatgtaaggttcttgtattggtttgaaccctgagagcacactaacagacaacatgaggcagtgtggagacacatggtgttttaatgagtgcctggttgcaggcgggctgaggcctaaaatggccccagcaccaaataaggatgggtcagggatttcatggtctcctgtaaatcagaagtggcccagtctgacatggctgctatatagtacctggacggcctctttcttgatcttcaggagtacgtgtcttctggccagggtgggtgtcttctggccatctctctttctactactgctatcttgctggtgcacactgctgatgcaagtagccttgtaccttgggactgggcctgagaagggagttactcatcccttcaagctttcaggccccggggagaatctatcagtcaagagttctagaccagcctggacaacatggtgaaacccgtctctactaaaaatacaaacattagtggggcgtggtggcaagagcctctaatcccagctacttaagaggctgaggcacaagaattccttgaacccgggaggtggaggttgcagtgagctgagatcctgccatcacactccagcctatgtgaaagagccagactcattctcaaaaaaaaaaaaaaaagaaaaaagaaaaaaaaaaggtaagcatcttaaaatttcctttgtttatttaaacactgtgagtaatttcactggatttttcaaacacttagtttcaaacacgaagtgaataactctgacatggaaattaaagcttgaacctagtgattccaagctaagactaatactaagcctacaacaggaggtttttgttgttgttattgttgtttttgagacagagattcgctcttgttgcccaggctggagtacaatggcacgatcttggctcactgcaccttccggttcaagtgattctcctacctcagcctcaagagtaactgggattacaggcatgtgccatcacacccagctaatttggtatgtttagtacagacggggtttctccatgttagtcaggctggtgtccaactcacaacctcaggtaatttgcctgcctcagcctcccaaagtgctgggattacaggcctgagccaccgcgcctggctaacagtaagttattaaaggcctactgtttttttctggggagcctcccctgcagatgtcccagcctgcgcatcctagcaatggaaggagcctttatcctgagagaagctacagagtcctggaaagctggggccccacagcttgatgcagttaagatgaagacgaaaggaaactgggaggttctaactgataatgaagttattgttttgaggcattttttagactttgtaaaataacaacgtcagatttatgttaaaaaaaaaaaacgaattccaaaatgtattgcaacaggaggaagtatcaactaactataaggcctttatggcttgcaaaaatgtaggcagaaaagggctttctttcctagggaggagcaaacaatattggaaaggaggtgggaggggaatggcaaatggagggtgaaaaagtcagattttagatcagagaatgtcataccctgaaatcagcatgttcttagtagggacataaaatggggttgtatgttgacacagactgagagtagctcaaagttcaggagcctgagggagaaagataaacttaagtaaagtttgattaagaaatattttattttaggctgagctcaatggctcacgcctgtaatcctagcactttgagaggcagaggcaggtggatcacctgaagtcaggagttcaagacctggctaacatggtgaaaccctgtgtctaccaaaaatacaaaaattagctgggtgtcattgcagtcatctgtaatgccagctacttgggaggctgaggaaggagaattgcttgaacccagaaggcagaagttgaagtgagccgaggttgagccactgcactcctgcctgggtgacacagcgagactccatctcaaaaaaaaaagaaaagaaaagaaaagaaaatgcttatttaagtgggatggcatttattaaccagaaagttctgaaaaaaattattaggagataccagctctctacggtgctgaatgaagtctacttaaaattactactaaggtgattccgttccaagatggccaaatagggacagctctggtctacagctcccagtgtgattgacacagaagatgggtgatttctgcatttctaactgaggtacctggttcatctcattgggactggttggacagtgggtgcagcccatggaggcagagccaaagcagagtggggcattgcctcacccagaagcacaaggggtcaggtgatttccctttcctagccaaggaaagccatactttcaccaaagacagtgcctgaaaaaataggaaacttccacccaaatactgtgcttttccaatggtcctagcaaatggcacacaaagagattatatcccatgactttcttggtgggtcccatgcccacagacccttgttcactgctagtgcagcagtctgagatcaacctgcaaggcagcagcctggcagggggaggggcgtctgccactgctgaggcttgagtaggtaaacaaagcagtcaggaagcttgaactgggcggagtccaccacagctcagcaaggcctctgtctctgtagactccatctctgggggcagggcatagctaaaccaaaggcagcaaaaacttctgcagacttaaacatccctgtctgacagctctaaggagagcagtggttctcccagcacagtgtttgagcttggagaacatacagactgcctcctcaagtgggtcactaacccccgtgtagcttaactgggagacatctcccagtaggggctgactgacagctcatacagccaggtacccctctgggatgaagcttccagaggaaggatcaggcagcaacatttgctgttctgcaatatttgctgttctgcagcctccactggtgatacccaggcaaacagggtctggagtggacctccagcaaactccagtagacctgcagctgagggagctgactgttagaaggaaaactaacaaacagaaagaaatagcatcaacgttaacaaaaaggacatccacaccaaatcccatatgtaggtcaccaacatcaaacaccaaaagtagattaagccaaaaagatggggagaaaccagatcagaaaagctgaaaattctaaaaaccagagtgcctcttctcctccaaaggatcgcagctcctcgccagcaatggaacaaagctggatagagaatgactttgaagagctgacagaagtaggcttcagaatattggtagtaacaaacttctctgagctaaaggaggatgtttgaacctatcacaaggaagctcaataccttgaaaaaagattagacaaatggctatctagaataaacagtgtaggaaggagcttaagtgacctgatggagctgaaaaccatggcacaagaactacatgacacatgcacaagcttcaatagctgattcaatcaagtggaagaatgggtatcagtgattgaagatcaaattaattaaataaagtgagaagagaagtttagagaaaaaagagtaaaaagaaatgaacaaagcctcccagaaatatgggactacgtgaaaagaccaattctacgtttgattcatgtacctgaaagtgacggggagaatggaacgaggtagaaaacactctccaggatattaaccaggagaacttccccaacctatcaaggcaggccaatattcaaattcaggaaatacagagaacaccacaaagatactcctcaagaagagcaaccccaagacacaaaattgtcaggttcaccaaaattgaaatgaaggaaaaaatgctaagggcagccagagagaaaggtccggttacccacagactgaagcccaacagactaacagcagatctcttggcagaaatgcgacaagtcagaagagagtgggggccaatattcaacattcttaaagaaaataattttcaacccagaattcatatccagccaaactaagattcataagtgaaggagaaataaaatcctttacagacaagcaaatgctgagagattttgtctccaccaggcctgccttacaagagctcctgaaggaagcactaaacatggaaaggaaccaccagttccagccaccacaaaaacatgctaaattgtaaagaccattgatgctaggaagaaagcccatcaactaacaagcaaaataaccagctaacatcataatgacaggatcaaattcacacataacaatattaaccttaaatgtaaatgagctaaatgccccagttaaaagacacagactggcaaattggataaagagtcaagacccatctgtgtgctgtattcaggagactcatctcatgtgcagggacacacataggttcaaaacaaagggatggaggaagatctaccaagcaaatggaaaggaaaaaaaaaaaacagtggttgcaatcctggtctctgataaagcagactttaaaccaacaaagatcaaaagagacaaagaaggccattacctaatggtaaagggatcaattcagtaagaagagctaactatcctaaatatatatgcacccaatacaggagcacccagattcataaagccagtctttagagaagtacaaagagatttagactcccacacaataaaaatgggagactttttagacagatcaatgagacagaaggttaacaaggatatccaggacttaaactcagctctgcaccaagcagacctcacagacatctacagaactctccaccacaaatcaacagaatatacattcttctcagcaccccatcacacttattctaaaattgaccatatagttggaagtaaagcactcctcagcaaatgtaaaagaacagaaatcacaacaaacagtcttgcagaccacactgaaatcaaattagaactcaggattaagaaacttactcaaaactgcacaactacatggaaactgaacaacctgctcctgaatgactactgggtaaataacgaaatgaaggcagaaataaagatgttctttgaaaccaatgagaacaaagacacaatgtaccaaaatctctgggacacatttaaagcactgtgtagagggaaatttatagcactaaatgccaacaagaggaagcagcaaatatctaaaatcaacaccctaacatcacaatagaactagagaagcaagagcaatacgcattcaaaagctagcagaaggcaagaaataactaagatcagagcagaactgaaggagatagagacacaaaaaaccctttaaaaaatcaatgaatccaggagctggttttttgaaaagatcaacaagatggatagaccactagcaagactaataaagaagaaaagagagaataatcaaataggtgcaataaaaaatgatgaaggggatatcaccaccaatcctgcagaaatacaaactaccatcagagaatactataaacacctctatgcaaacaaacttgaaaatctagaagaaatgagtaaattcctggacacatacaccctcctaagattaaacaaggaagaagatgaatctctggatagaccaataacaggctctgaaattaaggcaataattaatagcttaccatctaaaaaaagtccaggaccagacagattcacagctggtttctatgaggaggagctggtaccattccttctgaaactattccaatcaatagaaaaaaaaggaatcctccctaactcattttatgaggccaacagcatcctgataccaaagcctggcagagacacaacaaaaaaaggagaattttagaccaatatcactgatgaacatcagtgcaaaaaacctcaataaaatactggcaaactgaatccagcagcacatcaaaaagcttatccaccacaatcatgttggtttcatccctggaatgcagggctggttcaacatacacaaatcaataaacataatccatcacatacacagaaccaaagacaaaaaaaccacatgattatctcaatagatgcagaaaaggcctttgacaaaattcaacaaccttcatgctaaaaactctcaataaactaggtattgatgtaacatatctcaaaataaaaagaggtatttatgacaaacccacagccaatatcatactgaatgggaaaaaagtggaagcattccctctgaaaacttgcacaagacagggatgcccactgtcaccacttctattcaacatagtgttggaagttctggccagggcaatcaggcaagagaaagaaataaaggtattcaattaggaaaagaggaagttaaactgtccctatttgcagatgacaaaattgtatatttagaaaatgccatcgtctcagcccaaaatctccttaagctgataatcagcttcagcaaagtctcaggatacaaaatcaatgtgcaaaaatcacaagcattcctatacaccaataacagacaatcagagagccaaatcatgagtgaactcccattcacaattgctagagagaatcaaatacttaggaatccaacttaaaagggatgtgaaggacctcttcaaggagatctacaaaccactgctcaatgaaataaaagaggacataaacaaatggaagatcattccatgctcattgataggaagaatcaatatcatgaaaatggccagactgcccaaggtaatttatagattcaatgccatccttatcaagctaccaatcattttcttcacagaattggaaaaaaactactttaaagtatatatggaaccaaaaaagaccccacattgccaagataatcctaagcaaaaagaacaaacatggaggcattatgctacctgactttatactatactacaaggctagagtaaccaaaacaccatggtactggtgacaaaacagatatatagaccattggaacagaacagaggcctcagaaataacaccacacatctacaactatctgatctttgacaaagctgacaaaaacaagatatggggaaaaaattccttatttaataaatagtgttgggaaaactggctagccatatgtagaaagttgaaactggatcccttccttacaccttacacaaaaactaactcaagatggattaacgacttaaatgttagacctaaaaccataaaaaccctagaaggaaacctaggcagtaccattcaggacataggcatgtgcaaggacttcatgactaaaacaccaaagcaatggcaacaaaggcaaaaatagagaaatgggatctaattaactaaagatcttctgcacagcaaaagaactaccatcagagtgaagaggcaactttcagaatgaaaaaaaatttttgcaatgtacccatctgacaaagagctagtatccagaatctacaaagaacttaaacatatttagaagaaaaaaaacctcattaaaattgggcaaataatatgaacagacacttctcaaaagaagacattcatgcagccaacagacatatgaaaaaaatggtcatcattaccggtcattagataaatgcaaatcaaaaccacagtgagataccatctcacaacagttagaatggcgatcattaaaaagtcaggagacaacagatgctggagaggttgtggagaaataggaatgattttagactgttggtggaagtgtaaactagttcaaccattgtggaagacaatgtggtgattcctcaaggatctagaacaagaaataccatttgacccagtgatcccattactgggtatatacccaaaggattataaatcatgctactataaagacacgtgcacatgtatgtttattgcagcactattcacaatagcaaagacttggaaccaactcaaatatccatcaatgatagactggattaagaaaatgtggcacatatacaccatggaatactatgcagccataaaaaatgagttcatgtcctctgcagggacatagatgcagctggaaaccatcattctgagcaaactgtcacaagaacagaaaaccaaacaccacatgttctcactcataggtgggaattgaacaatgagaacagttagacacagggtggggaacatcacaccctggggtctgtcatggggtggggtgcagggggagggatagcattaggagaaatacctaatgtaaatgatgagttaatgggtgcagcaaaccaacatggcacatgtatacctatgtaacaaacctgcacattgtgcacatgtaccctagaacttaaagtataataataaaaaataaaaaaaagtactactaaaaattatggaacataggagttatctgtacattgaagtttgcataaaacatgtttctttaaggttaaattcagattttatttactttgtgttggaggaatatttcaacagtgatgctgtgttcttctgtgtgcattagcacatcataaaaatttgtccagtgcagttaatggttaatgattcacttgcttaaatagctctctgacagattttttcactcttcagttaattatttttctcttcattattaagtatctttatgcagctgatgtgtataaaacgctatacttaatctggcagctgcccttttttcttattttttcttcatatttttctttggaaaatgaaggcttttatctttgtttacaggtgagaaaaacttggaaaacccaggcttttccacttactggatgtgttacaaaatatccttcttgggccaaaaacatagacagtattgctgagcttgttagaaattaaaaaaatcagactttatgtcggatcttctggaaaaaaaaaaaaagaaaaaaacctgtataacaaggtcttgaacttattgtacatatcaaaatttcagaggtgtcttgtagctcaatatgtctttttccatctgaaaaatatgcacaactcattcagtatgatgtaaatatagcactgaaaagtgtgtatgttgatgttcatgctcttaattttatactttgttagctacaataacatcatatatgaactgatgtggatcttatgctgttctttttttctcagagttaaaaaatacattagagaatatttctttgttggagattattttcttggataatttaattctataagtaagaaccagttccttttactttccaatttcaccttcagtcaaaataaaaactctgcccatggccacttggtaaaaatgtgtgtgtgtgagtgtgtgtttgtttcaggggccattgcaatttagagatgtgcttacagaattatctctggaggagtggcattgcctggatactttacagcaaaatttacatagcgatgtggtgttagagaacaacataaacctggtctttcttggtgaggataactttaatacataattcataatatactctaaaggttttctttctcttttttgtggaatgttttttagtaatgtattcattgatcaaagagtttcagaacccattttccagaaaatctttagaaatttttcatttagaaaagaatttgttcaagatgttttgtgttaatcaaaactttacacattcctgagttgagctatattcttcactctaaattagtgataattccagaaatttggtggcataaaatattgttgtccccacctgaaaatctaattatcagcaacaagttttgattctgtagtaccaggtagtaaaattaaaaaacctacaagtaggctgggcgcggtggcttatgcctataatcccagcacttcaggaggctgaggcaggaagatcatgagatcaggaattcgagaccagtctgaccaacatggagaaattccatttctaataaaaatacacaattagccgggcatggtggcacatgaatgaaatcccagctaccctggagactgaggcaggagaattggttgaacccagaaggcagaggtttcactgagccaagatcgtgccattgcacttcaacctgggcaataagggggaaactctgtctcaaaaagaaaagaaaagaaaagaaaaactgatgaattcaaagtgttttctgggagccaagatggccaaataggaacagctccagtctacagctctcagcatgagtgacacagaacacgggtgatttctgcatttccaactgaggtaccaggttcatctcactggggagtgccagagagtgggtgcaggatactgggtgcactgcaccgtgtgtgagccaaagcagggtaaggcatcccctcacccaggaagtgcaaggggtcagggaatttcctttcctagtcaaagaaaggggtgacagacagcacctggaaaatcgggtcactcccaccctaatactgtgcttttccaatgagcttaacaaacggcacaccaggagattatatcccacacatggctcagagggtcctacgcccatggagccttgctcattgctggcacagcagtctgagatcaaactgcaaggcagcagagaggctgggggaggtacgcccaccattgctcaggcttgagtaggtaaacaaagctgccagaagcttgaactgggtggagcccacctcagctcaaggaggcctgcctgcctctgtaggctccacctctgggggcagggcacagacaaaagaccgcagtaacctctgcagacttaaatgtctttgtctgacagctttaaagagagtagtggttctcccagcacgccgcttgagatctgagaatgggcagactgcctcctgaagtgggtccctgacccctgagtagcctaactgggaggcatctcccagtaggggtggactgacacctcacatggccgggtactcctctgagacaaaacttccagaggaacaatcaggcagaagcatttgtggttcaccaatatccactgttctgcaaccactgctgctgatacccaggcaaacagggtctggagtggacgtccagtaaactccaacagacctgcagctgagggtcctgactgttagaaggaaaactaacaaacagaaaggacatccacaccaaaaacccatctgtacgtcaccatcatcaaagaccaaaggtagataaaatcacaaagatggggaaaaaacagagcagaaaaactggaaactctaaaaatcagagtgcctctcctcctccaaaggaacgcagctcctcatcagcaatggaacaaagctgagcggagaatgactttgacgagttgagagatcaaggcttcagaagatcaaactactccaagctaaaggaggaagttcgaaccaatggcaaagaagttaaaaaatttgaaaaaagaattagactaatggataactagaataacccatgcagagaagtccttaaaggacctgatggatctgaaaaccatggcatgagaactacgtgatgaatgcacaagcctcagtaaccgatgcgatcaactggaagaaagggtgtcagtgatggaagacgaaatgaatgaaatgaagcatgaagagaagtccttaaaggacctgatggatctgaaaaccatggcacgagaactacgtgatgaatgcacaagcctcagtaaccgatgcgatcaactggaagaaagggtgtcagtgatggaagacgaaatgaatgaaatgaagcatgaagagaagtttagagaaaaaagaataaaaggaaatgaacaaagcccctaagaaatatgggactatgtggaaagaccaaatctatgtctaattggtgtacctgaaagtgacggggagaatggaaccaagttggaaaacactctgcaggatattatacaggagaacttccccaatctagcaaggcaggccaacattcaaattcaggaaatacagagaacgccacaaagatactccttgagaagagcaattccaagacacataattgtcagattcaccaaagttgaaatgatggaaaaaatgttaagggcatcccaagagaaaggtgggttacccacaaaaagaagcccatcagactaacagctgatctctctgcagaaactctgcaagccagaagagagtgggggccaatattcaacattcttaaagaaaagaattttcaacccagaatttcatatccagccaaactaagtttcataagtgaaggagaaataaaatactttacagacaagcaaatgctgagagattttgtcaccaccaggcctgccctaaaagagctcctgaaggaagcactaaacatggaaaggaacaaccagtaccagccactgcaaaaacatgccgaattataaagatcatcaagactaggaagaaactgcatcaactaatgagcaaaataaccagctaacatcataatgacaggatcaaattcacacataacaatactaatcttaaatgcaaatgggctaaatgctccaattaaaaggcacagactgacaaattggataaagagtcaagacccatcagtgtgctgtattgaggaaacccatctcatgtgcagagacacacatgggcttaaaataaagggatggaggaagatctgccaagcaaatggaaaacaaaaaaaggaaggggttgcaatcctagtctctgataaaacaggctttaaaccaacaaagatcaaaagagacaaagaaggccattacataatggtaaagggatcaattcaacaagaagaactaactgtcctaaatatatgtgcacccaatataggagcacccagattcataaagcaagtccttagtgacctgcaaagtgacttagactcccacacaataataatgggagactttaacaccccactgtcaacattagacagatcaacgagacagaaagttaacaaggatatccaggaattgaacacagctctgcaccaggcagacctaatagacatctacagaactctccaccccacatcaacagaatatacattcttttcagcaccacaccacacctattccaaaattgaccacatagttctatggaagtaaagcactcctcagcaaatgtaaaagaacagaaattataacaaactgtctctcagaccacggtgcaatcaaactagagctcaggattaagaaactcactcaaaaccgctcaactacatggaaactgaacaacctgctcctgaatgactactggctacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacacattcaaaagctagcagaacgcaagaaataactaagatcagagcagaaccgaaggagatagagacacaaaaaaatccttcaaaaaaatcaatgaatcccagagctggttttttgaaaagatcaacaaaattgattgaccgctagcaagactaataaagaagaaaagagagaagaatcaaatagacgcaataaaaaatgacaaaggggatatcaccactgatcccacagaaatacaaactatcatcagagaatactataaacacctctatgcaaataaactagaaaatctagaagaaatggataaattcctggacacatactctctcccaagactaaatcaggaagaagttgaatctctgaatagaccaataacaggctctgaaattaaggcaataatcaatagcttaccaaccaaaaaaagtccagaaccagatggattcacagctgaattctaccagaggtacaaggaggaactggtaccattccttctgaaactattccaatcaatagaaaaagagggaatcctcccaaactcattttatgaggccagcatcatcctgttacaaaatcctggcagagacacaacaaaaaaagagaattttagaccagtattcttgaacattgatgcaaaaatcctcaataaaatactggcaaactgaatccagcagcacatcaaaaagcttatcctccatgatcaagtgggcttcatccctgggatgcaaggctggttcaacatatgaaaatcaacaaacgtaatccagcatataaacagaaccaaagacaaaaaccacatgattatctcaatagatacagaaaaggcctttgacaaaattcaacaatgcctcatgctaaaaactctcaataaattaggtattgatgggacgtatctcaaaataataagaggtatttatgacaaacccaaagccaacatcatactggatggacaaaaactggaagcattccctttgaaaacttgcacaagacaaggatgccctctgtcaccactcctattcaacatagtgttggaagttctggccagggcactcaggcaggagaaggaaataaagggcattcaattaggaaaagaggaagtcaaattgtccttgtttgcagatgacatgactgtatatttagaaaaccccatagtctcaccccaaaatctccttaaactgataagcaacttcagcaaagtctcaggatacaaaatcaatgtgcaaaaatcacaagcattcttatacaccaataacagtcaaacagagagccaaatcatgagtgaattcccattcacaattgcttcaaagagaataaaatacctaggaatccaccttacaagggatgtgaaggacctcttcaaggagcactacaaaccactgctcaatgaaataaaaagaggatacaaacaaatggaagaatattccatgctcatgggtaggaagaatcaatatcatgaaaatagccatactgcccaaggtaatttatagattcaatgccatccccatcaagctaccactgactttcttcacagaattggaaaaaactactttaaagttcatatggaaccaaaaaagagcccacattgccaattcaatcctaagccaaaagaacaaagctggagacattatgctacctgacttccaactatactacaaggctacagtaaccaaaacagcatggtactggtatcaaaacagagatatagaccattggaacagaacagagccctcagaaataatgctgcatatctacaactatctgatctttgacaaacctgacaaaaacaagcaatagggaaaggattccctatttaataaatggtgctggaaaaactggctagccatatgtagaaagctgaaactggatcctttccttacaccttatacaaaaattaattcaaggtggattaaagacttccacgttagacctaaaaccataaaaaccctagaagaaaacctaggcaataccattcatgacataggcatggacaaggatttcatgtctaaaacaccaaaagcaatggcaacaaaagccaaaattgacaaatgggatctaattaaactaaagagcttctgcacaacaaaagaaaccaccatcagagtggacaggcaacctaaagaatgggagaaattttttgcaacctactcatctgacaaagggctaatatccagaatctacaatgaactcaaacaaattcacaagaagaaaacaaaccccatcaacaagtgggcaaaggatatgaacagacacttctcaaaggaagacatttatgcagccaaaaaatacatgaaaaaatgctcatcatcactggccatcagagaaatgtaaatcaaaaccacagtgagataccatctcacgccagttagaatggcaatcattaaaaaggaaacaacaggtgctggagaggatgtggagaaataggaacacttttacactgttggttggacggtaaactagttcaaccattgtggaagtcagtgtgacaattcctcagggatctagaactagaaataccatttgacccagcaatcccattactgggtatatacccaaaggattataaatcatgctgctataaagacacaggcacacgtatgtttattgtggcactattcacaatagcaaggacttggaaccaactgaaatgtccatcaatgatggactggattaagaaaatgtggcacatatacaccatagaatactatgcagccataaaaaattatgagttcatgtgctttgtagggacacggatgaagctggaaactatcattctcagcaaactatcacaaggaccgaaaaccaaacactgcatgttctcactcataggtgggaattgaacaatgaggacacatggacataggaaggggaacatcacacactggggactgttgtggggtgggggaagggaggagggatagcattaggagatatacctaatgctaaatgacaagctaatgggtgcggcacaccaacatggcaaatgtatacatatgtaacaaacttgcaagttgtgtacatgtaccctaaaacttatagtataataataataacaataaaagtgttttctaaatatttagaaatttctgttttaacttagtatttttgtattaatttactagaatattttatcacaccctctcagctgagcacattactagcttgtaattggagaatatgagcaagattcatattatttatttatttatttttatttttttgagacagagtgtcactttgtcacccaggctagagtgcagtggtgcgatctgggctcactgtaagctccacctcccagattcatgccattctcctgcctcagcctcccgagtagctgggactacaggtgcctgccaccatgtgtggctgattttttgtattttttagtaggtacagggtttcactatgttagccaggatggtctcaatcttctgaccttgtgatccacccaccttggcctcccaaagtgctgggattagaggcgtgagccaccacacccggtctcatgttatttatttttaataaaacaggtattgttgtctccaagccagacctgatcatctgtctggagcaaggaaaaatcctttgagtatgaggagacatgagatgattgccaaacacccaggtgggtgcaagtgaaagtgaatacaacagacgacacaggtaagagatcccaaggtgaaagagaaagccagtacttaaaatgtgatttgggaagctgtgttccaaaggaaatagttcctgggcggttgttttataatttttctctcacaaagggacatctgctgtcttatgctttcaaattctctaaggattctacttttctttcagtgagcttccttcaagttcacagtgaaagccaaagtcttcttcatggcatataagacactgcacaatcttgctgcttttacattgttttgatgacacaaaattatctgcatgattttaagaaactaaaactattctcaaagttctctttttgcattttgaaatgtgcgagagtagtagtttctgttgaatttttttcattattctgcacatttccattctgtttttattactatatagtgttgaaatatagttggaaagtataagtatgatatccttctgctctgttcttttcatcaagattgctttggctaatcagtttattttagtttcatgtaaattttagaattgtatttttcattactgaaaaagacaccactgcaattttaataggaagtttattgaatctatagatcactttagataatatggaactctaataatatttattctttcaatccatagacataaaatactttataatttatttggaacttctctaatttctttcactgattttttttggtaaaggtttttcatttcattggttaatttttttctcagaaattatttaatgctataacaaataagatttttttgtcctatttttatcagatagtttgatttaagtgtataaaaccgtacatatacttgtatgttagtttcatattttgtaatttactgagtgtatttattagtttagataggatttaatgtactgtttattagtttttaaatataatattgtatgatctacaagcaaaaactttttagttttcttaaattttaatggatttttttttatttctttgagtaaatcttctgccacatacttccagtgttacactaaaatagaagcattcacaatgggcacaatatagttttgcattggtgtctgaatttgatggagcaaagacctattcaagttttcataaactgatttcagaaggtaaatatcttcttctgttggacccttagggtgatgagatgccctctgaatttgtagtgaagaagggttgtagcttggtcaccaggctgctgggtctgcattagggtccacctttagttggcttgttacaggggcttgggttgttataattcccattttatttttggacagactgaatatccttcagagctttgctccataaggcagacactagggcatgtttttgcaattggctctgcatatggtgggccttgtatcaggatgtggatgggtgtggctttcagtgagtaccagagagcatttcctcaggtaaccgtgtgggttactatataggcagaactgaccataaactgtggctcaggtaactgaaactgagtcatggaactgcctcagtgaccccagtaaaggccaaggtctgcatgcctggatgcatgactgtaaatgggcaccttcctccaagtctctggaatagcaggacctctgtcagactgtggctgggaggagtttgggatggttacagagtaagtttagaattctcaatggaaccaagttgggtgaaccctatcctggtctgtagctaaaacaggggtcctgtagtatcccacgtgagtgagggcctgccttctgaatagaacacttctcaaacataagctttaacagcatttcacaactgcatccctggatgtcaaatctctcttagaggtacttattttggagatggtgtcttgctacataacccaggctggtctcaaaatcctggcctgaactagttctccaaccttaacgtaccatgtagctgtcattacaggtgtaagccataatcctggttctctcataaaggcatttttgtcaggggtggctgactttttatgccataagggaatatgaaaatagggcacttttaatcttttcatcttactgatgtcactgtccttttacatttttactttttattttctatttcaaatttgtctataattttggattcagtcatttagcacatatgctagaatttgcatggtatacctgaagtaaatgagatattagtaggcaccccatatttactaaaatagttacttataaatttatgtttgctccgggcaaaaaggaattataggattttcgtctactattttcagcctatatctaaataataacatagttcatttcctaatatttgttttacatatcagaggatctaaccctattctacaaaatatatatatatttttctatatttaacaatggaaggttattatttgcttttaaagttggaatacagcagtttcattttgtgtaagaatagcatatatttaaaacaaaaagcaactctagtttcttttaaatgctaatttattaaaagtttgtcattggagtcttctatttataattatactgcatattttctgaaattttagtgccacacagtgcatgccaatgattcaaaatacaggtatatgatgattacatagtagcagttgaatatcacagttacctacacaatttttttttttttttttttttttttgagaaagagttacctctcttacccaggctggagtgcaatagtgtgatcttggctcactgcaaccttcatctcctgggttcaagcaattctcatgcctcagcctcccaagtagctgggattacagggatgtgccactatgcctggctaatttttgtatttttagtagattttgggtttcaccacattggctaggctgcttttaaactcctcacctcaggtaatctgcccccctctgcctcccaaagtgctgagattacaggcatgagccactgcacctgcctgacaatttttttttgatgatacatcaatgtggcataccagattttgtgagtaaatatttctcttattattgttttgaagttctgtgtatcaggggtcccgcccccaatatttcaatgtatgttctttctattttccataagtgtcagctggttgaaaaataaagagaaagagtacaaagagaggaattttacagctgggccaccaggggtgatatcacatatcggtaggaccacgatgcccacctgaaccttaaaaccagcaagtttttattaaggattttaaaaggggagggagtgtatgaacagggagtaggtcacgtgcttcaaggggcaaaaagcagaacaaagatcacatgcttctaaaacaggaccagagcaaaatcagaactcctgataagggtctatgttcagcagtgcacgtattgtcttaataaacatcttaacagaaaaaaagggttcgagagcagagaactggtctgaccaaaaatttaccagggtgtagtttcccaatcctagtaatcctgagggtactgcgggagaccagggcatatctcagtcattatctcaaccacataggacagacattcccagagtggccattcatagacctccccccaggaatgaattcctttcccagagtattaatatcagtattccttgctaggaaaagaatttagtgatatcttccctacttgcacacccatttataggctctctgcaagaagaaaaatatggctctttttgcccaaccccacaggcagtcagaccttatggttgtcttcccttgttccctaaaaatcgctgttattctgttttcaaggtgcactgattgcatattgttcaaacatacatgttttacaatcaatttgtacagttaacacaattatcatactggtcctgaggtgatgtacatcctcagctaatgaagataacaggattaagagattaaaataaagacaggcataagaaattatgaacatattatttgggaagtgatagatgtccatattaaaatgaaatcttcacaatttatgttcctctgctgcgactccagctggtccctctgtttggcatccctgacttcccacaatatctctccctttctttttatataaatgtaccaacatcgcatgcaatgttcaagagtcactagctgatctccaagccaaagtatagattgtcttaaatcattaatttgattagataatttttgatcaatgccttgttgagaattccacatttggttggaatttgcttgccaaagattaacaaaatgggccgtttgaatagattggtgtaatgccactccggcagtagtggccagtgcagtgactataaataggcccatgatcacagtgattaaagtgaaaacaaatctcttagattttttgagaattctttgtaacacttcattcattaaatgtactgagagggaagattcccagtgtctgggtaaagttaccgaatccagattccttctcgagctcgaagccacattacacttctcctggagtcaaaatgggagttaacacaagtgtataaatgacaattaatgcattggacagtttgtgtgtccaaattttgatatttcccactaacagcacgtaaggaggcttaacacaactttgtataggaatagtcaggctggaggtaaacaaagcagaacattgatactgagggagagtagaggtggtggcaacgcccaatgttgtctgccataaagaagcaatccgaggtgcccagggatgctgaggaagtagaggggcatacctgggtcaagaagaattatcataatgccaattggagtcccataaaggaggatcagcatcaaaaagaggaaaagggttcaaaggggatttatcatggggttcagagtcatggatgcaaggggcagtagtggggataacagacagaaaagtttacccttcccatactcacagtccagacatggcaatagccaatttccaaagttctgagtgttccaggctcagaatggggaatatcatatgaggcctcggaggggtaatgcccttatcttcccattttaagggaaagaatgagctgaacttcctatgtaaagtagaacgatgatcctcgtcctcccaataagaaataaaataagtagcctccaggcattcccttccaccagaggagcaattgttttttaaatagccctttggtgcccatcctattactaaaccatatgcgtcattttttagtactactacatgtgagttaacacagtcttcccaaattaaaattttagatgggccctcaaaatttttaggacatggttttcctacaggtttatattgaaagtttggggtatctcctattactccccctttcatttgtcttaaaggagaaagagagaggctggagatcaaatgtccctgttctcttgtagctaatctctccggaagataagcagcccagatttgagcttgtagatgaatacaaccatctacatgtgcatgtccaaggcacagaggagggtatttataacccatggtaacattaaattcagtgctttcttctcctggttgagtggggcaatggtcatctgtagctccatgtatccacacactatcattagtatagatttctgcaggagcattcatccaggtgagaggtcgaataagtggaagaaaaggcacataagcccaataagaataattttgtgtagcaggtaaatcattttgaggggaaactgatgagacagaaagtttaagaagaattattaaataaaacctattgtaagcaagatcctgtgctgaaggaggaagagaagaacagagggatgttattttcaggctaatagaaatggtgagatttttaggtttagaagtggcattaattagaggggtctccgttgccattagggaggattgaaccagacccattttgatttggcatgccagtttttgagaagtcggcagagatctcaccaggtatgaaggcggtctctgacttggatgtcttttccctgtggctttctttgtcactattcacacgaagtttgagtctctcagtgggcacccagacaggggattgatctcctggtgaaacacaagcataccctcttccccatgttataattgttccaggttcccaggtattggtttgggagtttttccgtaacactggcttgccttcatttagggagaattttttgcctgtataatggcattcagctgcagtcagagttgtctttaggaacatttagaaagtttaaagtaaacaatgctaaatgtaattgggagtggggagtggttaaattatgcttttgttgctcagactgtttggacaattgagtttttaaagtgcaattggcctgttccaccacagtctgtccctgaggattgtaagggattccggtagtatgggaaattccccttgttgcataaataaatcaaaagacttacatatccaggggtgttgtctgtttttatctgacatggaagccccataactacaaagcaagaatacttatgtcttttaacatgggcagtgccttcccctgtttggcaagtagcccagataaagcctgaaaagatgtctacagaaacatgcatatatgaaagtctgccaaaggagctaacatgagtcacatgcatttgccataagtcattaggagttaggcctctgggattaatgccagattcctgatttggaagtacaaaaacttggcactgagggcagcagtggataataagcttagcctctttccaggtgagagcaaatttatattttaatccagtagcattgacatgagtgagattatggaactctgagcttcttggtttgcaaaagagaccggtcaaccttttgattaccagcaggcatgggtcccagtaaagtggtatgagatctgatatgtgtagtatagaaagggtgtctacactggcgaaccacctgttgtaaacttgaaaataaaaaaagccaattcagaattatcaatatgtttgatagtagcgatttctatatttttagtggcatgtacaacataaacagaatcagagacaatatttaacagtttggggaaatcctgtaaggcaataattacagcaattaactctgccttttgagcagatgtgtgaggcgtagaaataagcttgtctgcaggacacagataaccagcatttccgttactggagccatcagtgaacactgtaacagcctcaggaatgggctgatctttggtctattgagggaccacccaataagtcatttttataaaatcaaacaatttttttgataatgattgacaataacacagataaaatcagtcaagtgaatttgccacagtatggaatgttgaaaagcagcctgaactttaagccgatttaaaggaaccacaatagatttggatcaaatccagaaattttaagtgatctacaccaagcttgtccaattagattggctatttggtccagataaacagacaaagtttttgacacagaatgaggaagaaaacaccactccactaaatcattatgttgaacaattagcccagtaggggagtgcaatgaagcaaaaaccagaagctgaaaaggctgagatggctgtaccctagacaacagggcagtttggattctttcttccatgaattaccgttccagtgaagcctcaggggtcaaagtcctgagactgtggagattggaatctccacacagtatagaaaacaagttagacagtgcatattttggaatgcctaaggtagatcttaaataattaatgttacccaaaagtttttggaaatcatttaaggttttcaaagaatctctcttaatctgaactttttgaggttgaatatattctttattgaccaccattcctaaatattgagcaggagtggtcttttgaattttatcttgagtgatgtgtaatccagcctcagtgacatggtggctcaaaaattgataacagtcaattaattctttatcagtgggggcagcaattaatatatcatcaatataatgaagaatataggcctggggaaattgagctcacactggtgaaagcacccatccaacataaagctggcagatggtagggctattcagcattccctgaggaagtactctccattgataatgagctacaggctcctgattattgatagatggtacagtaaaggcaaatttttcacaatccaatttatgtaaagcaataaaaatactttaagatcaataactatgagaggaaattcttaggtattaaagcaggggcaggcatgccaggttggatggctcccataggtttaattacagcattaatggaccttaaatcagttaccatccaccacttgcctgatttcttttttactagaaacacaggagaactccagggggaaagagaagattccacatttccaagttgtaactgttcagaaaccaattgagttgaagcctccagttttttttagagagtggccactgatcaatccaaacaggtgttttagattttcattgtaaaggaataggattaggaggcatggcagtggccgccattaaaaaggagaacctaaaccagcgctgtcttcttttacagtaacttgaagaggtttagcaattccttcatgttttggactgaaaccgagtctgggaacaaaccccatgttttccattatatgttgactgggagcactataagagttatgctgaatattaatttcagctcccccttgtgccaacaaatctctaccccaaagattaatggggattggcatgatataaggctgaattgcacccttttgaccatcagggccaatgcaaggcaagataaatgtgctctggtgaacttcatcagcttttccaacacctactagtcccatgttagtgggatgtttaagtcaagaggaaggccataaattagaggaaatattagaaatgtcagccccagtatctactaggccctcaaacttttttccttgaaggcgtatggtgcaggtgggccattgtttagaaattacgttaatcaaataagtggctttttcaccaccagagcccatcccagggccccgtgtcttatctcctttgtttaaacaatattaggtagtgaaagtaattgagcaattgactcactggccggaatggaaacaggaaccttggcagacaccataagtttaatctcatcagaggaatcagaattaatgagacaagtatgaactatgatacctttagcagaggtggataccctacatcctacataacaccaggcccaccgaaccttgagataaagggccagtgacccctctggggacaattaaaggcaaagaattaggtagtaaatttagaggaatggtaatacagagatcgacccccctgacccctactgtggaggtagacaagcactgtactgagatagaagaagaggatgggacccatctgggttggctgtaggtaaatttgtttgtgctgggggctacgttgggaccacttgaagtggaaatgcaacattggtctgagtctgaggtgtcccatttgatattggggtctgggactggccccacttcccatttccctggttctgtggcaagggatttgcatctatatcagacttagaggggcaagtacttgcccagtgtttatctttagacaacatgggcaaacagtagtaggagaatttgactgtgtttgttgagccagcttggctgcttttaagtttttaacaggctccaagaaaagaataagttgagacagtttgactgccatccttcatggcctgtgcccacagaatagctttgtgggtctctgatccaatgccttcccaagctttaatatatgcaggcaacacctcatgatcaggaaaattttgtctttggatggaacacatggcaattttacattcatggttcacattctcaaaagctaacatatgaaggagaataccttgagcatgctcatgagagacagatttttcaacagcatcttgtaatttagccaaaaaaatgagggtataattctgaccttgtttaacactagtaaatgaaacaggagcttggcctggggtgtgtaatttatcccaaactctcatacacaacttcgttacttgttccatggtgagagcatcaaagcctaattgaacgctagtgtcagagtaattatcagagcctgtgagctgagcctgagtaattagaatgccatcagcccaatttagttgagcctgcagacgggcctcctctgaccaccaggtacagaattgtaaatgctgagatgcagttagaacagcttttgccaaaaagtcccagtctaaaagaagcaaaatgacctcagtacaaagagtctgtaataccattttaacatatggagaactaggaccatactgaataaagagatccttgaattcttttaaaaaggtaagattgagcagtgcataccaaagcacttgtaccccttgagcatcaggaggttccagcatgaccggataagcctacatctctaatccacttgtttctttgttctggtgtaataagtgttgcattaaagtttcaagaacaggcacatgagacggagttggcatagaagtgacaggaaaagtatgtgcagataagagaaactgaggttgaggaggtcagactggtatgagagtgtgagaaaggggcattgggggagcacaagaggcagaagcatactggtgattattgtcccagtcctgtgcaactagagtggcaggagtgtccttgcatgaagaagcgtatagagaagcaggctgagtggatggcaaagtgactgattgagggaccaaaatgacaggagggtgaggagctgtggtggatgggggagggcctacagaattacaggtaaattatagtttggtcctggagccattaggggtctccggaggcaaagcctgcaaacgtttgaagagggaagagttagcatagatatggtcctggctgtccaagttggggccacgggagctacaagtaccggctcttcatgaaaagaaataagatcatcaggggagatgttaagccaaagtcactggagttagatattgaattctcaacattgtcaggtcagggaggagtaggcaaagggagaggctgagcagataatgaaggccgagtgggagaggaaagctgaggaagaggtagagggttgccagatttagaaaattgtggtaactgcaggggacacgggattggtatgtcattaggacaccaggtaccaagtcccaatcaccccaaacagtgatggcaacataatttcctgtcaggaccagttcccagaattttgcaccaacatgatcccatagttccacatctaacgttcccttttcaggaaaccaaggacagtattcttccactgccctgaatagggtgaccatattttccttgggcaccagaactccaccaagttttaacaggagtttaatatagcagagataagcaaaatgtttagactccatgtgacccatagttaccgcagacaatacacagacaactcaccaatcgtcagggagtcaaacaagcatttctgtggactggaccaatgaacattcctccacacctaccaaagggaatcaggttcccacatgcacttaggaaaaagaaaacaacattggcacaccagttattggggaaaaccacccccaatacttcaacatatgttctttctattttccataagtgtcggccggctgagaaataaagagaaagagtacaaagagaggaattttacagctgggacaccaggggtgacatcatatatcagtaggaccgtgatgcccacctgagccttaaaaccagcaagtttttattaaggattttaaaaggagagggggtgtatgaacagggagtaggtcgcatgcttcaaggggcaaaaagcagaacaaagatcacatgtttctaagggaacaggacaagggcaaaatcagaactcctgataagggtctatgttctgtagtgcatgtattttcttgataaacatcttaacagaaaacaggatttgagagcagagaaccggtctgaccaaaaatttaccagggtgtagtttcccaatcctagtaatcctgagggtactgtgggagatcagagcatatctcagtccttatctcaactgcataggacagacattcccaaagaggccatttatagacctccccccaggaatgaattcctttcccagagtattaatatcagtattccttgctaggaaaagaatttagtgatatcttccctacttgcacatccgtttataggctctctgcaagaagaaaaatatggctctttttgcccaaccccacaggcagtcagaccttatggttgtctttccttgttccctaaaaaccacgttattctgttctttttcaaggtgcactgattgcatattgttcaaacacacatgttttacaatcaatttgtactgttaacacaattatcatactggtcctggggtgatgtacagcctcagctaatgaagataacaggattaagagattaaaataaagctaggcataagaaattatggaggtattatttgggaagtgataaatgtccatattaaaatgaaatcttcacagtttatgttcctgtgctgcaactccagccggtccctccatttggggtccctgacttcccccaacgctatgttagtgagttttttcagggtaggttacttttttttttgttttgagataaagtctcgctctgtcacccaggctaaagtttactggcacaatctcaaatcactgcaacctctgccttccgagttcaacccattcttctgcctcagcctccaaagtagctgagaatacagatgcatgcaagcccagctaatttgtgcattattattgtagcaggacaagctgcagacaaaacccttcagacaccaagttagagaagaaagggctttattcggccaggagctttggcaagactcacgtctccaacaactgagctccccaagtgaggaattcctgtcccttttaagggcttgcaactctaatggggtccatgtgagagggctgtgatcaattgagcaagcaggggtatgtgactggaggctgcatgcactggtgattagaatggaacagaataggacagggatcttcacagtgcttttcttgtacaaataactgattaggtcagggttgtctgcttatggatttcatttctgctttttagtttttactgctttctttggaggcagaaattgggcataagacaatatgaggggtggtctcctccctattccccccctttgagaatctcagtagtgggagttctcactttcattctggctacccgtgtcttcttacaaggcagatcgatagtgattcaaatagtacacttgtgctgaaacattttggtgaactaaggtagcagtgaagctttttatcatttgaaaaagtacaggtagcaaacaagggagcagtaagcaggttcctattactattataactcttattataacagttttaaatgctcctagcactggaaaccattttctaaacttggcaccaggatcaaatccatgccacatttgcacaggcacatgtgccagttttgtcatatctctaactatgtcttcaattacttgcccttggtcatctatgtgtagacctcaattagtaaggttaaatttcccacagacccctccttcagctgctagtaagtagtcgagagccaatctatcttgataggtaggatttctcatctgagtttcttgccaggccagaatagtcaaggctctgccagttttattagtggttatttctaagacagcttgtaaccatatcatttggttgagcatgtaaatggggttgtagtatccccacgagccgtattgtgcccaagtagcaggcccataatattgtgtgattctctcagggagccattcatcatcttgccaattccctatggctatgcttctcttttcatgagaagcatagacagggaagccaggagttcacctgtctttatgggcaataggaagaaagattgtttaatagtgccaataacacaactacctgcccactggttgggtaatttggcataagctctatgcccacatatccagtataatccagtgggggctgtccagtcctggtgggactctgggtgggtctacacggtttgcaactttgggaatttactaaatggattcctttctgtgtgatttgaactgtaccaagtgactgtttttgtggtaccattatacaatttatgtcccagacaaataagttgtcctatgggatgagtgaattattttccttctctagctatgcaatattgtccaataattgaggcttttagggcccagaaattatcagggtgattcttttgagccaggaattcaacaggaactgggtctataggtactaatccttgggcttcccatggccaatgatctcccattacagttcctccacacacataacatgaagtgttattgagagactgggctatgtgctcagataattgcaaaaacaaatttcttgtttttctgggaatttttggtactggtacatttagttcatcataggaagtttgaaacactgtctcaggagagcgtttgtaaacttctcctcaaactaagatatttacttgaggatcccatccagacccgtcaattcctaaggtcacacactcctcttttttccagtgaggatcaaggggatttgttattactagctctgtggggttacattttcccttaatacaggaaaggctattttttccttcctgaaagtggactggatccttttcattttttatccaagttgcccaagtgacacaagaccaatatccacattcattgccacacaatcctaattcatgacaaatgtactttttttcagtcatatagcctttttcccaactaaaagagcgaccttgccttcctaacttattgctattaatgacagcactggcatcaaatctcaagattatgcgtttgggcacccctttttattctgttgtggtcaatactttacttgtatcatttatgagtccccaccagacttcagtccttaatctttgttaaaaaactgtggacatgggaggctcagaacggtcataacacacatctggccagtcttttcctgggctacataccttgtactgagtgccattatataagcatgttccttttaaagtccctagacattcatagtaactatagaacagaaagattgttttaacttgttgccctacctcggtaacctgatgtatacactgagagcagtcctccatgtggggaaaatcagtggaagtttttactatacaagcccaaattataaggaagatgagtcccacgatgatcctcctcatgctttggccgtgcatagaccagtcagcttctgggtgtgactggagcagggcttgtcgtcctcctcagagtcactttgtagggggtgtccgggctcggttttgcctcccaggtttcagcggctgcaggtttcacacagctgtggtggatccaggctgggattccttctacctttacagctgtgggggtggtcaggatgacggtctgaggtcctttccaccgtggcctcaaaggggctatgttgcagtctttgatccaaatgcaatcacctggagagaaaaggtgaactggggagaataagctgatgggacatctctcatttacccaagttgagattgtttgtgtaatttttcctaaagcctgtagctgtcactgtaattcaatttcacctaactctcagggaatgcctggaagcccccatagtataggaggaggtctatgatacagtatttcataaggggagtatcctgttttcttagaaggagtgcatctaattttaaacaataccataggaagggcctgtatccactttaatcctgcttcctgacatactttccctaaactatttttaatagtccgaatcattggctcgacctttccggaactctgaggtcggtaggtggcatgtagcttccaagtgattcctaatgcctttgctgtcttctgtaccaagtcagccacaaacactggcccattatctgagccgattcataagggcagtccaaacctaggaataagatctcagagaagcacacaggttaccttgggggccttttcagttctttttggataagcctccacccacccagagtaagtacacacaggaaccagcaaatacttgttacctgcacatttctgtgaaatccacctgaggatcctgaaaaggagctgctacataagcttgtatgccaggcagaacagtgagacattgcctcatattgtgctgtcggcaagtaacgcactgtttggtactgctttggcaagggctgggaagcgtgagatgtagaagtaccagcctaacaatttttcaaatgactcttgacctagatgagtggtttcatgcatggccaatacaattgtggctcccagcaactgcagcacagctactctcccatctggcagtctgatccatcctccttttattacttgcccccttctgtgtggaagaagtctttttctttcttaggtaggtaccaggtcaggtatttgagggagtaagggggctgctactgatgcctagtatggggtagatgctgcttttcgagcttctgagtcagctcgggagtttcctaaggccactgaggtggagcctcactggtattccctgcagtgcatgactgccaccttctgaggtttccacactgcctccaataattgtagaatttcttgttgatattttatgtcctttcccccagagtttaacaggcccttttccttatataatgctccatgcacttggagggttagaaaggcatgtctagagtcaatgtagatatttacagtcttaccttcactgagttctagagctcgagttaaagcagtgagctcagccttctgggctgaagtgccctgtggcaatggtttggtttcaatgacagcatccaaagttaccaccgcatattctgcacatctttctccttgtgggttgatgaagctactcccgtccaaatataactccaagtctactgatgcccatggctggtccctaaggtcaggtctgctagaataaactgagtccaacacctctacacagttatgctcgactgggctctctgatactgggagcagggtggtgggatttagggtgttacagacttcaatgtttatgtggggattttcacatagcaagctttggtacttggttaatctagcatttgttagccaatggtgtcctttggtgttcatcaaagttaccacagcatgggggcttttatattcagatttggcccaagggttagtttatctgcttcttgtgctaacagggctgttgctgccagggcccttacacatggtggccagcctttggagaccccatctagttgttttgagagataggccactggccttggccaggaccccacagtctgggttaaaactccaactgccattgtttctctttctgacacatagagtgcaaaaggctttgtcaaatctggtagtcccagggctgggaccaatgtaagtttttcctttaacttacaaaaggcttgctgttgtagaggcccccattcaaaaggctcccagttgcccccctttgtaatgccgtacaaaggtttggctagcactgcaaagtttggaatccataatgtgcaaaaccccacagctcccaggaattcccttacttgccttctggttttaggttccggtaggctgcagatgacctgctttctttctgaccacaggctgtgctcccctttccaaatagtgaatcccaggtagcgtacctgctgtctgcagatctgagatttcttcttgggcaccttatacccacagtcctccaggtgctgaaacagggcatcaacccttttgagcacccaactgccatggagtgtcccagcagaaggtcatccacgtacaggagcaagacatagcttaggtctttagcaggaaacttttgcaagtctcaagtcagagcctccccgaagatagtaagggagttcttgaacccttggggaagccagttccaagtgtactgagtagtgacacctgactgtagatcttcccaccgaaacgcaaacagcttctggctctcaggagctattctgatgctacagatggcatcttttaagtccagatgggtaaaccagatgtcctcagccggcagcagccctaacaacgtgtaagggttaggaactgttgggtgcagagtcactgtagcttggttgaccaagcgcaagtcctgtactggttggtagtccttggtccctggcttagggactggcaggaggggggtgttccatggacactggcaaagaactataattccataggctttgaagcacctgagatgaacccggattccttcgagagcttccctgggaagggatactgctttcatctaatcagttgggcccaggcttaacttctatgagtatgggggcttggttggccgccagtcctggaggattatcctctgtccattctcaagaccaacgctcagctagagctggttgtatctcttcccattcttcttcccaggggactgtaaggacaatgataactcctgttcccagtaactttagctgtaaagagccgtgttttgtaaaggagatggtggctgtcagcttgctaagcaagtctcttcccagcaagggcaaggaacagccaggcatgtacaagaactggtgaactacttcatgtcttgccaccgagtaggtccgtggcagacagtaagtctacttagtagaaactcctgttgctcggattatatcaatggttttcttggacaagggggtgaccggggtggtcaataccaaatgttcaacacctgtatcaaccaaaaacttaatatctttgcccccaattgtaatcctgaccgtgggctccttgggggtgattgagcccagtccccttcagtccaatagcccttcagccagattgaataaagctccctcatctttatctgaggtcttttgttctgaatcatgttgcttttccttcagttggggacacttatttttccaatgtcccattttcttacaataggcgcattggttacattgcaagcgtgggtgattagacagggtattattcccagaacccccctttccctctccttttgggggaattcccctgatggccacagccagtaagttggcgtttcgcctggcctggctttcaccttccttacggctttctctgtggcttgttgcatctctattcaaacacttgattggctatttccagtaactgtgagatattcatacacttaagcccagcctgtttctgcagttttctcctgatatcttccacgctttgactaactaaggccatgttgatcatgtgctgattttcagggctatctggatcaaaatgagtgtacatactgtaagcctcacaccgtctttcatagaattgcgctggactctcctctttttcttggatgacctcagagatcttatttacacttgtagccttttaagcccctttctttagaccttctattcatgcatcatggtactgtcttagcctctccatgtctggtcactagttcaggtcccattgggggtctgttcctggcagctgaattcttatatattcttggggattttggtaatccactgggatgtgctcctctggccacttagttgccacccggagcacccttagcctttcatcaaagaggtacatgaacagctggtggcaatcagcccaagtaggattatgagtgtgtataatagtttggagcaagtcaattaaagcttgaggcttttcagtgtaagcagcagtattatttttccaattgatgaggtcagcagaggtgaaaggttgatacacaaagtcacgcctttccaccatgtgtccatcctcatctaccccagtatatcactgctgtctcaggggcatttggattccagtcttgggccgtaagtgagctgccaagggaggagtttctcccgtggcttcacttcctcttttgtctactctgggtggtctaggagtgtggctatctggtggaggtgtgggtgctgtgggctcaggagtgggaagcccttcctcttgcaattctgaccatgattcttctggtattgggtcagacagggcttttggtgccggcttccctcagcaggtggagtgagaaccttccttaactaactgtccctttgctactagtactgctgctgcctgtcctcttaactactgtggggggtccaaaactagctctaaccgagaatctttatacaggaactgatcggggtgccctggcttgtaggttacactgtgccataccttcaatacaagggacctgttcaggcttccttctgatggccaacccacctttaatgctggccagtctaactcacacaaagttctaagttttcttggtgtcatagtaactccatagtctcccttaaatccctttttgaaatttttcaacatagctcctagtggggtgggcctactttgtgcctgacccatgtttcctcgagacaaaacactgcgcttacaccacatgcacaccacaaaacaaaaacaggtaaaaagggcacacacacactttttcagtttacaccaaaccagaatcagaaccaaaatcagagtatcaagaaatccaagccaggtcaaaaccaaaacctaagtatcaagcaattcaactcaactcaaaaacaaaaaacctaagtgctggtatgggcacgtcatgggtgatcaggccacgcttccactcaaatggagtaggcaagttccaaagactagtcttaccaagtttcagatgtctggattccaagtgccagttccttcctgatgttcagccactgcagtgatcctccatgggggcctgccacacactgctctggtgaggcattccactggcgcagttgcctacccgggagcactctcaggatccgcgttgctcaagctggccagagtcccctgcagggatgcttcacagggcaggcctaagctgcctaagtggctgtctcaatggtcctttaatcacctgcttcccagtcagggaaccaagaaatgtagcaggacaagctgcagacaaaacccctcagacaccaagttaaagaaggaagggctttattaggccgggagctttggcaagactcacatctccaacaaccaagctccccaagtgagcaattcctgtcccttttaaggggtcacaactctaagggggtctgcatgagagggtcatgatcaattgaacaagcagggggtacatgactgggggctgcatgcactggtaattagaacagaacagaacaagacagggatcttcacagtgcttttcttatacaaataaccaattaggtcaggggtcgatctttaactaccaggcccaggttttggtgccaggctgtctgcttgtggatttcatttctgccttttagtttttacttcttctttctttggaagcagaaattgggcataagataatatgaggggtggtctcctcccttattattagagaccacatttcaccatattggccaggctggtcttgaactcctgtcctcggtgatctgcctgccttggcctcctaaagtgctgggagcacagtcttaagccaccgagcccagcctcagtgtaggtttcttaacatcagtttattgtgtttattgggtttacttacgtattataaatttagacaattttcaattctgcttgtactctttaagtcaacttgagtttcaactgaaaaataaataatgcatgtgtatcccaatcagattacatgtgtatgcattgtcacacatgtccatgtgaagagaccaccatacaggctttgtgtgagcaataaagctttttaatcacctgggtgcaggctggctgagtccgaaaagagagtcagcaaagggagataggggtggggccattttgtaggatttgggtaggtaatggaaaattacagtcaaagggggttgttctctggtgggcaggggtgggggtcacaaggtgctcagtgggggagctgctgagccaggagaaggaatttcacaaggtaatctcattagttaaggcagaaacaggccattttcacttcttttgtgattcttcagttacttcaggccatctgggtgtatatgtgcaggtcacagggtatatgatcgcttagcttcagctcagaggcctgagattcttgtcttcttatattaataagaaaaataacataaaatagtgttgaagtgttggggcagtgaaaattttggtggggtggtatggagagataatgggggatgtttctcagggccgcttcaagcaggattaggggtggcgtgggaacctagagtgggagatattaagctgaaagaagattttgtagtaagggcaatattgtggggctattaaaaagagcatttgtcatatagaatgattggtgatggcctggatgcagttttgtatgaattgagaaactaaaccaaagacacaaggtctgaataagagaaggagcaaaacaggtattaaaggactaagaattgggaggacccaggacatccaattagagagggtccaagggggttcagagtaattacttgtttggttggtgagttttggggctctattcttgacagagtcctttttgttaagttggaggctgagcttgctgaggtatgttctgaaaagaccattaatccattctacctttcctgaagattgaggacagtaaggggtatgaggtttcaatgaataccaagagcctgagaaactgcttgggtgatttgactagtaaaggctagtccattattagactgtatagaggtgggaaggccaaactgaggaattatgtctgacagaagggaagaaataacaatggtggccttctcagaccctgtcgggaaggcctctacccatccagtgaaagtgtccacccataccaaggagtgttttcatttcctgactcggggcatgtgagtaaagtcactttgccagtcctgggcaggggtaaatccccgagcttgatgtgtagggaagggagtgggcttgaataatccctgaggagtagtagaatagtagatggaacactgagaagtgatttccttggggatagatttccatgatggaaaggaaatgagaggttctaagaggcagtctagtggcttgtaacctacatggaagaagttatgaaatgactacagaatggaatgggtctgtgaggctggaatgagatattttccttggtccaagaatcatttgccttgtgtgggaagagattgataggtgaaagtttcagtgggggagtaggtgggagtgaccagataagaaggagaaaaactgccatgagggatagaagttggaatgctagctgctttttagctaccttatcagcataagcattgtcctaagtgatgggatctgatgccttttgatggctggttttttagctaccttatcagcataagcattgtcttaagcgatggggtctgatgccttttggtggcctttgcagtgaatgactccatcttcctttggaagtaaagccgccttgacaagagtttttattaaagaggcattaataatggaggacacttgtatagtgagaaaacatttttcagcctatataacagcatgggggtgcaggatatggaaagcatgtttagagtcagtataaatattgatgcatagtccctttgcaagattgagggcctgagttaaggcaacaagtttggcttgctgagaggtagcacagaggggcagagcggtagcctcaatgatagacatggaagatactatagcatagcctgcctttgctggtgagtggcaattaggcctggtggaactgccatcaataaaccaagtgtgatcagggttaggaacaggaaagaaggaaatatgaggaaatggagtgaatgtcaggtggatcagagcgatacagtcatgtgggccagttgtggtatcaggaataatgtgggggccagcctaaaacagtaaggtcaagttgtttggacagaaaggctacacagtgcagtcccagctcttgtgtaagaattttgaccacacagccctgtacttcggctgcatgtaatgaaaagggttgcgatgagttaaggagagctagtgtgggagtagcttctagggctgcttttaaggaatggaaagaggagtggtgaaaggatttaggatctgtggggtcagctaggtttgctttttgagtttatacaatggtttagtcaggatggtaaaactagatatccaaaggcagaagtacctaaccatgactaggagggaaaggagttgttgttttctagaaggggttggggtttgggagattagctggacacaatcggtagggagagcacatgtgttttcatgaagaattatgccgagataggtaatggatgagaaagaaatttgggcttgactgaggtaatgggagctgtctgtgaagccttgcagcagtacagcccaggtaatttgctgagcctaatgggtgtcagcatcagtccaagtgaaagagaagagaggctgggatgaagggtgcgaagaaatagtaaagaaagcatgtttgagattcagaacagactaatgggttatggaggggttgtggagggaggtattgaggataggaaagtatatggttttgacaccaatgggtggataggcaagacaattggttgataaggtacagatcctgaaataacctgtaagtcttgtctgggttttggacaggtaaaatgggggaattgtaaggagagtttataggctttaaaaggccatgctgtaacaggcaggtgataacgggctttaatcctttggggtaagggtgattaggttttaatgggatggtaagaggtgcatgaattgtcaccaaggagggagtagaggtgtcctatacttgtggattaaaatggggagatacaaggggaggatgtgaaggaggctttgaactggggaaaaggatggcaatgaggtgtggctgtagcctaggaatagtcagggaagcagataatttagttaaaatgtcttgacctaataagggagctgggcaggtggggataactaaaaaggagtgcgtaaaagaatgtggtccaagctggcatcagagttggggagttttaagaggtttagaagcctggctgtcaatatccacaacagttatggaggcaagagaaacacgcccttgaaaagaaggtaatgtggggtgggtagcctccgtattgattaagaagggtatggactcactttccactgtaagagttacctaaagcatctgtgatggtccaggaggcttctgaggtgattaggcagtgtcagtcttcagccgctaagccaagaatatctgggaaggagtcagtcagagagccttgggctagagttccaggggctctaggagtggctgccaggcgagctggacagtctgattcccagtggggtcccgcacagatgggacatggcttaggaggaatcctgggctgcaggcattccttggcccagtggccagatttctggcacttgaagcaagatcctgagggaggcggtcctgtaggaatgcctgaccactgtggcttaggcattttgaagttcttgtgtgctggaggtgtggctgggttttgtctcatagcagaggcaagtaatttttactcttctctattattgtacaccttgaaggcaaggttaattaagtcctattgtggggtttgagggcaagaatctaatttttggagcttttctaatgttgggagtgggttgggtaataaaatacatattgagaataagacggccttctgccctttctgggtctagggcggtaaaccatctaaagttgttgccaaatgggccatgaactgggttgagtttctatatttgatgaaaaagagcctaaatgctaactgatttgggaaaggtcagataaagaaaaaggagtgttaaccttggctatggcttcagctccagccacctttttaagaggaaattgttgggcaagtgggagagggctagtcatggaatgaaactgtaagccagaccgggtgtgaggaggggaggtgataaaaggattatagggtgggggaacggaggctgatgaagaactgggacctggcttggcctggcgaggagcagcttggggaggagaggacaggtgggtctgtagaaaaggaagattgaaaagactcagtgatgcttggggttgggactgaagggacaggtgggagggaaagaaggaggatttgtgatgagtcgcattgggaacagagattagggagggaccaatgtgtaaaagaatgcctggacatcaggcatctcacaccatttgtcttttttgacaaaaatcatccaggtcttgtaaaatggaggaatcaaaagtgccattttctggctatttagaaccattatagagtttgtattggggccaagtggtgttgcagaagaaaataagatgcttaggttttaggtcaggtgagagttgaagaggttttaagtttttaagaacacaggctaagggagaagatgcaggaatggaggtcagaatgttgcccatagtgaaggatgtaagtttaaggagaaaggtagagacatggagaagagggtggtgagcagccctgggctgcaatatgggtgagcatccaaagcaggtgtccccgcaattaacttgccaccaagggaatgtgggtgaatgaccaaggcagatgtccccacggtgatcagacgccaatgaaatgtgggtgaataatcaggcaggcatccccacagtgattaaacaccaagggaaaactgtcttcctgagtctaagactggcaccggagttttgggtccacggataaaatgtgtctcctttgtctgtactagagaggaaaaagaactggagttggaaggacagggagattgaagggtagcaagagaggctggagaagagagtgaaaagaccgcttacccgatttgaaattggtgagatgttccttggactggttggtctgaggacccgaggtcataggtagatttcctcacggagtgagggcggggacaggcctcccgaaggattacctctgtcctgggtttttggcaccaaatgtcatgcgtgtccatgtgaagagcccaccaaacaggcttcgtgtgaacaataaagctttttaattacctgggtgcaggcaggctgagtccaaaaagagagcgaagggaaataggggtggggccattttataagatttgggtaggtaatggaaaattaccgtcaaagggggttgttctctggtgggcaggggcgggggtcacaagatgctcagtgggggagcttctgagccagaaggaatttcacaaggtaatgtcatcagttaaggcaggaacaggccattttcacttcttttgtgattcttcagttacttcaggccatctggatgtatacatgcaagtcacagtggatatgatcgcttagcttgggctcagaggcctgacatgcgtgtttatctataaatacgatgccaattttacttatggcttatctcatattctttgttagctgattttcgatggtagttttatcttgtctaagtgagtagtcgtggagatagtcattatcacgatgtgtttaatgatgaatatatattttctttttgtgagagaaacacttttgtgatttgaagttaatttttaaaaagatttaccattctgtatttttgtcagtttttccttgaaaacgttgttttaaaaacacataacataaaatttaccatcttaaatttattgaagtgtatatttcacagccagctgtggttgtggctctcatctgtaatcccagaattttgggaggtcaagacaggaggatatctggagctgaaaagtttgagaccagcctggggaatacatggagacccctctccataaaaaaaaacttaatagtagccaggtatggtggtgtgcagctgtggtcccagctacatgggagattgaggaggagtcaaaattgtgcctctacactccagcttgggtgacagagtgagaccctgtctcaaaaaaaaaaaaaaaaaaatgctgttcacttcaggcatgttaagtatattcacattgttgtgcaaaagatttctagaaactttacatattgcaaaactaaaactcagtaaccattaagtaacaacatctcattttaccctctctccagcttttggcagacaaaacttccactttttgtttttatgattttgactacttaagatatctcatataagtggaatcatacggtatccataattttgttactggattaattcaactgacataatattctcaatgttcatcttaaaatgtgacaagattgttctttttaaggtggaataatattccatcgcatgtatatgttacattttttgatacgtttataaatcaaggaacatctaggttgcttcagacttttggcttttgtgaatactggtataataaagatgaattttcaaatatgcctcccaggtccagtgttgcattttttttttttttttttttcccgcagacggagtattgctttgtcgcctaggctggagtgcagtggtgtgatcttggttaactgcaacttctgcctcctgggttcaatcgattctcctgcttcagcctttcgagtagctgggattatagatacccaccaccacacccagctaattttttgtacttttagtagagatggggccaggctggtctcaaactcctgacctcaggtgatctgccccctcagcctcctaaattactaggattataggcttgagccactgtgcctggccttcgttacatattttggatatagatttataaatgaggaacatttataatttttaaaataatggctgcatctttgttttccaccaacattcaatatggatttcatttttattgtatcatcaacagatttggtgttttaaaaaaatttatcatggccatattaatgggtatgaggtgattttgtttgtcattgtggtttttttttcatttctttacaaattagtaattttatgtgtcctttcaaatgctttttctcatttgtgtacttttctaatgaaaatgttgtttgtccgtttctaaatcaagttattcaaccttattttttagttttaagagttgtttatatattttgaatattaacttctttcatgtttaatttgcaaatgttttcacctattttctaagggatgtcattactcttgaattgttttttggtatgaagaaattttgaagcctattgtagttaaaacttttctgttatttcatttgctgctcatgtatttaattttgtatctaagaaaatggtgccaaggccaatgtcatgtctttttcctgtagtttttctaaaagatttgttagtttttttatgtctcagcattttatttaaaatatatttttgtatcattctaggaaataatccaacttaattttatcagtgctgatattcagttttcaacatcatttttttgaagagattatttctattttgtgctcatggcaacttcgtggaagatcatttgatcatatacagaaggattcatttctgagctctctattctgttctttcatctgttcatctttgtttctgtatcacattgtttatattctttagcttttaactgtaggttgtattgacatctttgaaaaataacattttttgacccctgagcaagaatatgttgatgaagagtgtgtttcatattcacaaggttttgaatttgccagtttgacttttgcttttaattcctagtttcattcagcttttgttggaaaacacacagtgtataattttagtgtttttaaagtgatttgttgttgttgttttgagacaagatcttactgtcaccaggctgcaatgctgtggcataactttggctcactgtagcctcagtctcctgggcttgaatgatgctttcacctcacttttctgagtggctaggactacagtcatgcactaccatgtctggctaattgtttgcttctttgtagtgttaggatctcactatgttgcccaggctggtctcatacttctggcaccaatggatcctcttaccttggtctctcaaagtgttaggattataggcaagagccactgcacccagtcagtattttaaaatttaataaaacttgctatgtgtcctaacggaatacaccagatgcaaatagaaatattgcatattatcttggttttgactggagagttttgtgtgtgtctgtgaagcctagttggtctataatatggtttggatgtccatgttctccaaacctcatgctgcaaaataaatcctcaatgttggttgtgagacctggtgggacatgtttttgtatgagggcatatttctcatgaatggcttggtacatcctcttggtaaacaaaaagtttacactccattaattcaaatgagagctggttcattaaaagaacctggcttcttcacctcacacttgctctgtctcttaccatataatatgtccagttactttttaccttctaccatgattttaagcttcttgatatcctcaccagaagcagatgctgacacacacttcttatacagtctgccaaactgtgagccaaataaacattttcctttataaattatgcactcccatgtgttcctctatatgcaaaataactaatatagtctataatgttgtctcagttttctgtttcttattttttatctgaattctctatttatttcttcaaatggggccttgatgtctgcaattattatgtcgctatgtatgtcttgcttcacttttgtcaatatttgctttatatattttaaagcccttatgttatttacacatatacatatagatagataaatactataaattcctgctaaatcaactcactttaccataatataatatcaatcattgtctcatggtagtacttaaagcatattctgcccaatataattatgaccacctcactcacttgtggttactatattcatggaatatacatttttttattctgttactttcagcctatttgactcaatgattaaattagtctcttgtaggcagcatactgtatgctttataaaaaaccactcaggcattctatatctttttctttatataattttatatatatatatatacacacacacacatatatatatatacacaagtgtatgtatatatatatatgtgtgtgtgtatgtatatttttttccagatggagtttcactcttgttgcttagactggagtgcaatggtgtgaccccagttcactgcaacctctgcctctcaggttcaagcaattttcctgcctcagcctcccaagtaggtgggagtacaggcgcctgcaaccacacccaggtaattttttctattttaagtagaaatggggtttgaccatgatggccaggctggtcttgaattcctgatctcaggtggtctacctgcctcggcatcacaaagtgctggtattacaggcatgagccaccacatccagccttgtgtattttggagatagtgtctcactctgtcaaccaggctgatttgctcggttcactgctgcctgaatctcccaaactcagatgatcctctcatatcagcctctcaagtagctgcattacaagtatgtaacatcacacccagccaacttttttttttgtattctttgtcgagacagattattgccatgttgccgattctggtcttgaactcctgggatcaagtgatcagcctatcttggccttccaaagtcctgagattatatttcattttattaagtagtttaatacgtttaaatttaaaatgattccttaaagaaatgaagttgttatttccagatatattgttattgtttcatgtgtttctagtagtatatttttctcatttccttttttactctctttaattttgtactggcatgctttgattattttttgttttattttagatactttctttaaacagaatctttgcaatcatcttgaaaactgtagattacatacatcttacagttaaagcaatatattttaatctcatgacaacttcaattgaatacaaaaactgtgcctctatattttccagtttgttgttgatttttttttattaaaatgtgcatcattcttttatttttatttatttattttttattgatcattcttgggtgtttctcgcagagggggatttggcagggtcataggacaacagcggagggaaggtcagcaaacaaacaagtgaacaaaggtctctggttttcctaggcagagtgtttgtgtccctgggtacttgagattggggagtggtgatgactctcaacgagcatgctgccttcaagcatctgtttaacaaagcacatcttgcaccgcccttaatccatttaaccctgagtggacacagcacatgtttcagagagcacagggttggggttaaggtcatagatcaacaggatcccaaggcagaagaacttttcttagtacagaacaaaatgaaatgtctcccatgtctactactttctacacagacacagcaaccatccgatttctcaatcttttccccaccttgcccccttttctattccacaaaaccgccgttgtcatcatggcccgttctcaatgagctgttgggtacctcctcccagacggggtggtggccgggcagaggggctcctcacttcccagtaggggcggctgggcagaggcgcccctcacctcctggacagggcagctggccaggcggggggctgagccccccacctccctcccggacggggcggctggccgggccgggggctgagccccccacctccctcccggatggggcggctggccgggcgggagggctgagcccccccacctccctcccagacggggcggctggccgggcggggggctgaccccccccacctccctcccggacggggcggctggccgggcagaggggctcctcacttcccagtaggggcggccgggcagaggcacccctcacctcccggatggggcagctgaccgggcggggggctgacccccccacctccctcccagacagggcggctggccgggcagggggctgacccccccacctccctcccggacggggcggctggccgggcggggggctgacccccccacctccctcccggacgtggcggctggccgggcggggggctgacccccccacctccctcccggacggggcggctggccgggcagaggggctcctcacttcccagtaggggcagccgggcagaggcgcccctcacctcctggacggggcggctggccgggcggggggctgagccccccacctccctcccggatggggcagctggccgggcggggggctgaccccccacctccctcccggacggggcagctggccgggcggggggctgaccccccacctccctcccggacggggcgactggcctgacgggggctgaccccccacctccctcctgggcggggtggctgccgggcggagacgctcctcacttcccagatggggtggcagccgggtggaggggctcctcacttctcagatggggcggttgccaggcggagggtctcctcacttctcagatggggcggccgggcagagacgctcctcacctcccagacggggtcgtggccgggccgaggtgctcctcacatcccagacggggcggcggggcagaggcgctccccacatctcagacgatgggcagccgggcagagatgctcctcacttcctagatgggatggcggccgggcagagaccctcctcactttccagactgggcagccaggcagaggggctcctcacatcccagatgatgggcggccaggcagagatgctcctcacttcccagacggggtggcggccgggcagaggctgcaatctctgcactttggggggccaaggcaggcggctgggaggtggaggttgtagcgagccgagatcacaccactgcactccagcctgggcaccattgagcactgagttaacgagactccgtctgcaatcctggcacctcaggatgctgaggctggcggatcactcgcggttaggagctggagactagcccggccaacacagcaaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagcacagtccagctttggcttggcatgagagggagaccgtggaaaggggaggagagaggggagaggggagacgggagaggggagaggggaggggagaggggaggggagccggagtcactcttgttcgaacgcctccaacactatgactaagtaaaggagaatttctgttgttgattttaaaattattctatatggtgtatctattaacatttatgcggatttccatatttttatattctataaaagtactttaaaggttttgtgtaccatcattttgttagtttgttttgttttgttttgaatcgagtcttgccctattgcttaggacggagtgtatagatgtgatcttagctcactgaaacctcggcctcccaggttcaacaattatcctgcctctgcctccctagtagctgggattacagatgcctgccaccaagcctggctaatttcttgtattttttagtaaagataggctttcactatgttggacaggctggtcttgaactgctgacctcaggtgatccacctgcctcagcctctcaaagtgctgggcttacaggtgtgagccacagcacccagctggaaattactttttatctcactattcatagcatttcatatcaatacaaagattgacacatctagatataaatatacatagggagataaatactcacatagagaattctataaatatttctatctaaacatttatgtatacaaaacatgttccccaaaagacatttttaatcttttagcatgcactgaagatgctgatgtagaattacttcttttttcttttgctaaataacatgtcagaatggaacatagttatacaattttgtttatgtaaatatcaacaaagctctatcttcaaaggcaggccacagaaataagctgaaaagaaagtcatgtaacacatctgtccaggacagtatttcagcactctgcatgtctcctcattctgtgcatgttgtgttcacacctaccatttggggcctgtctcgacaaagccacagtcaccatttagataatttgataattgtatacacctgggctgagctacttggctggttgggatcacctgggctgtgcaaactggctgattgcaatcacctggtttctgctaatttgcttaatttatctcagcttcaggggtagaatacggagatgtcatctgacctactttatttctgaggttttttttaagggtcatatgcagaaataaacatttcatagacatacccatgtgactcattttgtgtgtatatgtttatcgagccacctattttgtatctatatgtacagaaagaagcctataaaataaacttgatctgaggctatttccattttctttacctacaggttaggtaaatcagtcagctactgagctcagtgaagatttattcaaaccaagccacacaccatattacattttttcataaatgtaaaaatatctttaataacctggaacctgggtgtttttaattctcatcccattaaaccagccccatgaggttctgttcgtctatctaggaactgccagaaatgcttgacatcagtgggctgagccttcctcacaaagcagatttgacctggcaaataagagccacctgtggcacttcagtgaatgttcactatcacccatttgaaatgtggccaagtaccatgtaccattatatttgcttccatcatcatcatcatctatcttctaaaaagagacctagacttctttttcattaccataaatacctgacttctgcctcaaagacaaaaagacaagagtgtgattttacatcacacactcttggaaataaatacagttcttgtcttgatgaaagttctaaagagaaagaataagtattctcatatttaggttaggacctttggactggggctggttcatctctgaccctacatacaacaataaaagaaaagtcaatcctgacatggcagtaaataactccaaaggccttagtaagtattcatcttccagaagcgcacaacaaagcccagtgcttcctttgaatatattaagtgcagcaggatgtatatcagagcattcctctatttctgtactattctagatatagtattctatagggaaaagatttttatacatgtatgaaaggtttttgtattactgtttgtagcaatagctatcaatacttccacattcaatgtctttattctgtatgaatatatataaagattgttccagcttcatatatatatacttatacatattaggtatgtatatgaatatacatacatggtagatacataaacacaaacatatgaatgtgtctttgtaaatattaatgtatacatataatattctcccactttttaaattatagagcgtatactaaggatgcaggtgtagaattaattgccttctgttttgctcagtagcatgtcagaataaaacatagccatacaatgttgtttatagaaacataaaggttcagcttcaggtttcaggccttgtaaagctgtgtggtatatactgtccaggtgagcaaataaggccctgcatttctttttggtgtgcatgggctatttacatttaccattttgggcatacctgaatgaatctgtagccactagttagataattagctgatcgggatcacctgggctgagctaattggctaattgaattcacctggactgatcagttggttgattggaatcacttgggctgagctaattcactgattgaaatcacctggactgagtgaatggtggttcaaaatcacctgtgctaaactaatgggctcatcagttgagctaactggctgattggtatcacctagaataagatagttggctgttagaaatcacctgggctaatcagccgggctgagctaatttgctgattggattctcctgggatgtgctaatgggctgcttggaatcccctaattggctgatttaaattatctaagctgagttaattgattcagaaaagttgaacactgagctgggccggtggctcatgtctgtaatcccagcaatttgggaggccgagtcaggcagatcatttgatgtcaggaatttgagaccagtctggccaatacagtgaaaccctatctctactaaaaatacataaattagccaggcttggttgtgggtgcctgtaataccaggtactggggaggctgaagcagcagaatcgctttaaccagggatgtggaggttgcagtgagccaagattgtgccattgcactccagcctgagcaagagtgaaactctgtctcaaaaaaagaaaaaatatctatctatctatctatctatctatctatctatctactgtcagaggatgataacttgaagtattttagagatgttaagaatctgaaattatttttacttttagtttttataaatgtttcttaagcatttttaatttccaaaaaacttgtaaataatgttgtcagtttaatttttctgaagaatttaaatagagtcaaattatacatatcaaaaaatctacttttctggtagtagatcagcttaattttcagaacaaatgtgttaaacttcacgagattttatgctgaccaatttgatcagtagcctctttcatacaactgggagagatgacaccaagatgtagcattcatgttgggtgagagactaaatgactaccagtagctagataatttctgttttactaataaatgtttattttcatttctatattgtctcaagttatgttaacaataaagtaataacctttatccaggaaattttgaaaacttattttttaatcagccataacagtaagcaaagacagagaaatgaaggtttttaccagtcataatttatatattaaaattaaaatacttctagaaataaagaaggaaaggaagaaagaaatatacaaacaaatgaaaagcagcctggtcaacatggtgaaagcctgcctctactaaaaatacaaaaattagcctggtgtggtggcatacacttgtaatctcagctactcaggaggcttaggcatgagaatcacttgaacctggtaggcagagtttgcagtgagctgagattgtaccactgcactccagcttgggtgacagaatgagactccatctcaaacaaaacaaaacaacaacaaaataaaagagaaggaaggaagttgattactcacaatagctaaggtttgaaatcaacctaagtgttcaccaataggtgaatggagaaagaaaatatggtatatatacacaatgaaatgctattcagcccttaaaaataagaaagtcttgctatttgcaacaacattcatgaacctgaaagatattatgttaagtaaaataagtcagcacagaaaaaaaacaaaatcctcgttttttttttttttgagatggaattttgcttttgtcacccaagctggagtgcagtggcaccatctccactcactgcaacctccagctcccaggttcaagagattctcctgcctcagcctcctcaggacctgggattacaggcatgtgccaccacacccagcaaatttttatatttttagtagagataggatttcccccatgttggccaggctagtctcaaactcctgacctcaactgatccacccacctcagcccctccaagtgttgggattacaggcgtcagtccctgtgcccagcccacataatcctatttctatgtaaagtgtaaaaaaaaaaaaaaaattaaactcatagaagcagatggtacaataataaaacaaacaaaaaatcccctataaggttttttgtctggttaagagagcttcttcaggatttttcaggggttatattttcttttattttccacattttcctgttcttcagccaatggatgaaaaaagatacagagaagacacatttaccttttatccgcttcacttccattcactattattcaatgtggatacagatgagagtagcagttttctagtaggacagccacttctctgcaataaacaaaaaactgaaaaaaaattagcatatgcatcagtaacccttctagtaaaataaagattaattttgttgatttctattgagttcctgtaatatttgatcaaaagctagcaaaagcacagtagaaaaggaaaattgttctaaataagaatattgtgaatggttattttgtcaatataagtaaaaatatgacctcacactaatagtctcacctatagttgtacaacatcaaatgctaatttttatttaaaattttatttcatataagtattcaatttatatcacctgcctctgctatttcaatgcctccttcactttatatcagtgaaaaacaggccagcaggtcctaggaaagcacgtcgtgctattgctactttaacaataaacaggtcaagcatggtggctcatgcctgtaatccagcactttgagaggccgaggtgggtagatcacagggtcaggagctcgagaccagcctggccaatatggtgaaacaccgtctctactaaaaatacaaaaattcccaggtgtggtggctcacgcctgtaatcccagcactttgggaggctgaggctggtggattgcttgaggtcatcagttcaagaccagcctgggcaacatggctaaacctcttctctactaaaaacacaaaaaattagctgtgcatggtggtgggtgcctgtaatcccagctacgcaggaggttgaggcaggagaatctcttgaacctgtgaggccaaggttgcagtgagccaggatcatgccactgtactagaccctaggcaacaaagtaagactcctctcaaaacaataaaatcagctgggcgtggtggcgggtgcctgtagtcccagctactagggaggctgaggcaggagaatcgcttaaacccgaaagccagaggttgcagtgatctgagatcataacactgcactccagcctgggtgacatagcgagactctgtctcaaaaaacaaaaaacaaaaactgatcatgaatagcacttttttggttgctacacacgtgtcaaacactgttatttggcttaaggtactggtttttttttttttctttttcttttttgagatggagttttgctcttgttgcccaggctggagtacaatggcacaatctcatctcactgcagcctctgcccacaaggttcacacaactcttctgcctcagcctccccagtagctgggattacaggcacctgcaaccacacctggctaatttcttgtatttttagtagagatggggtttcaccatgttggtcaggctggtctcgaactccagacctcaggtgatccacccgcctcggcctcccaaaatgctgacattacaggcgcgagccaccacattcagcctggttttctattttttttttttttttttttttttgagacagagtctcatctgtcgcccaggctggagtgcaatggcatgatctcggctcactgcagtctcttcctcctgggttcaagtgattcttctgcctcagcctcccaagtagctgggactacaggtgcatgccactatgcccggctaatttttgtatttttagtagagatggggtttcaccatgttggccaggctggtctcgaactcctgacctcttgatccacccacctcggcctcccaaagtgctgggattacaggcatgagccaccgcacccagccctattttttttctaaatttactggtaatataaaattcttcgctaagaagacatgatcttattcaaatgttttatgagatttcattgatgtctgaattatctggaatattaaaatttttcatgaactcaaatcaagtactatacataatcttttagtaaaagcttttctgaggcagagtaagatttataacattttattatcatatggaagaagtgtattaaccatgttttcagtaatcactctgaacacagcattctcagttcacagtgtaaaaagtgaagtagaggttcctcttcaaagacttttctacctaattatgaatagtaacttctcttagaagcaaagtttattcaaagacctgtgctaacattcttaaatatctgctaagcacaattaaaaaatcaatgtactttatgttcttagctcccacaatttagcctaaatatttgccctggcatgcttatactaatccaagcaagcattaggtcatagcctgttcctcctccttatttgaaggtatttttacctttctcagcattccacaagttacttcctccttcctttgttctcctctgcctttgtctcttttaaaaagttctaagttgctaaacaattgggacatacagaatgtgaggtcccattccagccaatgaaaaccagacacagcagtagggtggacacgtcaagttataaatgactctgtctcctctgttcagtgtactcgtggcaaaactgctttctgcaaaaagtaaaaatggccttgctaagaaaaattaaatttattttcaagtgctatttctttacagctccagagaacaaacatttctaaaaccattatggaccctgagtaattcagggggaattggtatctctgtaaagagacagtaaggaaatgctgagtggaggcaccacactgcacatcaatgctttccacatgcacccaatagagtcttaatttaattgggctgttatttgcatagctagataattaccaactttagtcatactattttttagcaactaatggcatctgttacccattaattttatacatttgcttttttgaaaaacaaatcttttgttaattcactctaaattgagactacatttacaatcttcagtttttcagtgttaaagcaaatcagagaagagcaatgtgtgtacataatgtgcattttcctgcctaccaaaattattctggctgggaaaagtggctcatgcctgtaatcccagcactctgggaggctgaggtggatggatcacctgaggtcaggagttcaagacaagcctggctaacatgatgaaatcccatctctactacaaaaattatccgggcataatggcgggtgcctgttatcccagctactcaggaggctgaggcggaagaatcacttgaaccagggaggtggaggttgcagtgagctgagcacgtaccattgcagtgcagcgtgagtgacagagtgagaatccttctaaaaaaaaaaaaaagaaattctttcttcaattacttggaaaccctgggaagcccctataaaatactccctttgaatactttagccaggatttcagatttcaaaaggtcaaaaacaatcattgagcaaagcttaaatcttgcctttgtttcttgttagtcatctggccatttctgtaagtacggcaattatgcgaagccattgaaaaaatgtggtcttggtaaattttattccatttcaaatgttttctctaatgttaccttggtcatgtgaatctaaaagaaactatctacataactaatcatggattcaaaaaatattcatattaatgtgtttacagtttaatcttgtattacagtatagtagaatcctctataattagaagttaattatttataaattcattgtttttaaggtttttcaaatatgaaaacagacaattaggtatactttttgaagtaagttcaattttaggacattacccactggtcttcatggcatttctgtaataaatagtgtaaacctgtgtcaccagaatggtgcagacatgctgattgaattagaatgagttcagccttgttggtagactattggtatcccagaggctgatcattcactacagcttactaaatactgttccataatgccagtgagcacttttacccaggttacctttttcctcccattaatgtggacctgttgtggtctcctgtttctcttaagctatcccagatgagaggtgattatttcttgaatgaatgagattcccttttttttccctctgccatagaatcctcttatgttccttactggaagcaacatggaggaggcagaaatgatggcaagatacaaacatttttcccgccatgtggccaccataagcagcttacaacatgttctacctagaagtcacttactttcaggccagcaggggtgtttttctgtgatgtgtctctttctcttaaaagcacctctgattaagtttagcacaatcaggataatctccattttgataaacacaaagtctacggatgagtaacctaatttcataagtgatttcccaccacagtcacacattttttttacactcaagaggaaagtatgacacagcacgtgtgcaacagactggtaatccagggtattatcttagaatgttgcctacccacctaaataaatgtttaaaatcatcttttgctgggcacggtggctcatgattctaataccagcaccgtgggaggctgaagcaggcagatcatgaggccaggagtttgggaccagcctggccaacatgatgaaaccctgtctctactaaaaatacaaaaattagtcagacgtggtggtgcatgcctgtaatcccagctacttaggaggctgaggcaggagaattgcttgaacccaggaggtggaggttgccatgagctgagatcacgccactgctctccagcctggaagacagagcaacactccatcatggaaaaaaaaaaagagtctttctgctgcttttgttatctacataaacaaagatatcaactggatataataattaactactttttagttttattcattacaaataactatttttctggcttaaattattttttatgcaccatttatacattcacacacacatagaacaataaaaatatatccaattattcaattttggttgaatgttcattcaaataagtgttaaaaatgatttttttttcctgttttaagagggcttttattattgtactcaagagagttgtttctggagacaaagttgcctgtgctttaataggcagactctggggagaatccgaatcacaggccagaacattttatattaataaattcaatacaaagcagaaagtatagatttgctttcaccattttaaaagtgtttagttttgttaatcacctaaataacataatttgttttgttgcagtaattgcttttattctgaaaatatgtacaaacctatactcacacaaaaacactcaattcataattttcttacacctcaggtttatcttcagagtaatatgtgtatatttaactctatgtaaattaaaactaaaagtctatgtgtttgcaggcagagaccacatgttcaaggaaaactatattacaagtatttataatttttcaggactcagaaatgtatggattttatttttattttattttttgagatggagactcactctgtcagccaggctggagtgcagtggcatgatctcagctcactgcaacctctgcctcctgggctcaaacgattctcctgcctcagcctcctggcatgtgccaccatgcctaatttttgtgtttttagtagagacaaggtttcaccacgttggccaggctggccttgaactcctaacctcaagcattccacctgtctcggcctcccaaagtgctggaattacagatgtgagccactgtgcctggccgtattttatttacatttttgtataattattatgatcatagaaataattctgtagtcaataacaatttaattgtacattttaaaatgaataaaagcatataattacactattggtaatacaaaagataaatgctagaggtgatggataccttatttaccataatgtaattactacatattgtaggcctgagtcaaaagatgccatataaggcataaatatatacacatattatatacccacgaatacaaataaaaaatttaaataataaagagtcaaaatttaatctatgggaacaatatttaactcatttgcagtttaaagccactgacagtgattactaaagatgttattttacaatgtatgaaatagtatattcctacaatattgtacctacacccttgagtaaagtgggatacagttagtggcacaataatggttcattaaacgcacggtagtcttaccatggtaaaaataaaataaaattaagttcacaaataatctaacaaacttttttttttttgagacagagttttgctcttgttgcccagactggagtgcaatcgcacaatcttgccccactgcaacctctgcctcccaggttcaagtgtttctcctgcctcagcctcctgagtagctgagattacaggcatgcaccaccatgcctggctaattttttttgtatttttagtagagactgggtttctccatgttggtcaggctggtctcgaactcctgacctcaggtgatctgcccaccttggcctcccaaagtgctgaaattacaggcatgagccatcaagcccggccctaacagttttaaaatgcactgcattttattacataaaagtacaagtagtaaagtaatatactcatttattttaatatacttttaattatttctttgtgtcactataataaagtattgctctgaacatttacgttatacattacttaatagaattttactacaaacagcttctccacttgtattttcattatgcgtcttacattttaatgttcttactattttatagaaaaagtcataatgtccaaataatgtaaaaaaatcgaatatctctgatgcagaagccactgatcacatgctttctcacatgtgaatagaaataaaataacagcataatttgaaagctgtattacatcattattcagctttcaaaaaattttattcaaggaaacaagtatactttcaacgtaattacaatgcttccaaaaatctactccttttaaagttaaatagaaatcatttacctaaaaactgcagttgtggattagtttttatattcaatgctctgatttagtgtaatgtctgaagtgtcggggccttagttattctactgtaaactctcttgatatttatatacaatctattttgaattaaatattttttaatatttactgcatctgcaaaattatattttagcataaactctctgttgttttctaagctgtagtttctggggaaaaaaaagtgtttctaaacttaatacatttgtaggactcatctccaatataaattccctgatgttgaacaaacttgagcaactgctttaggattttcctccagtacaaaatgtgtgcaataagatctgtgatactagtaaatgtactatgtaactccctttatatttgtaatgcttgtcttcacaataaatactcttcttcactttaaaggcttatacttgctgaaagttttgacagtaattgccattttaatgcttttattaaaaggaagatttttatgttgagttagatgtgagtaggaattaataggttttccatattccttctatttgtacaatttttctcaaggatactagcttttctgtgagataaggtgtaagaactgattaaaagttttgccacattcttcacacttgtaggagttttgccagtatgaattatccaacctacaatcaagagtggcaaccatataaaggctttgtcacattttatatatttctagggtttcacactagtataattattgttatgtgtagagaagttggaggtgttcgtaaaagcaatgtcacattttttagctttgcggatttcctcttcaacatgaattattgccatgcctcttaagaattgagaacttgtggctgggcgtcgtggctcacgcctgtaatcccagcactttaggaggccaaggtgggtggatcacctgaggtcaggagttcgagaccagcctggcaaacatggcgaagtcgcatctctactaaaaataaaaaaattagctgggcatgttggaggacacctgtaatcccagctactcaggaagctgaggtaggagaatggcttaaacccaggaggcagaggttgcagtgagccgagatcatggcactgtactccagcttggatgacaagcatgaaacttcatctcaaaaaaaaaaatattgaaaacttgttataggatttgccacattcctcaaacttgtaggatttttgtccagcatgaattatgtgtaagaagggttcagaacttcctaaaagcgttgtcacattctttatatttgtagggtttatgttccatataaattctcatatttagtaaaagttgatagctggttaaaggctttccgacattcatcaaactcacagggtttctctccagtacgaattatcttatgtctagtaagggcagaggtgtccttaaaggctttgctgcattttcttatttgttgggtttctttcccgcatgaattatctaatgtctactaaggtttgaggatgaaataaaggctttgccacatttatcacacttgtacagtttccctccaatatgaattttcttatgtgaaaaaagcatagtgggatagcttaaagctttgccacattcctcacatttatagtttctctccagtatgaattaccttatgtgtagtaagggtagaggggcacttaaagcctttgccacattcttcacatttgtagggtttctctccagtatgaattctcttatgtctagtaaggataaaggagcgcttaaaagccttgccacatcgttcacatttgtagggtttctctccagtatgaattctcttatgtgcagtaaggtgtgaggacgagttgaaggctttgccacattcttcacatttgtagggtttctctccagtatgaattctcttatgtgtagtaaggatagagaagcacttaaaggccttgccacattcttcacacttgaagggttgctgtccagtatggattatcttatgtgtagtaagggaagaggagtacttaaaggcttcgccacattcttcacatttgtagggtttctctccagtatgaattctcttatgtgtagtaaggtgtgaggaccagttgaaggctttgccacattcttcacatttgtagggtttctctccactatgaattatcttgtgtgtagtaagggatgagaagtacttaaaggctctgccacattcttcacatttgtagggtttctctccagtatgaattcttttatgtgtagtaaggacagaggggtgcttaaaggctttgccacattcttcacatttgtagggtttctctccgctatgaattatcttatgcgcagtaaggatagaggagcgcttaaaggccttgccacattcttcacatttgtagggtttctctccagtatgaattatcttatgtgtagtaaggttagaggagcgcttaaaggccttgccacattcttcacatttgtagggtttctctccactatgaattatcttatgtgcagtaaggtatgaaaaccggctaaaggctttgccacagtcttcacatttgtaccgtttctctccagtatgaattctcttatgtgtagtaaggtgtgaggaccagttgaaggctttgccacattcttcacatttgaagggtttctccccagtatgaattttcttatgtgtagtaagggttgaagactggttaaaagctttgccacattctatacatttgaaaggtttttttccagtatgtcttatcttatgtctgtttgaatttgaaaatttatgaatgactttcacatatttatcacactgaaatattttgctttgagtagttgtcaaatattggttaagtccattataacctcttttgtgcaccttacactcatctacactttcacagccctttttaaactgtaaattgtcatgtccatagttttcatatcttctcagtgtcactttttggaaagaatcttttatgctctgctctggccaaagatctcgggcaaaatgagaacacgtaactgaaagaaacaataaaagcacattacttcaattggtagactcagataaatatactttacagatctaacctatataattatacaaactacataagcaagatgacacagcaaaataccacaaactgtaatttcttcctggatacataaatgtaacaaaagtggactgcccaaaatacatttgtaaaaaatttataagtgagttaagtgtatgaagggccccaggtgagcacaatgcaaagagccacatagaataaaaagaaaattctgttacttatacccaacagagctcttcctgctctccagtataatattgtgcctttaaaagtaaatttccagtcggatgcagtcgctcatgcctgtaatctcagaactctgggaaggtgacacatgggtggatcatgagaaattcgcccccatgacccaaacatatcccaccaggtcccacatctaacagtgagaatttatattgcagcatgaggtttgaagaacatagacatccaaaccatattatagaccacctaggattcacagccacacacaaaactctccagtcaaaaccaagataatacacagtattcctatttgcatctggtgtattctgttaggacacatatgaagttttattaaattaaaaatactatgtgctgtagctcttggctataatcctaacactttgggagatccactggggccaaaagtttgagaccagcctgggcaacatagtgagatcctaatactacaaacaagcaaacaattatccagacatggtagtgcatatctacagtcctagatactcaaaaaactgaggagaaaggatcacttgagtccaggaggctgaggttacaatgagccacaattatgccactgcactgcagcctgggtgacagtaagatcttgtctcaaaacaacaacaaccaatcatttttaaaacactaaaattacacactgtgtgttttctaacaaaaactgaatgaaactaggaattaaaagcaaaagtcaaactggcaaattctaaaataagtgaatatgaaatacactctacaacatattcttgctcagggggcaaaaaattttatttttcaaagttgtcaatacaacctacagttaaaacctacagtaacatggccaggcatggtggctcatgcctgtaatcccagcacttttggaggccgaggcaggtggatcacgaggtcaggagattgagaccatcctggctaatatagtgaaaccccatctctactaaaaatacaaaaaattagccgggcatggtagcaggcgcctgtagtcccagctacttcagaggctgaggcaggagaatggcatgaacctgggaggcggagcttgcagtaagctgagattgcgtcactgcactccagccagggtgacacagcgagactccgtctcaaaaaaaaaaaaaaaaaaaaacaccacctacagtaacataaacaatgtgacactgacacaaagataaacaaatgaaagaacagaatagagaactcagaaatgaacccttctgtatatgatcagatgatcttccacaaagttgccatgcatacaaaatagaaataatctcttcaaaaaatgaagttgaaaactgaatatcaacactgataaagttgtttatttccttgaatgacacaataatacattttaaataaaatgcttaaacataaaaatacacaagtgaggaaaagcatttgaaagaacatacaaaatcattaatttatacagaaattaaaaaaacacacaatgacaagatcaacttacacccattaggtgcaataaaaataaaacccatgttgattgctggtggaaaacaaagacacagccattattttaaaatgttgtaaatgttcctcatttataaatctctatccaaaatatgtaacacaggccaggtgcagtggctcaagcctgtaatcctagcagtttgggaggctgaggtgggcagataacctgaggtcaggtgtttgtgaccagcctggccaacacaccatttctactaaaaataaaagattagcttggcgatgtgacgtgcacctgtaatcccagctacttgggaggctgagacaggagaattgcttaaacccagaaggcagaggttgcagtgagccgaaatcgtgccactgtactttagcctgggcaacagagtgagactccatctaaaaaaaaaaggaaaacaacagcaacaacaaaaatatgcaacacaggacctggaagatataattgaaaatccatgtgtattgtaccagtattcacaaaagccaaaaggctgaagcaacccagatgcctcttgatttataaacatatcaaaaaatgtaacatatacatatgatgaagtattattccaccttagaaaaaacaatcttgtcaattttaagatgaactttgagaatattatgtcacctgaactaatccagtgacaaaattttggatactgtatgattccacatatatgatatatcttaagtagtcaaaatcataaaatcagaaagtggaaggtttgtctgtcaaaggctggagagagggtaaaatgagcagttgttacttaatggtcaatggcttttagttttacaagatgaaaactttctaaaagtcttttgcttaacaatgtgaatatacttaacatgactgaaatgaacagcttttttttttgagacacggtctcactctgtcacccaagctggagtgtagttgtacaattttgacttcccttaaatctcccaagtagctggggccacagctgcacatcactatggctggctattattattattattttttatagagaggtgtcaccatatgttgccctggctggtctcaaactgttgggctccatggatcctccagtcttggcctctcaaaatcctgggattacaaataagagcctccaccaagcctggccctgaaatgcacacttcaatagatttaaggtggtaaattttatattacgtgtttttaagcaattttttttaaagaaaaactgaaaaaaaaaaaaaaaaaacaattatgtatcttttt

SEQ ID NO: 657 - DNA, 573304 bp, Homo sapiens
tttgccttttgagagaaagatattgattgactcttcatcagagatttaaaaaaaactgttaagtaggacttctctctctttctttttcttttcttttttttttcttttttcttttcttttttttttttttttttgccaaggagttttattcttgttgtccaggctggagtgcaatggcacgacctcggctaactgcaacctctgcctccctgattaaagcaattctcctgtctcagccttgtgagtagctaggattacaggcattttgtatttttagtagagacagtgtttcaccatgttagtcaggctggtatcgaaatcccaatctcaggtgatccacctgcccggacctcccaaagtgctggcattacaggcgtgagccactgcacctggctctctttattgttttaaacagaactctaatttttcttcaggccactgatttagtttcttattatacatttatttatttatctgtttcttattgcctgtccccccaactagaccaattgcaaaaaattcaactgcagaaatataaggtaagtttttcatggatgattactcattaactataaatacataaaaattttatgtacacatttatctgagctgccctcatatggccttctacagaatgcttgaagttagattaaaaataatctacagataaatattcactgatagaatgcttaaagttgaagcctactggtgaaaatgttgttcctttctcaccagaaatgaagtagatacatttatttctggacttgctattatgcttcattagtgtgtgtttatttttatccagtgccatgccgtttgcttattgtagctttttttttttttgagacaaggtctcattctgttgcccaggatggagtgcagtggcttgatcatggctcactgtggcctcgacctcacaggatcaaaggatcctcctacctcagtgtctcaagcagctgagactacgggtttgtgccattattccctgctaatttttgtagtttttgtagagatggtgttttgttatgttgcccaggctggtctaaaactcctgggctcaagcaacccaccttggcctcccaaactactgggatcacaggtgtgagccactacacctggccttactgtagctttgtaatatattcagagaccaggtagtgtgatgccgccagctttgttctttttcctcaagattgcttaggctattctgggtctttcatgaattgataaagatttgtgaattactttttaattctgtaaaaaatataattggaatttttataaggattgcattaaatctgtagatcactttgggtagtatggacattttcacaatattaattctttccattcatgagcacggtgtctcatgaattttttagtgtcttcaatttattttattaatgttttagagtttttagtgtatggatcttttacctctttgaataaatttatttatgtgtattttattctttttgatgctgtggtaaatgaaattttaatctcaatccttgtctacacatctattcaactttaacagctttagagtttaaaccaaatacgtgtggcaatgcaggagaggaaagaaacccaaagttttatagttttgtaaaatacaggtgctcaatttagcatcctgtgttatgccctggggtgccaagcatcgcattaagctcaaacttaagctcagattgacttattctttgggataacccaaagatagaggaactcatcatccttattttacataggcagagatggccaggcgctgtgactcaccctgtaatcccagcactttgggaagccgaggcaggtggatcatgaggtcaggagcccgagaccagcctgaccaacatggtgaaaccccgtctctactaaaaatacaaaaattagctgggtgtggtggcgggcgcgtgtaatcccagctactcaggaggctgaggcaggagaattgcttgaacccgggaggtggaggttgtggtgagccgagattgcaccactgcactccagcctgggtgacagagcaagactccatctcaaaaaaaaaaaaaaaaaaaaagtacataggcggagatggctgcatagagagaataaataaatatacacaatcgcatggctggtacatggtaaactggaacttctagtacaggccatctgaccctgaacttcaaatgggctgggaagcttcttaccttctgtctatgaaaagaccagagatgccagagaatgccatttgagtctttggtgaataggtgaaaacttcaaatattgataatcaggaggaaggagttagattgacccactacttgatggaacacttatttttaacttaatgcagccatgaaagtgcttataacacttggggctttaagttcatcaattaaggcagaatttctatatagtatgcttttccctataaaatgtatttagccattgataactctatgtagttctgtggaatatgtgcttattagacagatcaggtgtttcggctaagaataagatgagtaactgtgttttaaaaatatatatttataaataattttaatcttgaatatttaataaccattaactactgtttgaatacgtctttgtccaaaacatatatatgtctatatacattctagataatatataatatgtatatatataatacatacatacatatataatcatatgtaatataactgtaccttctgtggctattatgagcttcattgctcgcaagctccaggatatggggcatcaggtactcaagagtggcagcaggaaacataagcatggaagagtccaggcactgggcacaggagatctcccacaagaggtgtccaaatataccaaggggaaccgtacgtagttctgctcttgctaagagtgtaaagtctgtttttttgttgttgttgttgagatggagtttcactctgtcacccaggctggagtgcagtggcatgatctcagctcactgcaacttctgcctcccgggttcaagcaattctcctcgctcagcctcctgagtaggtgggatgataggcatgcgccaccacgcccagctaatttttgtatttttagtagagacggggtttcactatgttggtcaggctggtcttgaactcctgacctcttaatccacccacctcatctgcacaaagtcctgggattacaggcatgagccactgtgcccggcctgaagtctgctttttatgtctatcagagcttcaaagtcttcttttcctagacatgggcttttgtgaatggtatagtttagatgtagtttgtccctgaaaaagactcatgttgaaatttgatcccctatgtggcagtgttgggaggggggcctcatgtgagattttaggtcataaatagattaatgctctcctgcagagatgagttctcactctcaaagtttccagcaagaatagatttttaaaaatctggctttctcaagtttatctcccttttgcttcacctcttgctatataatctttttgcacatacctgcttcccttctgctttctaccatgagtggaagtaacatgaggtgttggggtgatcagacccaacaccaggtcgtgggggtgacgaagtccgttggagtcaaaggactgagaaaaagacagtttgagagagaaagtgggaccagggggccatcacgagtgtggagactgtgaaggccccaagctctgggagcccatgctatttattggtgccaaacaaacaggtgatgaggatttgggggttgaaaggaaacagtgtatcaagtgaatgagaaacatatggctgcttgagataacgagagtgctagaagcaaggagccagcaagtctagcagacatgcaagccctgcctcagcttctctcccaacactcagcttttctcccaacatgaggctttcaccaaaagccaaacagatgccagctccattcctcttgtgcttcccagcctgaagaaccatgagctaaataaacctctttatacattacccagtctcaggttctcctatatcacaaaaaggactaaaccagtgagctttgcattaatcaacctgattttcaacctggccttggcctctcaagaccccagtgctcagtcacacccactatgtccatgtgggcctgtccttcactcatctttgtaatactctagacttttgaatgccactcatgtcaacttggccatgaactggcctaggcctagaaatgcccatgattagaatctagtcactctaatgactgaaccctctttttaaagaaactctagctattcaattgactttgttgtagaaaaaaatgtgtcatcaataaaatactttgccctgtctagaggacaccactacagattatcacactctagccagtactctctttgagtgcttttacaactttttctaaggtttaggtcactgaaagacattcacaatgtcttgtccagtagagtgtaaattgtttcttctctcacaatacaataatacgagtctccctccatttatatatttatttaaatatttccaatttatattgcttttgctgtatatttgaattttttttgtactggttatcatgtatgctgattcctcagaagttaaataaacattttaatatgtgtgcctatcttttgttgttatttagatatctaggtgactacagcttcagtagaaatttgttgacttcgttttgattttatttgcaattttcctttcggcttatttagtgtttctgtgtttttctgctgcatttacagcatattatctagtctttatcactggcaacagtggcttgaagtttgtttataaaattatgtttattgagatgaaattcacataacatcaaattcaatatcttaattattttcaggtttacagttcagtgtctttttgtgtattcacaatgctttacaatcattagcactaggtaatttttgaacagtgtaattacccaaaaaagaaaccccacacccatcaaaagccactttctattttccccaccggcctctggcaaccactaacccgctttctgtttccaaggatttgcctattttgggcatttgatacaaatggattcataaagtatatgatgctttttgtatagcttttttcttttcttttcttttgagatggattctcacactatcttctgggctggagtgcaatggcacgatctcggctaactgcaacctctgcttcctgggttcaagtgattctgctgcctcaacctcctgagtatctggaattacaggcacacaccacaacacctggctaattttttgtatttttagtaaagacggggtttcactatgttggccagactggtctcaaactcctgacctcatgatccacctgccttagcctcccaaagtgctgggattacaggcgtgagccaccgcacctggccttgtatagtttttttcatcaagcataatgtctttaatatccatccatgttgtgtcccatattagtacatcattcctttttctggctgaatactattgccttgtatactacatcacatttgtcaatctagtcctccatggataggcatttacactggtttcactttttggctataacaaatgtttctatggacatgcatatacaagtttttgtgtggacctattttgatttcagttgagtatatactcagaagtggaattgctaagccatgtggtaactctgtgttaacctcaggaggaactgccaaaatgttttccaaaactgctgcctaattttgccattccaccagcactgtatgaaggtttcaatttccccacatcttcacccacactgatctgtcctctgaaatatacctgtaccagcaggtgtgaggtgatatatcactgtggttttgacttgcatctttctaatgaacaaagatgttgtgcatcttttcatgtgctcattggccacttgtacagaataaaaatcttggagccactggtccagattatgagtctcaaacacatgttacgaacagatttttgatgctgcacaagaaatagcactcagcaaggcaaatttacttctatagaagggttcacctcgtaaattaagcaatggcaagggcgcacagaacaaaggaagcaggagtttttattatctctgacacagcttctacttctgtatctttcccctattggttagggttggaccgcacagtctaaaccagtcccgattggctaaatacttaaaactttttagataaggtagtcacgtaagggaagtaagagagaaagaaggcgggtcacttatggggaaactacaaaagtaacctattccctaataaggaaaggaatgtggactgggactggggttgtaggaagttcacgcatgtctaggcatagttagataagttggggcacaggtgaggtaaggaatatttggaattatagaataaagaatggggaaaatggataaggtatttgaagagtgaacctaactgtatctaacacacaaaacaccatggaatgatgataattcagtacatagtaatcttataattctgttattatctaatgaagaacagcatcccaaatcttttttgtgttgtttttgttgttcgatttgccaatcacatgcatagaaaaaaatggtatttaccagtgtatttacaatccaggacaagatgttggagggcccaatgtatttgggagcttgtagtttcaactgtgcccacctgatgtggctgataataatagttagaagatactcaagagggccgggcatggtggctcatgcccagaatcccagaactttgggaggccaaggcaggtggatcacctgaggtcaagagtttgagaccagcctggccaacatgttgaaaccccgtctgtactaaaaatacaaaaattagctgggcgtggtgtcaagcacctataatcccagctacttgagaggctgaggcaggagaatcacttgaacccaggaggtggaggtggcagtgagccaagatcatgacattgcactccagcctggtgacaagagcaaaactctgtctcaaaaaagaaaaaaaagaagatacctaagaggcaggtggtggcaatacacacacctctgcccactctgtgaacatagaaaacacatttgaatgcaatgtcactgaggaaatgctttaaattaaaaacagtcattgtctgtaaggctgctttggataatatgaccgagatgttggctatagccaggtgcttgagaatcaaatctgtggactttagtatccacctggtgtaacgaaatgcaaaaaaaaaaaaaaccaaacaaacaaataaacaaaattccccaataatcagactgttgtctgagaaaagatcattcctattaccaaatccctggaggccattcattattttccagttactaatattttcattcagagtgagaatattctgcatagacacataaggtctgttttatggtggcaactaaaatggactatttttccacatactattgttttcaacttataactttgtttttaaactccacttttctttcactaagatttttttgattctctctctctttctacacacacacacacacacacacacacacacagatataaacacatacacacacatatagatatttacacattattttcatttagcctgtgcttttaaaaataaatttcagtggttgacacctagttcacatgttgtcaggcattttctattttagtaatttaattttcacctatattatttcattgaaatacatttgaattaaatatgaaactttaatatgaaagattccattggcttttcttgcaaaaaactttaatataaaagatgccattggcttttttattattataaatatatgtagtgtgataacactgtatacatagcactataaaactactgtattagtgtgttacatataatttttataactctatgaagtgctttattattcccattttacaggtgaagagagcttagatacaaatagaataaataacatttctaaaatcacctccttgtaggaggcagtttcaggagttgaagatgtttttaacaatagttaatatatgctgtctcaacatcagatatatattttttaaaaatctacataggccaggcacagtggctcactcctgtaatcccagcaatttgggaggctgaggtgggttgatcacgaggtcaggagatcgagagtggtgaaaccccgtctctgttaaaaatacaaaaactagctgagcatggtggcacgtgcctgtaatcccagctactcaggaggctgaggcaggagaattgcttgaacccaggaggtggaagctgcagtgagccaagccactgcactccagcctgggtgacagagcgagactttgtctaaaaaaataaataaataaataacgacacatattttaaaaacatgtacctcttgttagctttttaaagaatgtttgtacatatttatttaaaaatgcatatgaaaattttacatttaaatatgattgcataatttattggcaaatatctataatgattcaaagattcaagtagaatataaatgttctgatttagcatcatcttaaaataagtggaatttgttgaatgcaaaaatggtttcctcatggaattagaagactttttaacttaaccaagaaggagcacataatggaatggcaattgagaaaagggacttgaaacatgagtagaaggtcaaatattgcatagaaaaactaaattaccataagtatatagagaaaatcagtatttgtgaatgcaaaaatatcaaataaaattatgtcagggaggtgaaagatctctgcaatgagaatcacaaaacactgctgatagggatcagagaaagcacaaagtaatggaaaaccattccatgctcatgaataaaaagaatcaatattgttaaaatggctatactgtccaaaacaatttacagattcaatgctattcctatcaaactaccaatagtattttccccagaattttttctaatatttatataaaaacaacaaagagtctaaatagccaaagtaatcttaagcaaaaagaacgaagctagaggcaccacacttcccaacttcaaactatactacaaagctgcagtaatctaaataacatggtactggtaaaaaatcagacatatagaccagtggaccaggttagagaacccagatataaagccacccacctataactatctgatctttgacaaagttgacaataacaaccaaggggaaagaacttcttattcaataaatggtgctgagataatggactagccatatgcagaagtttgaaactggacctctatctctctccatgtacaaaatccacctaacatttgctacagacttaaatataaaatctaaaactgtaaaatccctaggagaaaacctaggaaatactattctgccaataggtcttggcaaagatttcacgatgatgacacccaaagcaactgcaacaaatagagaaactgacaagtaggacctaattaaacttaagagcttctacacagtgaaagaaactatcaatagagtaaacagacaacctacataatgaaagaaaatatttgcaaactatgcatctgaaaaaggtctaatatccagaatctataaagaaacataaatggccaggtgcagtggctcacacctgtaatccccgcactttgggaggcctaagtgggtgaatcacgtggtcaggagtttcagaccagcctgaccaatatggtgaaacccccgtctttactaaaaatacaaaaaattagctgggcctggtggtgggcacctgtaattccagctactcgggaggctgaggcaggaaaatcacttgaacccaggaggtggaggttgcagtgagccaagattgaacaactgcactccagcccactccagcccgggcgacagtgagagacttcatctcaaaacaaacaaacaaacaaaccataaacaaatcaacaagcgaaatataaacaaccccattaaagaatgaacaaaggacataaacagacacttctcaaaagaagacatatgcacagccaaagagcatatttaaaaaatggtcaacgtcactaattattagagaaaggcaaataaaaaccacaatgtgacaccatctcagtccagtcagagtgtctattattaaaaagccaaaaaacaataaatattgatgaggttgcagggaaaagggagtgtaagttagttcagccactgtggaaagagcaatgtgaagatttctcaaataactttaaatcatctgacccagccatcctgttaccacatatatacccaaagggatataaatcattctactataaagacacgtgcacacatatgttcattgtagcacttttgacagtagcaatgatatgtaatcaatctaggtgcccattaacagtggactgaattagaaaaatgtggcatatgtacaccatggaatacaagtcagccataaaacagaataaaattacgtcctttgcagcaacatggatacagctggaggccattaatataagcaaattaatgcaggaacagaaaacaaaatactggatattctcacttataaatggaagctacacaacgagtacacacgaactcaaagagaaaaacaataaacagcagggtctgcttgagaatagagggtgaggggggtgaggatcaaaaatctacctttctgccaggtatggtggctcacgcctgtaatcccagcactttgggaggctgaggcgggtggatcacctgaggtcaggagctcaagaccagcctggccaccatggtgaaacctcgtctctactaaaaatacaaaaattagctgggtgtggtggcatgcacctgtaatcccagctactcatgaggctgtggctgaagaatcgcttgaacccagaaggcagatgttgcagtgagcagagattgtgccactgccctccagcatgggcaacaagagcgaaactcttgtctcaaaagaaaaaaattaaaaaaaaactacctatcaagtaccatgctcactacttgcctgatgaaataatgtgtacaccaaaccccagtgacatgcaatttacccatttcacaaacctgcacatgcgcccttgatcctaaaatagaagttggaagaaaaacccacaaataaaaaagattcagaactagagtagataaaacaacaatgattttaaaaagagcttttttgcccttctaaaatatgggtgttaatagatgttctggatcttcagcctcatcttggaccatgaagaatggaaaacaaatgtcaggggtgatggagcagagacatccctaaaggcttcctgaggctgccatgctggcccaggtatgcctaactcctgagtttttatgtgaaaaaaatataacttacgtgttttaagtcagtatagatagatctctattattcatagctgaataaagtaaaatgagctgttgaacttgaaaaaaaaatagagatattttgaaaaatttgctccagttacaatttaccaataacaattacagctctttgccgggcatggtggctccctcctgaagcaggtggatcacctgagagtttaagcccagcctgaccaacgtggcaaaacactgtctctactaaaaacacaaaaattatctgggtgtggtggtgcacgcctgtaaacccagctacttgggaggtggagtcaggagaatttcttgaacctgggaggtggagattgcagtgagccaagatcctgctactgcactccagcctgggcgtcagagtgggactccatctcaaaacaaaaacaaaaacaaacaaacaagaaaaacaatgacagccctctagtgtctccagagaaatgaaggagtttggaacagtctcctctcttctatgatttctgaagaaagaaagaggctcacatggagggctcagaaaatgctgagtctgatacatgaaggacagacagtgaagtcagtgtgtctttctggattctgtgcttccttaaaatgttctgctaaaaaggaaattttctgttaatcttcaaattcctgagccaaactagtctttaatatttaatagagaaatgtgctgggcatagtggctcacgcctgtaatcccagcactatggaggctgaggcgggcagatcacctaaggtcaggagtttgagaccaggctgaccaaaatggagaaaccgcgtctctactaaaaacacaaaattagtcgggcgtggtggcacatgcctgtaatcccagctactcgggaggctgaggcaggagaattgcttgaacccgggaggccaaggttgcagtgagccgaggtcacatcattgcactccagcctgggcaacaagagtgaaactccatctcaaaaaaaaaaaaaaaaaaaagaacaaccccactacaataaaggagaaaacaacagcgaatttcatcacctgtaacattgtaacattctagctacccagaagtcctcagtctgtccatgtgacaacttcactgctagaacaacctgcattcacaaaaaccagtgcactaaattgaattacaacaaaggaccctcacagagtccactttactcccctgctacctctaccagagcaggtggtattatccatggctgagaaacctgaagacagatcacatcacaggactctttgcagacaatccccagtaacagcccagagcccagtagctccactggatggttaaacccagaagagcaataacaagcactgcagtctgactctcaagaagccccatcccaagagaaaaggggagaccatcacatcaagggatcaccccatgaaacaaaagaatctgaacagcagcctagagcctcaggtcttacgtctgacatagactacccaaatgagaaggaaccaaaacaaaattctggtgatataaaaaagcaagaatttttttaacaccttcaaaagaccacactagctcactagcagtggatccaaaccaagaagaaatccctgaattgccagagaaagaattcataaattccattattaagctacttaaagagacgccacagaaaggtgaatattaacttaatgaaaaaattttaaaatacgggatatggatgaaaaaagtctccagagaaatagacagcataaataaaaaacaatcacaacttccggaaatgaaaggcacacttaaagaaatgcaaaatatagtggaaaattacaatagaaccaaacaagtgaaagaaagaacttcagaccccaaagagaaggcttttgaatattccaatctaacaaagacaaacaaaacagaatttaaaaatgagctaagtctccaagaagcttagaattatgttaaacaataaaatctaacaataattggtgttcccaaagaagaagagaaatctaaaagtttggaaaatttatttgagggaataattgagaaaaactttcctggccttgctagagatctagacacccaaatacaagaagtccaaagaacaccaaggaaattcatcacaagaagataatcacctaggcacacagtcatcaagttatctgaagtcaatatgaaggaaagatttttaagagttgtgagacaaaagcatctggtaaactataaagaaaaacatatcagattaacagcagatttttcagcagaaaccctaaaaactagaaagaattggggtcctaagtttagcctccttaaacagaacaagtatcagccaaaaattttgtatccagtgaaactaaacttcataaatgaaggaaagatagtctttttcagacaaacaaatgcttagagaattcaccactaccaagccactactataagaactgctataaggagttctaaatcttgaaacaaaacctcaaaatacaatgaaatagaacctccttaaggcataaatctcacaaggcctataaaacaataatacaataaagaaggtattcaggcaacgactagcacaatgaatagaatagtccttcacacctcaatactaacggtgaatgtaaatggcctaaatgatccagttaaaacatacagaatagcaaaatggataagaagacaaatatctgttgtcttcaagagactcacccaacacttaatgactcacttaaggtaaagggttggaaaaagatattccatgcaaatgtaccccaaaagaaagcagtagtagccattcttacatcagacaaaaaagactttaaagcaaaaacagtttttaaaaaaagataaagagggacaaaaaaaaaaactagtccaacaggaaaatatcacaattctaaatatatatgcacctaacactggagctcctaaatttataaaacaattatcactcgacctaagaaattagatagatggtaatacaacaacacaactataatgggtgacttcaatactctactgacaacactagacaagtcatcaagacagaaagtcaacaataacaaaaaaaaatggacttaagctataccctagaacaaatgggcttgacaaatatttacagaatattctacccaacaactgcagaatatacattttattcttcagcacatggaacattcttcaagatagacatatgataggccacaaaacaagtctcaataaatttaagacagcagccataaaaaatgatgagttcatgtcctttgtagggacatggatgaaattggaaatcatcattctcagtaaactatcgcaagaacaaaaaaccaaacaccgcatattctcactcacaggtaggaattgaacaatgagaacacatggacacaggaaagggaacatcacactctggggactgttgtgggatggggggtggggggagggatagctttaggagatatacctaatgctaaatgacgagttaatgggtgcagcatacgagcatggcacatgtatacatatgtaactaacctgcacattgtgcacatgtaccctaaaacttaaagtataataataacaaaataaaaaaaagaaaaaataaataaataaataaataaataaatttaagacaatcaaaatcatatcaactactctctaagactacagtggaataaaattgaaattcaactccaaatgaaccatcaaaaccatgcaaatacatgaaaattaaataaattttggaaattaaataaatacatggatattaaataaaacattaaacttaagttcaacccatttttgaatgattgctggatgaaatcaagacagaaatttaaaaattctttgaactaaagataataatgacacaacctatcaaaacatctgggatacagcaaaagcagtgctaaaaggaaagttcatagcatcaagtgcctacatcaaaaagtctgaaagagcataagtagacaagctaaaataacacctcaaggacctagagaaacaagaacaagccaaacccaaacctagcagaagaaaagaaagaccagaactaaataaaactaaaacaaacaaaaaaaattcaaaagatgaatgaaatgaaaagctagctcttagaaaagataaacaaaattgttaagccattaacagaattaaccaagaaaagaagagagaagatataaataagctccattagaaatgaaagagaaaatattgcaactgatgccacagaaatacaaaagatcacattcaggtctactgtgaacatctttacatgcagaaagtagaaaatctaaaggagatgaataaattcctggtaatgtacagtcctcctagataaaaaaacaacaactctgaacagactaataacaagccagattgaataataatttaacaaattgccaaccaaaaataaaagttcagaaccagatggattcacagctgaattctatcagacattcaaagaaaaattggtgggggtggggcccagatggctgactagaagcagcatcccatagaaaagaaccataatagcatgtaaatcttgcaccagcacctgaggtatccaggttctctcatcagaactgactaggtggctggcatgacccatggagaagaaggaaaagcaatgtggtgtggcaacccacctgacagccaaatggggctggagagcccccaaccccagccaagggaggcggtgagtgagcaggctacccagtctgggaaactgtgctttctccatggaactgtgaaacccatggaccagaagattcaatttgtgaacccacgccactggagcctaaggttccaactgttggaaacaagagcttggagtcacaaagaaaacaagcactcaaacaaggaatttctcagcaaggcaaatttacttctgtagagaggtgctgctcatgtctctggctgttgtgagagcacaccatacaagagagggaaggggtttgtatccctaatgcagtctctacttctgcatcctctcctcattggctggagtcagaccacacactctaactcgattggctattctaaatcaagactggcaggaaggttgtttacagagtaggtaactaggagtgaggaggaattcttccaaataaagaagagatgtgggttacagattgggactggttggaagagttgtttacagagcaggtagctaggagcaggaaggtacaaggaagttgatttccagaacaaagaacaaggaagctatcctttgaagaggaacttattatgcctgacacaaccctggagctgagtagattctcaacagcctctcagctagaatctgcttaagcctgccaagttcccaggggaggggtgaccaacaccacagctgtggctggctgctgtctaagctgtttgagctccttgggggagggacagcagccagcacggggactcacaactgcctaacaggctaagatccttgggtggggaaaggcagcagccatatctatagctcctgaccacacttttcccctgctagagccagggaggctggacagcttggtctcaagaggtgttccccacagcccaacacaccggctgtggctgactgcagccagaatgtctcttcaggcctgaccctcacccatccctcctcactgggcagggcctccctccaagaactccaacagctccagccaggggctcagggacagaactgtgatctccctgggcctgaacccctagcgggagaggtggttgcagtttctgtggaccagcagacttagcctttctttctgctagttctgtggaattcaggcagcccagatgactgggtttccacccatcaaaacacccccctccaccaaggaacagtcaaagtgcttcattaaatgggttctgctccccgtgccacccaactgggtgagacccttcaataggggttgtcggacaccctatacaggagcaatcatactggattcaggttggtgcctcttgacatcagtgatctcagaggaaggagcaggcaccattctttgctgttctccaacctccttgagtgacatctccaggtacaggagtaaaccagatgaatagagcctgaagtgaccccccagcaaactgcagcagccctacagaagagggacctgactattgaaagaaaaacaaacaaacaaacaggaagaaacaacaacagcatcaacaacaaaagcgtacccacaaaaaccccatccaaggctgggcatagtggctcacatctgtaatcccaatactttgggaggctgaggcaggcagattgcttgaggtcaggagctcgagaccaccctgccaatgtagcgaaacccagtctctcctaaaaaatacaaaacttaaacaggtgtggtggtgcatgcctgtagtcccagctattcgagagcctgagacatgagaatcatttgaacctgggaggcagaggttgcattgacccaagactgtgccactgcactccatactgggtgacagagtgagactctgtctcaaaacaaacaaacaaaaaaactcatccaagggtcagctgcctcaaaatgttgaaattagacaaactcatgaagatgagaaagaatcaccaaaaccctctgaaaggccttatctcctagagatgatcacaatgtctcttcagcaaattcacagaactggacagaggatgagatggatgaagtgacagaagtaggcttcagaagatgtgtgataacacactccgctgagctaaaggaacatgttctaacccaatgcaaagaagctaaggaacttgataaaaggtgagaggaaatgctaagtagaataaccagtttagagaggaacataaatgacctgatggagctgaaaaacacagcatgagaacttcatgaagcatacaaaagtatcaatagcctaattgacaggcagaagaaaggctatcagagtttgaagaccaccttgccaaaatgaggcaagcagacaagattaaagaaaaaagaataaaaaggaacaaataaggcctctgagaaatatggtgttctgggcaggaaatgcatgaggggagaagaaaacacacacacaataccattaagggtaaacaagctttatcccacctaaaaggcaatgcagatataataagcaaattgatatcataagcaaattgcaatgggaaagggagaagggaaaatatgtaaataaatgtacaaaaccaaactatgtggtccatagttcaccctatttaaaaatatgtagtcctcataatattccatttaacagcctgttgtaactctttggtgttaagcccaagcacatctaatatatgctggtgccaccaccagaaacgtgtcccatcacaccaccataagtggtgtctctctctgatgttggaagagacagtgccaaggacattttcgctggaggtaggaggtggggtcataaaaggaatagcaaagtaccttgttcaaaaggatcagatatagttacactcatcagactatgggggattcgtcaccacaccaggaagcaacagcctgggctccagagtcggccacccatctgtgcacaaacaaggagaggtctcttgaagccttggtgcagtcttggaccctgtctctttttgtaacaagttgtttggcatgaggcccagtgatgagggccctttgcgactgggctcagggaacacaaaaaggtcaagttgtttttgtgattgtctattgtttttcaataactaacgtataggaatagattgaaatagagattctttctgaaatagcgctggatgaacgcctcaaggggttcacacaacctgtgccaggacttggtgaccattgtttgtgtccatgttcaatttagttcaaatttaatatttaacatgtcctctacattcggcctcaattggatactcaattgtaggaaaatacccttacagatacaaggggaaggcataattgatatagattacagatacagggtaaggacaagagaattaaaagcacaattaataaaaaccacacccaccatggctttgcaaggagagtcatattgtgagaactgccagagatatacacacaacattcagtatgcagtaaggtgcaaacccctccttgggttgcggtaagcatatctaatgccatttgattttgcaacacaacagtactcagatgagcaaattcatctgataacaacataaattcagtgctactatcattaagagctttttctacatgtaaggtaaatcttttaatttgttgctgaagcaagattgtacgggcggcaggggagaatactgtgatagggtaccaccaccagggagtccagtgcattggtaaccagcgatgtttgtaagcatctagattactggggaggggaatattaacctggatggtgaatgtaattaatggccacccccaagtgcatctccccatccaatgcagggacaggtatcaccacccataggatctgcatacccagagggccccccaggggacagcaatggatctactgtaatcatagtgtactaatctcttattaaaataggaaagagattgtggttcattgggggcaatgttgttgatttggagtatgtgttgacaaatgtctgaagaaaccccaaataaacattagaggagccatttaaggtctccagacagagtgggaactgtatggaatccggccaccagcacagcaggttttcagtatattccattccaggattattgggcaggataccaaggcttttgatgcaaggggagggtggagttcatcttttgtctgacttggcaaagatagattgcttagtgtggtgaaaggaagcccaggttggattgcaagtgttgttgttgttgtggccctactggtaacaatatagccattcagaaatgttgtcagggacaattctgcaaggtagcacattccaggcggcctccggcaactcaacatatagccaacattgactgcggttggcttcagttgcagcagtggctaccaagttgatgaatttattcttggcttcagacacaaagacacaggtgctgacgagtagtagatagattatttcttgtaataacaaaaacagaggggaacaagatattgtttttcatctttaggaaattgtactatgccttcatttcctgctttcatagctacaaagtcaccagccttagggtcaggatctgatggacgctgtacccatatttcagctccaggatttaagctacctgtaccaggggatccgaatcccccagttctgtatgtagcctctgttggggcagagatttcctcaggggttgttgacaaggtaccactaacaattgagcaacccacatttgtggttttagagcaaaagaatctggagtgtataaaatgacctttaactctccctggtaatcgctatcaattatagcaccatacattataatgcctctcattgcaaggcttgaacacgttgtaatccattcatccgcattcatgtttaccgttatggtggaaattttggcctgctgttcttcctgctgattaagtagtctgtcaagagaaagcagagactcatgagcatcaatatggaaaacagggccgggtgcggtggctcacgcctgtaatcccagcattttgggaggcccaggtaggtggatcacgaggtcaggagatcgagaccatcctggccaacatggtgaaaccccgtctctactaaaagtacaaaaattagctgggcatggtggtgcgtgcctgtaattccagctacttgggtgactgaggcaggagaattgcttgaaccccggaggcagaggttgcagtgagcgagattgtgccactgcactccagaatggtgacagagctagactccatctcaaaaaaaaaaacaaaaaacaaaacaaaacaaaacaaaaaaccagtgataatggtagtgtgtgctaggattgagatatctccccagtattgttttccccaaacctctttattcccaattaaccatttgctttgttgcctggggcatccaggtagtaagaccatttggtattgaccaagagttggtatagaagtgaaaaatccctctggtctccttctgaatagctcaggggaaccgctactagttcagctaactggctgctcccaccccttccttcatcagaaatgcttttgtttttaataggattataagccacagccttccagcattgattcccaccaatgtatttggtggatgcatcagtaaaccaagcatgtttctgatcctctgggcttagttctttaaaggatttgccccattgggtgggggaggtttccttccctatctgcaggacttgctcggtggtttcctgagctgggagattttgtacatccttatgtaaaagtgatactcactttggttttgacttagcctggtcttgtatgtaccatgtccattttatgatgctactttcttggacatgtcctatctgatgggttttgggggaactcaagtcccaagtcataataggaatttcgggcctcataaagacatcatggttgaagcagaggtgttccatttccagcaaagcccaatagcaagctaacaattgcttctcgaaaggggtataagcttttctggcctctggcagtttctgggtccaaaacctgaaaggtaccctcttcccatcttgtttctaaggctccaattagcctgttgatctaggacagttacttgcagttctcctggcccatcctgtatggaccatagatccagggccagttgcaccgcttgtttatcttgttcagaagccatgctgtctgtctctccccaatgaaagtcatagtgttttctagtggctgcatgcagaggttgtaaaatattactcaagtgaggaatatgatgtctccagaatccagagatgtcaataaatgtctgggcctcctttttagtggtaggggttgcaaattctagtattttagcccctttaccttttgtaagatggactatatctctgcattccataggatgccaaggtattttacagtttgtgcaggtccttgaattttgctaagcttaatttcccatccttgagataggagctgggtttttacctgctccaagccccagcaaagtagttcttcagttttaacctgaccgagtcattctgacagctgctttttttcagcaatagggtgatagctttgagcctgatcagtcaagatataggcctggcattgggccagggccagtctggaaatcacactggcattttccttttccaacttacatttctcttatagcaaccagcccgtatcttgacacattaacttataagcagtaagcaaacaccatccactctgggagatccctcagcatctcctttgctgactggaatctcctgcagcacttcccgcacagtcaaaggtttaaattgcactaatttagattctcagttctcacaaaggccagttccccttgaccattcagttgccaagggggaaaactgggggagttcccatcctgagacatgggaagtccctgagcctccagccccatccttctggccaaaaagcggcatacttttgtttccaaatactgtttgtgacaccaaaaatgttctgtgcaggaaacccgcgaggggagaagaaaagacccacacacaatacttttaagggtaagaagttttataccacgtaaatggcaatgcagatataataaacaaataatataataagcaaatcaatataataagcagattgcagacataataagcaaattgcaatgggaagaggagaatggaaaaggtttacactcaccagactgtatatatttacaccaccagactgggaagaaacaacctgggctccagagtcggccactcatccgcgcacagatgaggagaggtctcatgaagctttggcgctatctgggaccctagctcttttgtaatgagttttttggcatgaggcttagtcatgagggccttttacgaatgggctcaaggaacgcaaaaaggtcaacttgtttttgtgcttgactattgtttttcaataatgaatgtataggaatagattgaattagagatttctctgaaacagcgcgggatgaatgcctcaaggggctcacacaacctgttccaggacttggtgaccattgtttgtgtccagattcaattaagttcaaatttaatatttaactttacctccataccagactatggaggattcaccaccagagtgggcagtaacaggctgggctccagagttggccacccatctgtgaacacatgaagaggaaaaaaaaaaaaaagtgaaaaacattatcccacagtttgcaaaatatattacatttaaacagttgtaaatacatgaacataacatctcagtcataatcaaaattaagtatctgacaacacactcgaaagtttgggagaaatagaaaagtgtttgtgtcttccccaggcccacagttccagtgccctgtgctccctcattgtcatggggttgccatgggccccacaggatatgggaggcacagagcagatggtggctgaaggtggggtgtcttgtgggaccagcttcaagatcagagaccttggttcattgtattgaaatcagccagctcaggaaaagagaccttgctgcctcaagctctatgtccatctgcattagcgatgtaaggaggcttgagcacccatgggcacacaaacccatcccactccaatatttcatcaactattgaggagtctgaatccatgttcttgaggagcatatgcttctgcagttacaaccactatggaaaacagtatggagattccttaaagaactaaaggttatctaccatttgttccagcaatctcagtaatggctatctccccagaggaaaggaagtcattatatgaaaaagacacttgcacatgcatgtttatagcagcactatttgcaattgcaaaaatatggaactagataaaatgcccatcaatattgagtggataaagaaaatgtggtacaggtataccatggaatactactcagccataaaatggaacaaaataatggcattctcagcagcctgggtggagttggagaccattattttaagtaaagtaactcagaaatgataaaccaaacatcatgtattctcatttataagtgggagctaagctatgaggatgcaaaggcataagaatgatacatgaattttcggggaggaaaaatgggagtgggtaagggataaaaggctacacactgggtagtgtttactgctcagatgatgggtgcgtcaaaatctcagaaaccaccactaaagaacttagccatgtaaccaaacaccacccgttcccctaaaacctattgaaattaaaaaaaagaaaaaccatcccaatttctcattttaaaattgggaaactgaggccccaaaagaggctggaaattagagcccctaaataatagaaagccctgtgctctccttctccacatgggctatttttgtctccatattctcagataagcacacacagacacacacacagaaacacttctcagggaaagatcatggaagcgaggatagagaagaggcagacagaaaccaggcataagacaaggaaaaaaaaaaaaacccagaatagtggcagctctgctataagccagtgcatgcactcctctagctacgtgtccaggggcacagagaatgagcaggaggatcctccaggtttccagggttctccatcagctggggtcatctccaggtcagtttcaagaggacaggactggggtcctactgtccaactctgtaggtacctgaaatggaaatgagctatgtccccatctcagcctagcatagacaatggctacagcaaagccttttcatacctcataaataagagtacttgaagtgggtgacctcaatggtttcacatacccataagtgtctgctggcctttgttcttcattggtgaaccaagactctttgctctgagactgcaaaaatgcttctactccctggaagtccttcagagtgaggcatggtcaccccagaggcatcttgggtagataaagctgagatagagcgaaatgtgccatataactggactctgagtctgaagcccagggaaaatactagttcctgttgtgttcttgagatgatcatttggaagtggtagaaaacagtttccctggatgaggggttgtccctcatgagtaaagagcacaccccaaaaggtggaggcaaagagaggacaacggaggcttccaaggttactcttatcgcacttggagcctccggatgctgctcctttgtcccctgggaccctggagagccagtgtcttgaggacccaaacataaaaatagctttgttctgtgaggctcctgcatggggctgcagtgccagtgatggcctctaggtggtgagagccttctgggtttttggtgcccactgagctttgctggagcagctggagcaaagaagtcacaccgaggtcatgcaccttgagttattattaacgatccccatattatcaagtggtcaaaagcaggaaggagaatttgagattcccccatgcattcacttagccagtctttcccttacactcaccctgtgccagctaccctggtggacccaacatgtggtacagaaaatgattgaatcatacctgcaccgtaccctgaggaccagtctgaggacaggtgaccaaaaacactaaagcaagtatacgtgaaagaaaagagcaactgctataatataaagtagaatgttgacagaagagctgggaaatcatgacatggagtgacccaaatgcctcactgagatgacatttataccatgatgacaatgacaatagggagccagcgctgcaaaagaatgtgtcagaagaagccacccttagtaaagaatctcacaggtgtgagttgggcagaagttagaaagggaccactatggccgcagagagcctgagacagagaagcagaaggatggagaatcttggggcctgggagatgaagctagttatctgcttctttcttacaacattgccctgaaacttagcacctttcaacaacaaatactatctcacaatttgtggggaccagaaactggacacagtttagtggggtgcctcttcctcaaggtctttaggaggcttaggcctcataagaagctggacttctcaacagaagctggactggggaaggatcagctttaaactcactcatgtggaaattggcaagactttgtgtggcctgagagcccacgtttcttccatctattggcctgagcactccctcagttctttttatgtgggtctgtacatagagcatctcgtagcattggaatttgccttttcagtttgaggaatacagtacagaaatagataattaaacagaaaaacacaaaaagagagactgagggagcaagtaggaagaaaatgacagcttttagaaaaatatatatataatcttgagagttatgatttctccccctatatttgcgtgaaaattctaaccctcagagtaatggtactatgaggtggggcatcattaagtcctgaaggtggggtcctcatgattgggattactggctttaaaaaagataccccagggggctctctccctccttctgccagatgataaaacccgaagtgtgcagtctgcaattcaggagagtcatcaccagagctcagccatgctgacaccctgatcccacatttccaacccctacaagtgtgagaaattaagttctgttgtttataagcttcctagtccatggttctttggtatggcagcctgaactgcgacaaaaatgataccctatcattctgtactccattggacagaagctgaatttttgtccccaaagtgttgaaacaaaacaaaacaaaacctatgactaaaataagttgggttttcctaatgacaagaaacaacttgttgaaacactgaaatttcctttgcttaagagattttttaaaaatgggctgaagttggttggaactaatatggccatctgaagcctgtgaataataagcttgctgatgtcaggacccaaattatcattgcatgtttctttttcttttctttcttttttttttttcttgagacggagtctcgctgttgcccaggctagagtgcaatggcacgatctcggctcactgcaacctctgtctcctgggctccagtgattctcctgcctcagccttctgagtagctgaagttacaggtgcacaccaccatacctggttaacttttgtattcttagtagagatggggtttcaccatgttggacaggctggtatcgaactcctggcctcaagcaacccgcctgcctcggcctcccaattgctggggttacaggcttgagccactgcacccagcctacaccataatttttatatgttttgtcttatatacacctgataaattccctaggaggtagatgctagcataatccccactgtgtatggtaggaggctggggaagcccgaaaatagacaatggcttttactgagtcacagaaatggtaagataaacaaggttctgacccagctgtctcttctattataaaaccaaggctgcatttaggtcttcccagggaattaaggggaaggtgtgatttcataattacatacaaatggaggcctgacatgggagaggaggctgagtaatcagtagcctggcggggcctctggataggtcttatagtaagaaggggcccagtggaaggaaccttgaagagtctaacatacttccttggtgatggaacccaacagaacttaggaaaccaggaccccacctcctagagacaactctgtatccagcttctttggtgagagatgctcaagagagtaacatgctcttccatggtattcttacatttctgagttttagccttacaaaggctcaaagtaaaagccttctccgataatgcagatgtccacttagccctcatttctaatgaggtgcacccacagataacagggcaacccagaacagatccaggccagtcctctcttgtcgtttcatctagacagccccacaccaccccccactgccatgtattgcaggggcatcaagaggtgagggcattcttcctggacagaaccaggttgtcaaatgttgaaactcttgtgggtctgtcattttcatacccaggtcatggctggcaaaatggggacgaagtttatctactcagatgtgaatcccaagactttaagctgtcctctggtttccttcctggctgaagatctatgcagatgttcctatgtgcctgatctgaagagcaaaacttcaatagaggagtcatctatggtaaaaacaaggcaggcaatcaatcttttttagcttggctgctgggcactgtttacagagccgcattcagattaatgaggagctgtttgatgagtctaactcctccatctctttggaaaaagagcaggtgccctacaccactaaccttggccagcactgggctgtggtgagagcaggcacctagaggtctctatagctaggaacctgagaagaccaggacaggcccaggtcccagactgaaatatggaaactctctgacctctgtcctagggccttcccaggagtgactcatagtcctgtttcaatacaatctggccttcattcgtcccagtggcaacttggttaggtggaaagtctctgttcacatacttgtagaaatattagaggaaaggctttcatcttgttttcactttacatcaagccatgagcatttttgcatgttgctacagtttgtattgttttaactccccaccccaggcatctcctgtggcatgcagcttcagtcctacagaacttctccaaaacttaaaagccaacactatgactagggaagtttttatgcaaaaatgggggaatgtgctgtaccaaaaaagggggtgagactactttacgcatgttcctgcaatgtgtcatctcaagaactgatccccatatcccatcagggaaggaggtgtgcatgcacatgtctttataatattccataagtgaggctcttccccaccgtggttcagtctttcagtgctgatgcagcctggtataacatcctatttccatgtcagtcatgctgcagggaatattgtgtgtgtgtactaataggctgtaatcgtttgctaggactgccataacacagcatcacagaatgaagggccttaaaaacagcaatttagtttcttacagttctggaaattagaaatctaacagatgttggtggaatgacttctccaagcctctctccttggcttgtagatggctgtcttctaactctgtgttaacagaatcttctcttgtgcttctgtctttactacctcttcttataagaacccattatatttaattaggtcccatgccaatgaactcacaagcttaattacctctttaatgaccctgtgtccaaatacattcacaatctgaagcaatgctctttttgcctttgtaaaggaagtttgtctgtggcaaatgaataaatggcagaattttacatcatggggtcagtacaaaaaagggaggtgtgcaggggatttaggccactttccttatgttgggaactctaatgtcaccatctgaagggccacttatgaacagaagagttattatagttattatttcttttttattttttaaggtggagtctctgttgcccaggctggagtgcagtggtgtgatcttggctcactgcaacttctgcctcccaggttcaagcgattcccctgcctcaacctcccgagtagctgggactacaggcgtgtgccaccacccctggctaattttttttttttttttttgtattttagtagagacagggtttcaccatgttgaccaggatggtcttgatctcctgacctcatgatccgcccgccttggactcccaaggcaattcttttagccgatctttgtccttcacacagacataacagaggtccctgggtgctgaaagacgggcctcaggcccacttagatattttggaaggctgtggttaggctccattcactaaatacacgtatattaagcacttaacttgcgcagtcccttttgtagctgcttggcataattcaatgaagaaagcagataatcacagggcctcaattctatctgaagagttaaacacagtaaatattaacaggatgtccactgaatattaaatggtgatgtcctcacggcaattttaatctcctggagccaccaactcactccaattggaacactaattatggagtgtgtattacacatggtagtgcttttctgtgtttgttcacttcatttatgactaaacaacaccatgtctgatgtagagacgtaagagttgataaaaaaagaaacaaacactaccatgactgatgacatctccctagtgttcacctaaagaaattaacccaataagatcaataaactcaatgttaattataaaaattaaaagaacaacaaggccaggcgcaatggctcacgcctgtaatcccagcactttgggaggctgaggcgggcggatcacgaggtcaggaaatggagaccatcctggctaacacggtgaaaccccgtctctactaaaaatacaaaagaatgagccgggcgtggtggtgggcgcctgtagtcccagctactcgggaggctgaggcaggagaatggcgtgcacccgggaggcggagcttgcagtgagccgagatcgcaccactgcactccagcgtgggcgacagagcaagactccgtctcaaaaaaaaaaaaaaaaaaaaaaaaaaaaaattaaaagagcaacaaaggaaagattggcttagagttctccaattgaaaaaaaatgtactaaataaaatgttacaacatatttactatgaaattacatgttcaaattattttgcaagcaccattaaattttgtaaaaattattccaataattcccgagcagattatataaagaatactttataaactttggaacaagaaaactggccgggcatggtggctcatgcctgtaatcctagcactttgggaggctgaggcgggtggatcacaaggtcaggagatcgagaccatccaggctaacatggtgaaaccccgtctctactaaaaatacaaaaaaattagctgggcgtggtggtgggcacctgtagtcccagctactggggaggctgaggcaggagaatggcgtgaacctgggaggtggagcttgcagtgagcagagattgcaccactgcactccagcctgggtgacagagcaagactccgtctcaaaaaaaaaaaaaagaaaattatgcattaggtctactatcaataccaggcaagtaaaacctagatttacttaaggagattctgaactaggaaccacaagattttgaaaaaatgaattcaatacaaatgggaaaaatagatttgctttgaaattgtttgaggtttccagtttggtagtaacttatcaacactttaaaaattaccagtttgttctaacatattttctttcttctcaaaataggtacacatccacattcaaatacaattacttgcttcataattcccttacactttatctttagagtaacatatttgtatattaaactttcatgtaagtgaaaacttaaagagtctatgtgtgtctggaaggccacagaggttgcatgttcaaagaaaaatgtgagataacatcttctacatactcacttaagattcagaaatatatggcttttgattatatgcctgtgtaattttcataataatcatcttaatgactctataattagaagaaaaataataaaaatgtaacctatggaaacaatattctccaacgtatttgaagtttaaagtcactaaggataagaatcactagagatgccattccactatattactgaatagtatgttgttaccgtctgttacctagagacttgagtaaggtaaaataggttaatgttggtggcaggataacacctaattcaatgcacaactgtcttaacacattaaaaataattgttttattgaaactaagttcacacagtctaagaaaagcattacaaaatccactatactatctaatgtgcaattggtaaaacaatttactaaaatttgaataatgcacaagactattactctgaacatctatctcatgcagcacttacaagttttataagtcaaccacaaaagtttctctgtgtactttcttcacacacctcatatttcagtgtcctcaatcttctgttgaaaagtatgtaaatgacatcctaatatagaacttctcaaaccccgagcagcagaaattgaccacatgctttcatacagacactaggaataaagacacagcatcaagtaatttgagagttcaattacatcaaaatttgcctttgtaaaaatctaaaattctttcaatgcaaaaagtgtactttgaatataattgtttaagtctcaaaatattaatctcctatttctgtttaggctaactaaattatgttaaccttgaattactctttataatcaatgccctgatttagaataacattgaaagtgttagcgtcttagtggtttctactgtgaatcttctgatgttcatttagacttaattttttattaattttttatatttactgcatctgttaaatgctttcatataaactagcgttctttctttttttttgagacagagtctctgtcgcccaggttggagttcagtggcgcgatctcggctcactgcaagctccgcctctcgggttcacgccattctcctgcctcagcctctcccagtagctgggactacaggcacccgacaacatgcccagctaattttttgtatttttagtagagacagggtttcatcgtggtctcgatctcctgacctcgtgatccgcctgcctcggcctcccaaagtgctgggattataagtgtgagccaccgcgcccggccttaaactagtgttttctaaggtgtactttttaaacaatttttttcatattcattacagttgtagggtttctttccaatgtaaattatctaaaatggaataaaatttgagcaactgttagagggttacctttcagtataaattctcctatgtacaacaaaatctgtaacataagtaaaagtattgcaacaatctttatatttgtaatgtttttcttcagtataaaaactcttgtgtactctaaggcttatatttttgaagtctttccatgtacaaatgtaatgtatcactatcattacaccttgtgtactctaaggcttttatttggtgacatctttccacagataaatgtaatgtgtatcattacacttacattgcttttatctagcacaaaacctctgatgagtaagttcatagtagttattaaatgctttgccacattctttaaaatcagaatttttctcagcatgaattttcttctgtgcaataagctgtcagcaatggttgaagactttccccacattcttcacatttgtagtgtttctctccagtatgaattatcttgtgatttcaatgccttgagcaagatttatggaatttgccacattctttacatttgtaggatttctctttagtaaaaattcttacgtagtaaggtttgagcagtgattaaaagcttccccacattttttatacttgcaggatttctctcctctttgaactctcttatgttcattaagatgtgagcaccgtttaaaagctttgccacattcttcacatttatagcgtttgacggcagtatgaattttcttatgtctagtaaggtgtgagcaccgattaaaggcttttccacattcttcacagttgtagggtttctctccagtatgaattctcttatgttcagtaaggattgaggaccagttaaaagctttgccacattcttcacatttgtagggtttctctccagtgtgaattctcttgtgtttagtaaggtatgagaacctcttaaagactttgtcacatttttcacatttgtagggtttctctccgctatgaattaccttatgttcagtaagaattgatgatgagttaaaagctttgccacattcttcacatttatagggtttctctcccgtatgggttctctcatgtatagtaagtagtgagcagtggttaaaggctttcccacattctttacatttgtagggtttctttccagtgtgaattgtcttatgtttggtgagatgtgagtgccggttaaacgctctgccacagtcttcacatgtatagggtttttctcctgtatgaattttcttatgtctaacaaagggtgaacaccagtgaaaggcttttccacattcttcacatttgtagggtttctcaccagtatggattctcttatgtttagtaagactcgagcaccagttaaaagctttgccacattcttcacatttgtatggtttctctccagtgtgaattctcttatgtttagtaaggtatgagaaccacttaaaggttttgccacattcctcacatatgcagagtttctcttcagtgtgaattatcttatgataagaaaggcctgagtgagatttaaagactttgccacattgcatacatttgaaaagtttctctgtagtatgtcttatgttttctctatttagatttgatgatttactaaagactttcacacatttattatatgggaaaattttgctaggtagagttgacaaacattggttaagtccattataaatttctttttgatccttacactcacccacattttccccatccttccttaagtgtaaatcctcaagtccacagcttccatatcttctcagtatcactttttggaatgaatcttgcatgcactgttctggcaaaaggtcttcagtgtaatgagaagacatagctgaaatatgaaattaacaaaatatcccacttgttattttcagactcagatacatatactttacaaatctaatacagaaaattaagaaaaggacaggatgacttactagatgcagctgggaaacactcactccaaggagagaaaacaaaatgttgagtaaaacatcatactttaaacagatcttttgagaaaaagcttaattcagaggtaatgcagaaactgtggttgaagaggaagatgggaagcttgctcaaagtcactgggcaccaggactggctcgtagatccagaccagtcttatggaagggatatgtgaagaaaccccagggcaacacagtctagccatggacctctgagattctcactttggttccttctccttgaaaggcatttcccagctaaatctagtctgagctcctgattatagactctcatatgatccctatacatctgtgaactggcagggggagccacctggagaataggcagaggcacagcttaaactcttgtggaaatctgcagttttcactgtgctgtgcagctgtagctgaccataggtgcccatcctccgaggctctgcatcttgcactgaggggatccatctgctgctgtctgccaggctgagagagagcaaggttgtagctatcatgggactgaggtgaatctgatccatgcaccactttgcctgctggcaccgtccaagatgacctacctggctggtcctgcagaagggtgcccacagcatggcatccacttatatcacagatggtgcttgaccccaaagggccagaggacaaatccatgggcccagtgccaactgcccaggtcttcagcacactgcctgataatatcaagctgatatatgtggtctgagcttaagtggggtagaagcccacactgtcagcacacagagaagtcatgggatcatgagccagcatgggagctgagttccccttcattcacatgaataaactgggaagggtgtggccagatgaccagtcatggtttccatcccaggaagcctagcagcatagaacatctggaagaactcagcaatttcaatgcagatggcttgggacaagcctagccaattcagcctgctcccagggaagacactggagacagacctgctgagttgggggaccacaagctgggtgggccccacaactacctgctggactaaaaatcctgggctgcaggtgcaatactggttgcaaacccatggtgcaattgccctgcctggtgttccatcctcgagccatggcatcaccaaacgactcacagacacattccataacccatccttacttttgcaagcaaaggagaacagcaggacccctgataaatatgggtctcctggtgacctaaaagtgtgaactgtccctaaggaagggtaagcacagaccaccaaagccctccttggagcaaaggaattgggtgcagtgccagcagttgaagggaatatcaccaaggccccaaaataaatttggaaagaaaataatctctcacacactatcttccctccccagagcactcttaagtgccatctacttggactgaagcctgaattacaccaccaaacaagaatacattgcttcaacatgaagcactctatgaaatccactgcaggaacttatctacaaccaagggacctagacagaacctctgccctctgaaaacaaccttaaatgacaccaactgattatacacaacatacaccacagccaaaccctcaaggaaaaaaagaaataaaaaaattttaacaccccatccaaatgacagaaaattcaaaaggaaaagaagcaccagctccctcagatgtgaaagcgaaagaaagctggcaatacagaaagccagagtgtttcgttacctcaaaaggatctcactagttcctttgaaagaaccaaacacaactttaaaagttgaaaattttactacaggactttcaaaatacaattgaaagccttaaaaacagaatagactaagcagatgaaagtatttcagagctcagagactgctcctttatatcaacccagtcagaagatagtaaagaaaaaagaattcactacaaaaaaacaaagcttctgagaaatatggaattatgtaaaggggtcaaacttatgactcattagtattcctgagagagaaggaaaaaaagtaaccaacttggaaaacatacgtaaggatataatctacgaaaaattttcccatcttgctagagaggttgacacagagatacaagaaattcaaggaactcctttgagatactatacaagacaaccatcctcaaggcacatagtattcagactttccaaggtcaacatgaaatacaaaaataaaaggcaactagagaaaagggccatattacctaaaaaatgaattctatcaaacagtggacctccccacagaaaccttacaatctggaagatattaggggcctgtttttaacatttttaaagaaagaggccaggtgcagtggctcacgtctgtaatccgagctttttgggaggccaaggtgggcagatcacctgagttcaggagttcaagaccaccctgggcatcatggtgaaagcctgcctctattaaatacaaaacattagcctggcatggtagcgtgcacctgtagtcctagctactcaggaggctgaggcacgagaattgcttgagccctggaggcagaggttgcagtgagctgagattgcaccactgcactccaggctgggccacagagcgagactccatctcaacaacaacaaaaaaagagattaaaaaaaaaaaagaaattccaatcaggaattttatgttccagcaaactaagtttcataagcaaaggaggaataaaatatttctcagacaagcaaccactaggtgaattaactaccactagactggcatcacaaggtgcttaagagtgttccaaatatggaaatggaagaatgatacctactaccacaaaaacacacataagtacatagcccacagaccctacaaagcaactgtacaatcaagactacagagtgcatgaagggaacaaaaactaagatatcaatattaaccttgaacacagcagtctaaatgctccacttaaaagacacaaagtggtggccaggcacagtggctcatgcttgtaatcccagcgctttgggaggctgaggcaggtggatcacctgaggtcaggagtttgagaccagcccagccaacatggtgaaaccccgtctctactaaaatacaaaaattagccaggagtggtggcacattcctgtagtcccaggtactcgggaggctgaggcaggagaatcacttgaacctgggagtcagaggtttcagtaagctgatatcgcgcctgcactccagcccgggtgacagatcgagactctgtctcaaaaaatatattaaaaaatttaaaaaactggccagtgcggtggctcacccctgtaatcctagcactttgggagactgaggcgggcagatcaccaggtcaagagatcaagaccatcctggtcaacatggtgaaaccctgtctctaataaaaatacaaaaattagctggacgtggtggtgtgcacgtgtagtcccagctactagggaggctgaggcaggagaattgcttgaatccaggaggcagaggttgcagtaagccgagatcgtgccacttcactccagcctgccaacagagcgagactgtctcaaaaaagaaaaaaaaatttttttaattaaaaaaaaagacacaaagtggcaaatcagatttaaaaaaaaccaagacttaaccttctgctgacttcgagaaactcacctcacgtataatgacacccataaactcaaagtaaagggaaaaagtaacatctatcacacaaatgggaaaaaaacaaacaaaaaaatgcagtggtcactattcttgtattaataaaacagattttaaaccaacaacagtaaaaaagacaaacacattacataataataaaggattcaataaataaatagataaatcaacgatatttaactatcctaaatatgtatgcactcaacattggcacacccatgtttataaagcaattattactggacctaaaaaaaagacttagccagccacacaataatagcggaagacaacaccttacagatagcattacagatcatcaaggcagaaaactaacaaagaaattctggacttaaactcagcacttgaccatagacatctacagaataattcatctaatgaagacacacatacattctcatctgcgcacagaatatactttaagattgaccacatgctcagtcaaaacagatttcaaaaattcagaaaaattgaaatcatcttcttgaaacagagtgaaataaactcaaaactcaatagcaagaggaaccctcaaaactacacaaatatagaaaattaaacttgttcctgaatgacttttgggtaaacaatgaaattaaggcagaaatcagaaacttatttgaaacaaataaaaatggtgacgaggccaggcgtggtggctcatgtctgcaatcccagcactttgggaggccgaggcaggcggatcacgagatcagaggttcaagaccagcctggccaacatagtgaaaccccatgtctactaaaaatataagaaattagccgggcgtggtggcaggcgcctgtaatcctagctacctgggagagtgaggcaggagaatcacttgaacccaggaggcagaggttgcagtgagcggagattgcgccactgcactccagcctgggtgacagagtgagactccatctcaaaataaaaaaaaaacagtgacaaaatgtaacaaaaccttggaatgtggcaaaagcagtgttaggagggtttatagtgctaaacttttatatcaagaagatagatctcaagttaacaacctgataccatgcataaagaaatgagaaaaacgagaacaaagtaaatccaaagctagaagaagaaaagaaataattcaaatcagagcagaacaaaataatattgaaaccaagaaaaccattcaattaatcaaaaaaataaatttttctgaaagataaacaagatcactagatcactagctaagttaacaaagaaaaaaaaggatccaataagcacaatcaaaaatgacaaactatcaatagactaaacagacaacctattgggagaaagtatttgtagactatgcatctgacaaggaactaatgttcacaatctataataaatttaaatcaagccaggtgtggtggctcacgcctgtaatcccagcactttgggaggccgaggcgggtggatcacgaggtcaggagatcaagaccatcctggctaacacggtgaaaccccgtttctactaaaaaatacaaaaaattagtggggcatggtggcgggcgcctgtagtctcagctgctcgggaggctgaggcaggagaatggcacgaacccgggaggcggagcttgcagtgaaccgagatcgcgccactgcactccagcctgggcgacagagcaagactccgtctcaaaaaaaaaaaaaaaaaaagaaatttaaatcaacaagaaaaacagaaataattcattaaaaagtggtcaaaggacatggtcatttctcaaaagacataaaagcagccaagaaacatgaaaaaatgagataaaaagggagaaaaagaaggacaaacagcaacaaaaatcaaaacaataaaatggcaatagtaaccccttctctatcagaaaattaaaattcatggttcatggaataaacttcccaatcgaaagacataaactggtgtaaaaacaagattcaactacattctttttacaagatactcactttcaatctgaagaagacaatagactaaaagaagaatggtacaagtcattctattagaatgttaaccaaatgagaagaaactaggtcaaaattacataaggcaaactacattttaggtcaaaccctgttataaaatatactgtagtcaaaattctcacaagagacaaagaaggacattatataataataaaaagattaatttatatatgttatagaaaactataacatatatattatcatcagggttcccaaatatataaagtaaacattaacaaaattgaagaaatacacagcaatataataatagtaagatatttcaatatcccactttcagtaataagttataaagcaaggtggaatattaaatataagaacagaggacttcaaagcactctaaaaattacacctaatggacatatagcagaatacacagtcttctccatagctcataacacattctcttggatataccacttgttagggcacaaagccattcttagcaaacttttttttttttaattttgagactgagtttcgctcttgttgcccaggctggagcgcagtggcgcgatctgggctcaccacaacctccatctcttgggttcaagcgattctcctgcctcagcttccctagtagctgggattacaggcatgtgccaccacatccagctaattttgtattgttagtagagatggggtctctccatgttggtcaggctggtctcaaactcccgacttcaggtgatccgcctgcatcggcctcccaaagtgctgggattgcaggtgtgagccaccatgcctggcctagcaaacttttaaaaatggaaatcttatagactattattatgaccaaaatggaatgaaactaaaaattagtaatagaaaaaaatccacaaatatatggaaattaaacacattcttaagcatgctcgtgttcaaggatttgaagaattaatactgtacaacatctttacagtgcccaaagtaatgttcagattcaatgcaatccccttcaaattcccaatttcattttttgcaggaataaaaaagcaatgcccaaatcaaataaaatctcaagagaccatgaagagctaaataatctttaaaataaagaaaggtgttggaagcatcacacttcctgatttcaaaacacatgacaaaactacagtaataaatgcagtttagtactagcataaaggcagacaattagaccaatgaaaaagaatgtagcacagatattatctttcatgtatatggtcaaatagttacttgcacacccatattaattgtagcattattcacaaaaatcaataggtgaaagaaacccaaacttctctcaccaaatgaatagaaaaatacaatttataatatacaaataatggaataatactcagcttttaaaaagcagaaaattgggtcggacgtgtaggttcatgcctgtaatcccaggactttgggaggcccaggtgggcggatcatgaagttaggagatccagaccatcctggccaacatggtgaaacctcgtctctactagaatacaaaaaaaaaaaaaaaattagccaggcgtggtggcacgtgcctgtagtcccagctactcaggaggctgaggcaggggaatcgcttgaacctgggaggcggaggttgaagtgagccgagattgcgccactgcattccagcctggcaacagagcgagactccatctcaaaaaaaaaaaaaaaagcaggaaatcttctaacatgtacgataaagagaaatctgatggcatgatgctaagtaaaataagccagccataaaaagacaggattgtataaatccatttaaatgagacatctaaagtagttacactcagaaacaaaatagagaggtgtttgtaaagggtcagtcaagggggaaaatgagtagtttcgtgtatgttgagtttgagtttcccaagataaaaacatgtggagatacactgcacgacaatgtcaatatacccaatacaacagaactgtgtaactgaaaatatttaagattctaaattttatgttatgtattttgcacaattaaaaataaacaattacacctaaaataaagttataaagcttttcaaaaattaccttcaaatcacaagtgtttctctcacaaaaagaaaatatacatccaccaatgaatagatgttgaatttacaacaattctcatgactcctcatctaaacaggataaaaccatcactgatgaccaacaaaaatgtaaatataagagtcacaaacaaaatggggtaaaacctattcagtcaaacacagagataattaaattggtaataaacatatggctgattcatatctgacttttgcctcacactgtcttaaaatgtacagagctgaatactgtcatacaaaattataatatatgaataaaaactaaaaaatataatgaatgtcaaatggcctattataaaaactgtaacaaataaatataaaattgcaaagcaaaattaaaagaaactataacccataaaattctgaataaacatagtggagtactgatgaagaattcttctagatagctacaattttcaaccatgactggctatccataaaaagcatacatttttgaatcaagagcatacagttagagcattaatatttcacagaaaccccattataattattcataaaaagctttgagaaaataatttttaagaaataagcacttacataatactagggaaacttattaatatgttgctcttctttttacacaaaatggtaaggctgtaatctagcctgcagaagcaaagaaaagacttacatcttttactgtaagaacaatataaatattgtaaaatacggtataaaacactgattatgaattaggaataaattatgctatcattcagataaacgttgaggaatatagatgaaaatgcaaagaaagctttttacgtgcaggcaacttaattatacaaactaagccgggcatggtggctcaagcctgtaaccctagcactttgggaagctgaggcgggtggatcgcttgagctcaggagttcaacaccagcctggacaacatggtgaaactccatctttagaaagaatacaaaaattagccaggcgtggtagcactcgcctgtactgtcagctacttggggggctgagtcagtctatagagccagtctataaatatttattttataaatttccaaatgtcatccagagatcacagggcatagagagaagacaggaaatatattcctttaaaggaataaaatgattcttcggaaatcaatttttgagaaatgaagatccttgtattatctgacagggaattcaaaataatcattttaaacatgttcaatgagcaaaaatagaatgtagacaactaaacagaatcaagaaaatagtgcatgaggaaatgatatatcaacagagatttaaaaaactattaaaagtattttttaaaaaaacaaaaattgtggaactgaatacaataactaagttaaaaaaattattacagagccacaacagataacttaatgaggtaatagatggtatcagcaaattaaagacatttcacttataaatattgagtcataaaagcaaaataatactgccaacaaagaaaattttacctggaaaaatttacctctagaataaggataaaaaataaagactttataaggtaaacaaaagctgtcagtctttgtcaccatgtgtatagttctataagaaatggtaaagtaaatatatacacagatctacaattctctactataataataatgcataaaactgaaaatcttgccatagaatttaataaaccaaaacacaaatttgcataaatctgttaatagatacgcaatacgaaatgatataatgtgacactaataacaaaggatgtaaaaaggtatagttttatattcaactgaagtaaagatgagatttaagcatattgttatgtttcataaactctcatttttcaaggtgatcacaaaaatacctatagaagatatgcaaaagaaaatgaaaaaggaatcaaagtatgccactacaaaattaacaaaacaaaaacaaaggcagtaagagaggaaatgagggaaaacgtatttatgacaagcacagaacgtaatcgaaaacaaaacgcaactagtaattttatttctttctggtattattttaaatatgaacagattgaaccctttaaaaaagtaaaatagctgaatgagttaaaaacaaaatcttacaatatgcgtctttaggggactcattttagttttaaggagacaaacaggctgaaagtgacaggatacaaaaatatattccatgcaaacagtaagctcaagtgggtggggtggccatagttagacaaaatccactttaagtaaaaaattgttacaaaagataaagattggtattatataatggcaaaatggatccatttaccgggaatctataacacatataactgttatataactataacacatagcactctcaaatatataaaacaaatattgacagaaggtaagcaagaaatacacagcagcacaataattatagatttcacggcctcattctcaatcatgaatataaaaaaaccagatagatcaataagaaaataaaaaacttaaaacattacagaccaattagacctaagagacacatacagaacgttccagttaaaagcagcagaatacatgatattctcaattacacacagagcattctgttaggacacataacaagtcttaataaatttaaggagactgaaatcatacagtgtatattttctgaccaaaatggaatgaaactagaaatcagaagcagaagtaaaaccgtaaatccaaaaaatgtggaaattaaacccactcaaacatattcttgctcaaggatcagataatttcattttgttaagatgtcaacatgcacagccacgtacaaattcaatgtaatatctatcaaaatctccatggtagtttttattttttttttttgcagaaatatagttaagattctcaaattctttttttttttttttttttttttttttttttttgagacggagtctcgctctgtcgcccaggctggagtgcagtggcgggatctcggctcactgcaagctccgcctcccgggttcacgccattctcccgcctcagcctcccaagtagctgggactacaggcgcccgccactacgcccggctaattttttgtatttttagtagagacggggtttcaccgtttttagccgggatggtctcgatctcctgacctcgtgatccgcccgcctcggcctcccaaagtgctgggattacaggcgtgagccaccgcgcccagcctctcaaattcttttaggagctataactagcaaaacaccctttaaaaagaacaacaaagaggtattacacttcctggttttataacacattacccaaagctataaagatagaaataatgtggtattagcacaaagaaaaataaatggatgataaaacaaaatagctcagaattaagcacgtgtgtacataatcaaataaccttacataagattgctatggccacacaatggggaagaaaacagttttttcaacaaatgatgttgaaaactgagtatctacatgaaaaaaataaagttgagcccttccgttacatgcaccatataaaaacagtatttaaaatggattaaatacttgaacataaaaatataacaaacttcctagataagtatatgggggaaaatatgacattggacttggcactaatttcttgttacaaaagaccaagaatttgatgtcattttcttagctctgaaatcaaatgcataaggaacaaataatagagaaatgggactacatcaaacttcagaatttctgcacatcaaaggaaaaatttagtggggtgaaaatgtcacctaagaaatgggtgaaatatttgaaaatcacatatttgataggagttaattttcacaatatataaacaatgtctaaaactcaacaaaaagtgagttacttgattaagaaacagacaaataattgaactgacatctctccgaagaagttacataaatagcctataagcatttgaaaggatgctcaagattgctaacttttagaccaacacaaagtaaaatcacagtaaaatattacctcaaacccattaggagagccattaacaactgtaaccacccccccaaaaaaaagtgttacggatatggaaaattgagaggccttttgagccactggtaggcaaaaatgatgcaactactgtaaaaaacatactatgaaggtttttcaaaatattaaaaatggaattactatataatccagcaaacatggaaaatcctatttgatactgttcttggcagttattttttgaggtatgacaccaaaagcacagcaacaaaagcaaatataaataagtgggactgcatcaaactgaaaattttctgcacagcaaagaaaataatagaaggaaacttacaggatagaaaaaaatatttgcaagccatacgcctgataagaagttaatatccagaatatataaggaactcatacaaatcaaaggcaaaaacaataataagaatgataataagaacaaaactgaaaaacagactgaatggatagatatttttccagtgaagacaaagagccaacaggtatgagaaaaggacctcaacatcaccagtcatcaggcaggtgcaaaccaaaacaatgataaaatatcacttcacatttgttaggatgtctattatcaagagacacttatattttttgggtgatgtataccctaaaagcactgacttcaccaccatgcaatctatctgtgtaacaaggttgcacttgtaccccacaaattcatacaaacaaaaagaatagggctgggtatggtggctcatgcccgtaatcccagcattttgggaatctgaggtaagaggactgcttgagcccaggagttcaaggccagccctagcaacacagtgagaccccttctcttaaaaaaaaaaaaaaaagaaagaaattttaagcataaaaacatttttaaaaagagataacaagtgttgacaagtttctgaagaaaaaaatcttgtacactgttggtgtgttgtaaactggtagagtcattatgaaaaccagtatggacgttctttaaaaaataaaattaggccaagcacagtggctcacacccgtaataccagcactgtgggaggctgaggcaggcggatcacgaggtcaggagttcgagaccagcctggccaacatggtgaaaccctgtctctactaaaaaatacaaaaattagctgggcgtggtgacaggcacctgtaatccaagctactcaggaagctgaggcagcagaatcgtttgaacccgggaggcggaggttgcaatgaactgagattgtgccattgcactccagcctgggtgacagggtgagactccatctcaaaaataaataaattaattaaattaaattaaattttaaaaaaattccacataatccagcaatcccacttctgtgtatgtaaccaaaggaaataaaatcagtatttctaatatttgcatctccatgttcatttcacaattgccaagacatgaaaacaacctgaatgtttgtggaccctgactggataaagaaaatatgacacatatacacaatagagtattattcagccataaaaaaatcatgaaatcctgccaacatttcaacaacatggatggacctggaagacattatgctaagtgaaataagccagacacagaaagaaaaataatgcatgatcctcagctctatgggtaatctaaaaaggatgaactcatagaaacagagagtacaaagctggttgacccagtctcgaagtggggaaaatgggaagatgttcaatgagtatatacttccagtcctgaaatgaattaagttttggggatctaatgcatagcatcatggctatagttaatcataatgctctatatcaggggtatccaatcttttggcttccctgggccacagtggaagaattgtcttgggccacgcataaaatacactaacactaatggtaactgattagcttttaaaaaaatctcatgtttaaagaaagtttacaaatttgtgtttggccacattcaaagccatcctggactgcatgcagccagcaggacatgagttggacaaacgtgctccatatgcttaaattttagtaagacagcagacctttcactgcaaaagaaaactctgcatggtggcttaattccagcacttttggaggccaaggagggtggatcacatgaggccaggggtttgagaccagcctgtaatcccagctacttgggaggctgaggcacaagaatcacttgaacctgggaggcggaggttgcagtgagccaagattgcgccactgcactccagcctgtgtgacagagtgagactcgtctcaaaaagaaagaaaacaaaaaacaacaacaacaaaaaactctgtgaggttaacagatgcattcattaacttaactgtattaatcacttcacaatgtttacatatacaaaatcattacactttacataataaatagttatatacttttaatttgtgaaaagtaaccacacggtccccacacgtatatgtgtgggtttatttgtgtgtatatgtatacacacctcaactaatatagttgaagaatctgggaaaataaagtttaaattaccaattttagttcacactaaaaatataaaatgtagaaataaaataacattagattttcttatatttagggagatgcttagcattataacaaaattactgagtaggaatttttgtagaatcacatttgaaaattccataaggggctgggcacggtggctcacacctgtaatcccagcactttgggagaccgaggcgggtggatcacctgaggtcaggagttccaaatcaacctggccaacatggtgaaaccccatctctactaaaatacaaaaagtagctgggcatggtggtgtacgcctgtaataccagctacttgggtggcttaggtgggagaattgcttgaacccagaaggcagaggttgcagtgagccaagatggcgccctgcactccagcctgggtgacagagtgaaactccgtcgcaaaaaaaaaaaaaaattattaaaaaaaaaagaaagaaagaaacttcataagaaatcataaagcagaaaatacaccacatctgtttgtggtgttactgggattttggaaccaaataccgttatcacgaatactctcacacatttcagacataatacaaacaaaaacaaaacccaaaaccaaaacaaaacaaaacaaaaaccttaaaaaatagtttaaaggccgggcatggtggctcatgcctgtaatcccagcactttgggaggctgaggtgggtggatcacctgaggtcgtgggttcaagaccagcctcaacaacttggagaaaccccatctctactaaaaatacaaaattagctgggcgtggtggcatacgtaatcccagctactcgggaggctgaggcaggagaatcgcttgaacccaggaggcagaggttatggtgagccaagattgagccattgcactccagcctgggcaacacgagcgaaactctctctctcaaaaaaaagaaaaaaatagtttaacatagagttcctcaaaaatacacatatatttctgtgtgccccaagacaatgaaagggcagtcagataataaagtctcttataagccatgaagaggactttggctctcactataacctcaaagtaaggttactttttagagaatttaggagcattagacagaagatgcctctgtacaagagcaagaataaacaatcacgttcctcaaaaatcatctccattggagcagagcttctcaaataactcttgaagtctgtcttccttcttggcctttggagctttcacctgtggcatgtgtttcattcatccaacctacctgggggtttggctatggtctcatgtctcttcacattccagggctcctgtctttgctccagacggctaatcagttctggcttagaaacagtaagacctgttttattagaaaaaagtaatgtgattcttgctgggattctccaattaccaacctagtgttgtgctctgtagataagagagaatattatagatgattctagaaaattaataataaggacaggcgcgttggctcatacctgtaatcccaacattttgggaggctaaagcaggcacatcatgaggtcaggagatcgagaccatcctggccaacatggtgaaaccccatctctactagaaatacaaaaatgagcaaggtgtggtggcacgtgcctgtaatcccagctgcttgggaggctgagggaggagaatcacttgaacccggaggcaaagattacagtgagccaagattgcgccactgcacactccagcctggcaacagagcgagactccatctcaaaaaaaaagaaagaaaagaaaattagtaacaaaataatatttctaaacagaaagtttagaatattttatatttgtgggtctttagcttccctacccaatactacttaatcgaaaattggtggtagaagttggattttaaggtctggtcaataatattttataaaggaatttttataatggaattccaagaattaccactaaaggctgggtagggtagttcacactagtaatcccaacacttcgggaggccaaggagggtggatcacgtgaggtcaggagttcgagaccagcctggccaacatagtgaaacctcctctttactaaaaatacaaaaattagctggccgtggtggtgggcacctgtagtcccagctactcaggaggctaagacaggagaatcacttgaacccaggaggtggaggttgcagtgagctggattgtaccactgcactcaagcctgggcaacagagctagactctgtctcaaaaaataaaataaaataaaataaaaaaatagaattaccactaaactagagtgaaaaatgcccatcacctcaaggtagaagaaagttaatgtaaacataaaacatcttgaaaattttcttctctatcccaacaaatccccaagttttccttgaaagcagagatctaaaactcatttatacaaagcagaaatccccaccaaacattctacagaggaagaaaataaaatcttttgtgtgaaatagaaattgtgtattgaagttattctcacccagagagaccaggtttctgtagttctctagcatcactttcctatacaaactctgctgagcagggttcagaaactcccactcctccagagagaattctatggtcacatccctgaatgtcaacagttcctgaaaaacaaaacaaaacatagtgaccaactgtcaatgggcagagttcttgactccatgtgaaaagagagaattgctgtgacttatgagagttactggaattattcaatctgctatttttaacaaatatattctctgatgtattctctaacactgaggaaagaaaacagaatccatgtggccaggttcggtggctcacgcctgtaatcccatcattttgggaggccgaggcaggcagatcacctgaagtcaggaatttgagaccagcctggccaacatggtgaaaccctgtctctactagaaatacaaaaattagctgggtgtggtggtgcacgcctgtaatcccagttacttgggaggctgagggaggagaatcacttgaactcaggaggcagaggttgcagtgagctgagatcatgccatggcactccttgcctgggcgacaaacaaaaaggaaaacagaatccacaaaaccaatgtagatacttttctaaataatcactataaaattaagggcatcaacacaggcatatacagtttgagttttatgtctacagattatagaataagttgtaaatattattcatacagagaagtcatgatgggttagaaggtatctgtcaaattttaatgtacgtgacaatgaactacagatcttgttaaaatgcagtctgatccaggtgatctcaggtgaagcctgagtttctgaatttctaaaagctagccagttgataccaaggcatccgaatcaagaatattttgtcaaacacaaagtggttgagccccagtttatctgactagtaaacaaagatgagccttcattttccaaagcaagctttaagcaaagagaatctaaaaagaaagggaagtttgcagattaaatgtgatggtttatgtacatcagtcagtaaatctcccaaggtacttacgaataataaagataaaaataattaactttataattaaaaaaaatctgtcacagagagccttaaccaagtgattgaaattaacatgaattgggccaggcgcggtggctcacgcctgtaatcccagcactttgggaggccaaggtgggcagatcacgaggtcaggagatcgaggccatcctggctaacatggtgaaactccatctttactaaaaatacaaaaaattagctgggcatggtggcacgtgcctgtaatcccagctactcgggaggcagaggtagcagaattgcttgaatgtgggaggcggagattgcagtgagccaagattgtgacattgcactcaaacctgtgcaacagtgcgagactccatctcaaaaaaaaagaaaaaaaaaaaaagaaattaacatgaactacaatagaacaaattgatgtacagtgtcaacacacatgggcagacaatcatcagagctatgatattattggcaacaaaaagtaaattataacctgaatctaagcataaagaaacatctttatgcaaagttcaagctacagatatctcccaggttttataacctctaataatgtatttaagtagcctttcctcagcatttgaaagagcaagtcttatctaactattctcttttccagaatattctgagttattctgggcaattagtgacatcctctttaaatgtgcatttttaaaatcctgtttctggccaggtgctgtggctcacgcctgtaatcccagcactttgggaggctgaggcgggtggatcacaaggtcaggagatcgagaccatcctggctaacatggtgaaatcccatctctactgaaaaatacaaaaaattagccaggtgtggtggtgggcgcctgtagtcccagctactcgggaggctgaggcaggagaatggcgtgaacccaggaggtggagcttgcagtgagccgagatcgcgccactgcactccagcctgggcgacagagcgaggctccgtctcaaaaaaaaaacatcctgtttctgcatagagctgatggaacatccagatggaacctaaacaatacacattcccctcttcactaatatctgaggaccctataccatccctaatagagatcttaggtatctacacctttccacattgatgtgacacaaagagaactttatttatttatttatttttgagacagtctcactctatcgcccaggctggagtgcagtgagtggcatgatcccggctcactgcaacctcgcctcctgggttcaggtgattctgcctcagccttccaagtagctggaccacaggcacgtgccaccacacctggctaattttttgggtttttagtagatacagggttttgccaggtggctctggctggtctcaaactcctggcctcaagcgatcctcctgcctcagcctcccaaagtcctgggattacaggcatgagccactgtgcccagtcacaaagagaacatttttattcttacaggtcatacactcgatggtgagaactggtcatggtatgtaagaagcctggatacaaagaataaaggagaaggctctgatatataaaagagaagtatttttcagcgcctcttaactactatagtaagaagtaatatttataagaagaaaaggaggaaaaaaagtatctaaaacaaactggttaggtaggaacatcagaagtagagaagtaaaagtttgtaagttctaaagccaagacattcaagaacgaaaagagaacatcacccctgagctgggacacattcacctgagaaccagccatttcttcctcttgctcttccctttgggattccttctcaggtgatattatctggaaaatcacatctgtaacttgagcatacgccttttaaagcatcagcaaaaccccttcacctgctaccaccgcacccacaggcagatgtaccttaaaggcacagaaaaggccacacttgcttgtcctttgtcattgtcacaggagaatttcaggaacagtgagcttctacctaaagactaaaatgtgagtctccagtttcctgcctttagatgcccttccatgccagagatggcagcaatttctgctgcagcaaagggcccatagggccccactcccctgctcccatgaaaaccaagcacagcaggccccatgacctctctttaaaacaaagcctgggggctaggcgctatggctcatgcctgtaatcccaacactctgggaggccaaggcaggcagatcatctgagatcgggagtttgtgaccaggctgaccaacatggagaaaccttgtctctactaaaaatacaaaattagccgagtgtggtggcgcatgcctgtaatcccagctacttgggaggctgaggcaggagaatcacttgaacccaggaggcagaggttgtggtgagccgagatcgcaccattgcactccagcctgggcaacaagagcgaaactccatctaaaaaaacaaaaaagaaaaacaaaaacaaaaaaaaaaaacaaagcctggggaggctgagtcaggagaatcacttgagcccaggagacagaggttgcagtgagccaagatcgcgccactgcactccagcctggggcctgggtgacggagtgagactgtctcacacacacaaaaaggctgaactcaattctcacttatgtctgggagccctcatgattgcctctggctttatcttacaattacatgggacacttaattaaaacaatatggatgcttccacccaggccaacataatccgtcgagaggacacaggtaagggtatttcttcaaactggccatttaatcctaactagaatgtgatgagctgacaatcacttagctaagaattgcctcttaaactttaatattcggagaaatcatctggtatttcaagccccagactaatttgattctgcaggtttgtttgtttgagacagagtcttactctgtcgcccaggctggagtgcactggcgtgatctcggctcactgcaatctttgcctcccaggctcaagtgattctcctgcctcagcctcccaagtagctgagactacagtcacatgccaccatgcccgggtggctaatttttgtgtttttagtagagatggcctttcacgatattggctaggctggtcttgaactcctgacctcaggtgatccgcccttctcagcctcccaaagtgctgggattacaggtgtgagtcaccgtgcccagtcaattctgcaggcttgaaaggagtccacggattggcttcattcacagctaatgctgaccctgcttgccctagatcacttataacagcactcaactagacaaagcgccacagcacacagtcccttatacctacactcttcttagaacacaaatgcttttggtccaaaataaaaaccaccaatcactattctaaaacatggcgttctctgttggtcctttaaagtttccagaggcagctcatgtctgagtaagtctgcatttggaaaacaacacgcgcacatgcattaatgcgatgtttatggagcatgcgctgtgtgctcagaagcacactatagagcattgtgctgggaagatgacataatgtgaatttatcctcataacaccctgggaggtgggtactaactgtcccataattccctggatttatatgaaaagcccagcatttaaatttcttcttgttctatcactgattttttttttttttttggagatagagtcttgctgtgttgcccaggctggagggcagtggcacgatcttggctcactgcaatttccacctccccagttcaagcaattctcctgcctcagcctcctgagtcactgggattataggtgcctgccaccacggccagctaatttttctatttttggtagagatggggtttcgccatgttggccaggctggtctcgaactcctgacctcagttgatctgcctgcgccccggcctcccaaagtgctgggattacagacgtgagtcaccgcacccagcctttcttttgttttcttttttttttaaatgcatggaataggccaggcacggtggctcatgcctgtaattccagcactttgggaagccaaggcaggtggatcacctgaggtcaggagtttgagaccagcctggccaacatcgtgaaaccccatctctactaaaaatacaaaaattagctgggtgtggtggcacacacttgtagccccagctacttgggaggctgaggtgggagaactgcttgaacttgggaggcagaggttgcagcgagcagaaatcataccactgcactccagcctgggtgacagagtgagaccctgtctcaaaaaaaaaaaaaaaattaaaaaaaataaaaaagcttgaaataaaagctgaagatagacacaagaatgaaatacagaacgggaaaattaagtgtagttcaaagggatttctcagcattgggtttatatttactttcttgtgattcctggagcaactgctggatatgcaggaatagaaaatggtttgctaggtggtatgcctctagaaacagtggttttaattaaaaaaaaaaattaaagaccaaaaatatttagttatttgcttccatttatctgcttttgggtttggaagaattgtgaacaaccactctggagaggcagcaggagccaaactctgatctcctttaatcaactctgtatggagattccaaggtggagccggacctggatgaggcctcagaagaggtgaaacgtgggtaaggctgggacagggagagggccctaggtagaattctgatctccatgtcactggggtatttccaattctgtgttttctaagcctgcccaagagaaacttgactccccaggtttgtgtgattttaatctatttcacccaattccctgtctattttataacatacagtaacaaggaatttaaccaaaatgcatagtgttttctaggacatgtatattagaagctaaatatttagtcttcacaaggtaaaagcaatagaaataataactatagggctgggcgcggtggctcatgcctgtaatcccagtactttggaagaccgaggtgggtggatcacctaaggtcaggagttcgagaccagcctggccaatatggtgaaatcccatatctactaaaaacacagaaattagccgggcgtggtggtgcacgcctgtaatcccagctactcaggaggctgagacaggagaaaatcactagaacccggtaggcgaaggttgcagtgagccaagattgcaccactgcattgcaacctgggcaacagagcgagactccacctcaaaaaatagaaaagaaaaaataactataataacaactcttctgttcatgagtggcccttcagatggtgacatcagagttcccaacataaggaaagtggccctaaatcccctgcacacgtcccttttttgtactgactccatggtgtgaaattcagccatttattcatttgccacagacacagttcctggattgcagagattatgattgcctcatctgtttttctaatcgccatatgaaatgaaagtaattggttgatcagtctccagctctccttttttttcacccaagtgaaaactggaacaactcccatctaggaaccaaccaaagagattatttttgtgagaaagagaagaaacactgaatgacttattcccctccctcttagatggtagcagaattagaccctcttgtcagcctcaccccagtctgcacacaacaacctcaaatgtctcaaagactctcaggtgctgggaagagggtctacagtcactctgggttgatgtcctcatggcaatccaaacaggaaacactgagactgattctgtgggaacagaatagacaatagaacttccctggtagagcttcagatcctaaacccatatgtgatatcacctgtccttaatcagttagcttgggtaagaggaatgacaggaatattttattccagtatcacagcttacaggtaggtgtggttgttatggtcatggctgtagatattttgtggcctggaccccccactgctggggtgattctgccatcagattctatttacaccaagagcctctcacacaactgcagcaggtcagaggacaagatctggaaattttcaaggaccacactttgaagggtggggctctaaaatgtcgatgttgacctgtcacgatgcagaaaatgtttcctatgggctttctgtacattctcaatccaaagtcaggtcctgtctcatgagtcccagaagccagtgcttatatgcagattctagtgacatcaacctggctgtgcattattgggtgttatagcatgctgcgcaaaaccagaggagagatccagtcatggagactgctctaacacattataaatgatatgtcggccgggcacggtggctcacccctgtaatcccagcactgtgggaggccgaggtgggcggatcacgaggtcaggagatcaagaccatcctggctaatacagtgaaaccccatctctactaaaaatacaaaaaattagccaggcgaggtggcgggtgcctgtagtcccagctactcgggaggctgaggcaagagaatggctaaaaaaaggggaatagaaaagtgggccgataaaaagttctttgtcaaggattctcattagtttacaggaataacattgattagtgattggccatacagggttaagctagaaggtgtgggctatagtgtcctgtgtggcattattagattaatttatagctatgtgtggcagtaacaagcagtttcaagaggtgaatacattgctcaaaggagaagtaggacataattctggattcattttaatgtctctctgagcctgataactaacagaacttgcatccctcagataaaagttcttttactttctcaaatcccagggcctggattcaaatttgggggtttcagatttaggttgcagaggtatgggaaagtagcaggtgccctttgcacattctcaggcatttgtacaggaggaggaaaagaacattttaaattcttaggtctaatcaatgcatatgtgtaaccctgacagggtttgtctctgaattcatttcagatttgaagatgccagggacattgaaagaggtggaatggttggttgctgccctgtaaggttatttttgtagaaatctgatctgactgctctacaagggactatagatcacaaataggcagagagaccattttgcctgcaatttggggtttgcacaattgtgggttgtgacttgaagcccaagagggaaagaccctctagggtgaagtctgatgggtaccttacatgtttatatcatacctggtcatttcagacagtgttttcaaaaatgtaattaaaagcacaatcatctccaaccccagaaaaactctccacaatggcagaacacaaagcaaaaaccatatgattacacaattaagccagaatgtgacattaattgcaggcaatttgctaagagattgcaaagatagaaagaaggttgtcataattagtcctcaagaagaccacgtgacagcactcacttgtcgtagatagtttatcctaaacccacctgggaattggggaggtcagttgattatattctatgaaagataaacttcccacatcttcatgacaggaggtagttttgcaacttggagccaaattcaggtacttgctgaaggtagggttttacttctctgtagaaactgtggtgccaggtgcggtggctcactactgtaatcccagcactttgggaggccgaggtgggcagatcacctgagatcaggagttcgagacaagcctggccaacgtggtgaaaccccgcctttactaaaaatacaaaaaattagccaggcgttgtggtgggcacctgtaatctcagctacttgggaggctgaggcagaggcaggagaatcacttgaacctgggaggtggaggttgcggtgagccgagatcacaccactgcactccagcctgggtgacagagggagactccgtctcaaaaaaacaaaaaagaaactgtggaagagggatctatgttcttggctatttatatattaaatcaatggttcctgactcagagtactgggccatggtgcttctgcccatgaagcttagcctacagcctgcagcccacacagaccctcactgctgcatctgcgctccagcaccatgccacagagcagagccctgggctgcaggaggagggcctggagcactcctggttagaattgtattttcacaataatggaaatgaaagtggtgttccagcctaagtttctggggttctcttctttttgagatggagtctcgctctgtcacccaggctaaagtgcagtgacgtgatctcggctcactgcaacctccgcctcccaggttcaagtgattctcctccctcagcctctcgagtagctgggactacaggcgtccatcaccacgcctggctaattttatgtatttttagtagagacagggttttgccatgttggtcagactagtctcaaactcctgacctcaagtgatcctcctgccttggcctcccaaagtgctgggattacaggcatgagccaccacgcccggcctccagcctcagtttctactgacaacgatgacatggaaaaagtactactggatgcccagcaagaagtctggatggagttgctccacgagttgtcaccgtgacagcccacctcactcacagacacaaggaaccaacagagcttctgaaacacccaaggcattggagagaaaaacagttattagtctgtggaagattatattgacagaaagaaagaaattgaaagcatattgaaggaatactcagattagatatgggattggttaagtgagcaagaaaaaattccccccaatgtttctctttaaagaaccaaagtgcacagctactctcagcatgagaaacacacgcattctgaagaacagatacatattctatccagaatttctagaggtttttcttccatctttgctgctgtctcatctgctggccattggactagggatttatattggaagccatctaacaacatccaccagcatcttttgatgaggaataggaaaccaacgttgttcacatattggaattatatctgagcttgcggcatagctaactgaagagctattatatccgtgggtgggtgactgcatccgttgcatttattagttctgtaaatgccgcatgcctaagttagtaaaatgaaaaaatagggccaggcgcggtgactcacgcctgtaatcccaacactttaagagaccgaggcggacggatcacctgaggttgggagttcgagaccagcctgaccaacatggtgaaaccacctctctactaaaaaaattagccgggcttggtggcgcatgcctgtaatcctagctactcaggaagctgaggcaggagaatcacttgaacctgggaggcagaggttgcggtgagccaagattgcgccattgcactccagtctggggcaacaagagcaaaactccatctcaaaaaaaaaaaaaagaaaaaagaaagaaaagaaaaaataaggtcaggcccggtggctcatgcctgtaatccaagcactttgggaggctgaggcgggcagatagcctcaggtccaaagttcgagaccagcctggccagcatggcgaaaccccgtctctactaaaatccaaaaaccagccgggcatgttggtgcgtgcctgtaatcccagctactcaggaggctgaggtatgagaatatcgcttgaacctgggaggcacaggttgcaatgagtggagatcatgccactgcactccaccctaagcaacaggctgaaattctgtctcaaatacatatatacatatagacactaaaatcatgctgacctataatcatacctgttggattaattaataagcatattaattgatgtgacagaggtggggttaatatctattgtaacaatttgttactatattttttcctttttttgagacggagttttgctcttgttgccacggctggagtgcagtggcatgatcttggcttactgcaacctctgtcttcctgtttcaagcaattctcctgcctcaggctcccgagtagctgagattacaggcgcccaccaccacgccaagcaaatttttgtatttttagtagacacatggtttcaccatggtggccaggctggtctcgaactcctgacctcgtgatccacccacctcagcctcctaaattcctgggattacaggtgtgagccaccgcacctggcctattttcttttgatataagatataaatatcttaggataaacaattttaacatattagtcataacgtatgtagtattagaaaattatctgtaatattaattcagttaaaataatttatatttcaaaagaatacagaatatcaaaatcattattttaaagcagtttgtccaaaataaatattgtgctgttatattcactattgtacaaaatactgtttgtttgtttttttttgagatggagtctcactctcttgcccaggctggagtgcagtagtgtgatcctggctcactgcaacctctgcctcccaggttcaggcaattctcctgcctcagcctaccaagtagcagggattacaggcgttcaccaccacacccaactaatttttgtatttttagtagaaacgaagtctcactatgttggccaggctggtcttgaactcctgacctcaggtgatcctcccacctcagcctcccaaagtgctgggattacaggtgtgaaccactgcacccagccgaaaaaatactctttaatttaaatggatgcagtttgtctacacaagagtacatataactatgccaactgttcttaaaatataaatagaaaccaaggtacagagcgtactctgagctggtcttgctatcgcagcataagcccttcagcctgcacatattagtaattaccttggagcagcagttttctattgaaaacacctatcgtttttatctctccagatactgaagagatacccttctgtatctgtgaccctttagctttctggattgctgaattaaatcctatccttcgtgttttctgagacaaagttttgctcctattgcccaggctggagtgaagtgggcagatcacctgaggtcaggagttcaggaccagcctggccaacatggtggaaccctgtctctactaaaaatacaaaaaattagccaggtgtggtgacgggcacctgtaaacccagctactcgggaggctgaggcaggagaattgcttgaacccaggaggcagaggttacagtgagccgagattgtgccactgcactccagcctggacaacaagagtgaaactccatctcaaaaaaaaaaaaaaaaaaaaaaagatttacatatattttgaagaagcagagaaaaaaggtacatataaaagttttctaggccgggcatggtggctcatgcctgtaatcccagcattttggaaggccaaggcaggaggatctcttaaggccaggtgttcgacaccagttccgggaacatggtgagatgctgtctctataaaaaaaaaagaaaaaaaaaaaaaaaaaaaaattagctaggcaagttggtgcatgcctatagtcctaggtaactgggaggctgaggtagcaagactgcttaagcccaagagttcaaggttatagtgagctatgatcatgccattgtactctagcctaagtgaaagagtgagactctgtctcaaaaaaatcaatcaatcaataataaaagttttctaaattctatccttcaggaaaaggcaaaagaacaaaatgtcttccctcattttcaagtgggggaatgaagccccttatttctaatttgtatttgcttctgcaaaaggtaggtctaggcccatggtcttgaactactggacatctgacaactgaggggtggcgttgggcacactgtgtgcacataaaaaaagggtttgtgggggaactaaaaggcaaacgagggaaagttgctatctagaagccatgggtgggacagtgcagggttacggaaggactggttcatgctatagattgtgtcccaggagaggctatgctctgacttcttcctgtgtccatgcaggcagatgagactataatcaggtggcacagaagcctgggttggtgaaaaaaccaggttgccagtacagactacctttcaagctctactgataatttacacttaattaaaaactgaagttaaaataagcaaagaaatctttccaaggtgacaaactcaggaagcggcaatactgattggaacacagacatatctgactcagatgtcaagtcaagccattctatcatttgggacattttcccgccccatcctgctcactgaagtggacaataaccattctaccaagagccactgtgctgtgccccactgtgtcccttagatgcattttgctttgcaggtttttgcactgcctcactgggttgggtgttccttgtccttggggatattttttttctctcttcaccaatctgagaaaattttctcctcaatactagcatccaaattgcctggccagcactgtatctctaagaaatggaaactgggagttggggaagaaaatcttaatgtcctaatggatttgctttcagaggaaaggtatacctgatttctcccaggcacaatgcaccaaccactccacagagaggccacattcccatacctggcagggttgcccctgagaggagatggcccaggggctgatattcactagacacctcaggagacacagccactgtgggcatctcatgtcatccccagacagttctgaaactcaaaaccaggaaaataacacagggtggctgaggatgcattgccctgtgaagtttccaaagtggaacctcaacccaaaaacattctgataaggtgtctgtgcctaggaaagattaaagggagattggcacaaaggtttttgttttttggtctttttttttttcatggtggagtgttgggattattctctgctttcatctcctgtaaaatgtttgcaaatgaaaaacaattctttttctaaaaagtgccatccgctgctctttgaaataatgatcaatcaaaatactgtgtctgaaatgtacaaaaaaggactaatagttgataatgttgtgaattagagaggggaagttggtgttgaagaatgtcaggaaagaactgaaaatttaaaattcaactgcaagtcagagttaggctggggcaacagagtggtagctttgagattctgtttgtcacacatttggaaaatccaagagaaaaccacttctgtggagtgttaaataaatagcaggcagttagactgaggtggctctagtaccctgagttcctacattaaaaaaaaaaaaaatcaaaggcaaatacatttcttgtaaattgctaccttagggggaaacaaaattcagatttttcagatttaagcaaccacaaaccttcaattaacttctgattacataaccaggcaatgacaacctgaatagtctaaataagatgactacataactggaacgagtcagttactgaattcggtttgcttcatcctgcactttataaaaaactttccttcaagctcttcggctggacccccaaccacaaaccgtggctgggtgctctctgagcataaatcactgttaacttcaataagttttcaacattttaaaggtgactcccatagtttttaaacaggagaaggaaaagactgaggacccccgggatcacagcacttcccacgcacaaaccacacacggggtctggactctgccctgaggacgcttccattgtccccgcagtcggggcagacgcaagaacgcgcgcggctcttcccagggtgggctccgggcgggaagcgggagaacggaacgggatgcccgcccagggtcccggctgctggcccacctcgcatcctgtgcccggaggtgatcgacggccgagctgtgcctgccggggactccagtccgcagactccggagctgacagctgggaggccccagtcccgtcactgccggttccggccggtttcaaccagccctgcccccacctcgggatgcgcggcctggcacactcaccatttttcggcttccgggatgtcgtggagtcttagctctggatctcacagcatctgcaagtcagagggcaacagaggctgcgacagtcaccgggaactactagagcagaggatactaagcaatgaagatggaccctgagctctggctggagcgagacaaaggccccgccagctccaggacaccgccccctctaccttggctgcgcacctgattggacagttcccactctagcgcccatgattggatacagttccatgccccgccccctcaggtcatgagtgacaggaggcgtgatctgagaatgtgttgaataaggcaagagttacaggtttttcctgaacccttttctggcgcgcttccttcctgaattggaaactggcccttcctggggaacatttgcatttaactttgtatataaagttatctttatttgtgaatagtatacatatgttattcacaaatggaaacaatataatgacaattattttaaaatctcagatttcatcattttcctagcctccagtcttttgagcaggcagcctaagatgtcgcaagggaggcaattctctaagaaataaactgtgaagcacatatgaattttacattttctagtagccacattttaaaaaagaaaccaggcgtggtagcctgtgcctgtagttctagcaactagggaggctgaggcgggagcatcacttgaggccaggagttttaagaccagcccgggcaacatagcgatgatcccatctctacaaaaaataattaaaaatttagccaagtctggtggtgcacgcctgcagtcctagctactcagaaggctgaggcgggaggatcacttgaccctgggagaccaagactgcagtgagccacgatcacaccattgcactacagccggggtgacagagtgaaaccaagtttaaaaaaaaaaagatctctgaagaaggcattttctctttctgcaatttagccaagcagctgagtatgtcttgaagtcatcttctaatttttaacagggcaaggatgttttctaaaaccccagtctccagagttgccatggggcaaatcccggcagcatacatgaaaatcactcacagctaatgcattcttcatcagatccagtgcttcttacccctggcaaataaaaatcacctgcggggttgggagcggtggttcacgcctataatctcagcattttgggaggccgagacgggcgtatcacctgaggtcaggagttcgagaccagcctggccaacatggtgaaacccccatctctactaaaaatacaaaaattagccgggcatggtggcacacgcctgtaatcccagctactcgggaggctgaggcaggagaatggcttgaacgtgggaggcggaggttgcagtgagtcgagatcgcgccattgcagagtgagacttcgtggggagggtggtggtggcggcggggggtgtggagaatgactggaggggcggggcaggatgtaaacttaaaatccctgaagcccaagttgcaacagaccaattaaattagaatccttggagttggatctgggcaacaatatggtttaaagctctcagggtgattacagtgtgtagccaagtacccaaactactgcttttcaccaacagctttttcttttttttttttgagatagagttttgctctttttgcccatcctggagttcaatggtgcggtctcggctcactgcaacctccgcctcccgggttcaagcgattctcctgcctcagcctcccaagtaggtgggattacaggcgcttgccaccacgcccgctaactttttgtatttttagtacagacagggtttcaccatgttggccaggatggtcacgatctctcgacctcgtgatccacccgcctcggcctcccaaagtgctggaattacaggtgtgacctaccgcacctggccttcatcaacagttttgatgaattagttataaatggtttttcaaatgcatgtaaaaacgtttgctgctgagttgtgaccttacaatcttaactcatttcccacttactatactttgcagaaccaacctctgctactcgctttgttcctgattgaacctggttccatgtgtgctcagtgtatactatgcacagggcactgtgctgtgtgccctggtcccggtgagcatcattctcaggggagaaccttgctgaaaacaaaatcacatcccaaaaagttaaaatcatgctactggccgggcgcggtggctcacgcctgtaatcgcagcactttgggaggccgaggcgggtggagcacgaggtcagacgttcgagaccagcctggctaacgtggtgaaaccccgtctctactaaatatgcaaaaaatgcaaaaaattagccgggcgggggggcgggcgcctgtaatccgaactacttgggaggctgaggcaggagaatccttgaaacctgggaggcagaggttgcagtgagccgagattgcaccactgcagtccagccccggcgacagtgcaagactccgtctcaaaaaaacaaaacaaaacaaaaacaaaaaaccatgctacttaccgaattgaggtgaaaattaaaagacctagggggtcacccaaaggttagaacatgaatcaataacttggaatattaatatacatctgatggtgccctgagcacacatgtccattttattttattttatcttaccttattttatttttattttttgagacagagtcttgctctgttgccaaggctggagtacagtgccgcggatctcggctcactgcaacctctgcctcccaggttcgagcgattctcctgcctcagtctccccagcagctgggattacaggcatgcaccaccacgcccagctaattttttgtatttttagtagagacgaggtttcactacgttgggcagacctcgggtgatccgcccgcctcggcctcccaaagtgctgggattgcaggcgtgagccactgcaccccgccacgtgtctgcctttaaaagaaaacaaaataaagcattactattattctcaaatattaatttataactattatgcaaacatgtaatatttaaattttgattgatgtatagcatgcatacataaatatatgcgcaaaacatttatggaaaacttgatgaattattacagaccaaactcgtgtaaccaagaaatagaatcagacttgctcatgcccgacagtcactttctccttctcttcacaaaagtaagagcttaagagctaagtgtagatcaactttgtcattttgtacaagtgttttattacagagcattaaaaacatatccaaaatacaaagaaggtgtataatagacctgtcacccagctttaacagcaacttgacatgtgccatttttgtttcattgatatttcaacccatttcccatccctttattaattttttagtttttttttagataaaatgtatatacattgaaaggtacgatcttaactgtaccttttggacaaatcaactcactcatataaacatctcctcttttaagaacagaattactccacttaatcattaatgtacccataagttacctcaaagtattatttaaaatctagatttttataaaataggtctgagtttggactgagaattcatatttctaacaaagtacggatccatagagcacatggtaactacagagtctcttttatctaaagtaaatacaattggatgaataaaattaagaaaaattgacctaaggtgaaaggacaaatcaaaacatctgtgcaatatgctatctgtaggagcatttggttaagaaaaatataaactcaccaaaaagttttattattttaataatgcaaattggcaaaattcctactattgttttcatagaaatgctccctcacaataaaacattttcatataggaacggttacagtggctcacgcatgtaatcccagcaatttgggaggctgaggcgggtggatcacgaagtcaggagttcaagaccagcctggccaagatggttaaaccccgtctctactaaaaatacaaaaattagccaggcacagtggcaggtgcctgtaatcccagctactcaggaggctgaagcaggagaatctcttgaatctgggaggtggagtttgcagtgagctgagatcataccactgcactccagcctgggtgacagagtgagactccatcgcaggaaaaaaaaaaaagaaagaaaaaaagaagaaaattcatatcataggaaggcactggttaaaaatagcaaatatttgaaagtaaatgtcttataacattaagtagcagataccttttgaagcccatagatggcctttacatagttacccaaaattcagttgtttacacagcaagtgcagataatttttatagcttcctattaaattgttattaaaattaaatttattaattttaattaaattaaaattatatattaaaattatatgttaatgcccttacaaagttttcttctaaaattcactaacttaaattttgtatatgacatataagttccctttacattcaacttaaatttccttaattttattaggcagtgcctgtgtgtttaccacccagtattatttggggttcctccaacagacatcacggttggggaaacaggctgttcctgcttctttttcctcttcagggcatcagttcatcagtcaaccaagtcgtgtgggagtggaggtcatatattccctagcatagagggtgtcatttctgagcactctgctcagagtagaaaaagaccagaaggtccttttagggaacacttacttggggagggctaagccccttaaggtgtgagagctctaatcagcaggtatagacttttcaggagggagggatgaggcagccattctgaacctggagctccatcacctcttgtcccatctccagacaattctagagggctgttcaggaacatgtctgaaaggtgcacatggaggaacagtgtgggctttgatctggcttagatgacgtctgtcctggggaggcaggaggtccatgctcagtatctgggctggtatctttgaggtcagtaggttgcctttttgtatccaagtccattttcactagggaagaggccagacagtctaaatggcttccagagcccctctctgattctctttgggagatagggtctgaaagaggctaagtcagtattttggggaaattctacaaagtctggttggaaactgggaagacctcttgcctggtgcttaaatgctccatttgcagtcctagccatataggtgtttggtagacatagagctgggtttgcatttatatcagcacaaccttatgtcagagctgaagaagtggccaggataagtgtcttggttgcaggctggagaacatcataaaagcaaactgctagtttgctgattttcatcttggcaatgagcattgagtcctggccaaactgcttgagtgcagcatgaggccaattcataaatccacctccacgcatcagctgtccataagataagaggaagctcagttcatgttttgacgagaggctctgccatgtgaaagaatcacatctcaggtgtcttgacagctggctgacttgtgagaaaagatccaggacagatctatttttggatgcatcgacaggcttcagccttccagaataatgtgggagaaatggcttgcaaataaaatatggtaggaactcctgataatgaagagtaaaaacatgaacttaataaaaataagacagaacctataaaaacatgccatagtaaaagaaatacaaatggacttttctagcataaagaggcattcaaccataacggtgatcaggagaaaataaattacaaaataaatgtgttttgttggtgtgtgatcagggatactaatctgcgtctttgtttgggtttcattttgagattgaggatgggaaatggcttgtagccctcagggggctttgagaaatgtggcaatcatccccaagagctatgttcttcatgttcattcttgacactggctgaagagcctcagctgagagaatgacccacaaatacaggttagggatagactatggggctctgtgcttagagagaggagagtcacctaaactcctctttaccacagcccaatccaaatgagggtaattccaaagaaactaaactcaaagccagaaacagcactgctaggttaggcaagaatttgactcttccaaggtgaggagaaacagaggatggattaacacagtcttccctgggaaggaaactgggagttattttagcaactagggccttatagatcctggactctgtgtaaaaagtaaagtagaggttcctcttcaaagactttcctccccatctaattatgaataaatagtaacttctcttagaagcaaaatttattcaaagacctgtgctcctaaatatttgccctggcatgcttatactggtccaagcaagcattaggtcatagcctgttcctcttccttatttaaaagtgtttttacctttctcagcattccacaagttacttcctacttcctttgttctcctctacctttgtctcttttaaaaagttctaagttgctagccaatcgggacaaatgcagaatgtgaggtcccattccagcagtagggtggatacgtcaggttataaataaccctgtctcttttgttcgatgtactcttgtggcaaaactgctggcgagtataccctttctgcaggaagtaaaaatgcccttactaaataaattaaatttatgttcaagggctatttctttacggcactgaaaaacaaacatttcaaatactctggaaacagaaaatgtagctcctgcagaaaaaataaagatctgctacttctcagacacttttacactcattgtagtagtaaatgacagaacctgtggtggtcctaggaaaaaaacttgaacaatgtactcagaatggcgaactctgggttttcttgagggccaagactactgacatttcatgtgttatatttcatgtaagacatttgatgtcttttggataccttatgacagttatgcatttctttataatcagaaaaaaaattagcatgtaatcatgcatatatgtttgtatattgtacaatgtatcaaaatgaatatgtatatttatattctcccccttaaattcagaaaaagctgaagctctttactctctcagcctgagtccagggaggacggatatccacaaattagtggatacaaactaattagcattctctaatagagaagcgtttctattttttgcagtttgataaactcatggtgaaattaccatgctactttttttactttttattatttaatataaaatctaagacaagatacattaagtacttagtgacacacgtatttattcctcacctgattcataatatctgcctaattttaaactttcttccattttataggttcaattgatcttattttattgtaggatattaaatctaataccagcattgttattttatatattatgttctttaattttgtatattttctattggcattttacactgaaataatgcagtgtttcatcatataaatgactttatctgtatttaaaaaataaaagtctggggccgggcgcggtggctcacgcctgtaatcccagcactttgggaggccgaggcgggcggatcacaaggtcaggagatcaagaccaacctggctaacacggtgaaaccccatctctactaaaaatacaaaaaaattagcggggcttggtgtccggcgcctgtattcccagctactggggaggctgaggcaggagaatggcgtgaacccgggaggcggagcttgcagtgggccgagatcgcgccactgcactccagcctgagcaacagagcgagactccgtctcaaaaaaataaaataaaataaaacaaataataaaataaaataaaaagtatttgggtattttttttttggtcttataatttccatattacatagtgatgagataaacattaatgttttgagagtattttaaacttttgataatgactcatttgatccacatggaattttttactgcatgtgtgggttgaaaatctggttttgttttttgtttccttctttgttcatttgttgagacagagtctcattctgtcgcccatgttggagtgcagtggtgcgatctcagctcactacaacctccccatcctgggctcaagtgattctcctgcctcagcctcccaagtagctggattagaggcacgcaccaccacgcctggctaatttttgtatttttactagagatggggtttcaccatgttggcaaggctggtcttgaactcctgatctcaagtgatccacctgcctcagcctcccaaagtactgggattaaaggcatgagccatggcacctggcctgaagagctgatttcgcttctgcttcatcttcaacctgatctccccagaactgatagctcttgctgtaactgggggatagcagtttattattccaataaatgtggcaaattcaataacatactacaaatcagttggaaagcaggacatgccttcaagacatacacaacatgcaccaacctatgtacaacaataataatttgtaaatttcagttggaatggaaaataaaatgacaaaaagattgttaaggtaaattaaaatggaggtcaggcctgaagaattcctgagcagaccaaatcagttaggcctcataagtaacctcaaccttgcttgatttccaaacataagcaaaacttaacttgaattctttcttgtagctgcctattttaaagaaaaacagaaatgaatctcaaccaatcagaagtagccaacaaccttatatagctaggaacttttcaacaaggcaaagaaaccaaaaaccgagaagaaacaagtttctaactaccactaattgagtaatttattttgtttctacattttcccaataaatagttgcctcttacactgtcaatgaaacactaaacctcttttagactggtgtcctataattaatcaattgctcctactcaaactctttacaattttattgcgtctcagattactttttagcagaataaaataaactatctaggaatccatattacaaaaacgtttacagaatatcagaaaagacagaatgttcatacaatatatgaatgtagacataagcaaatagaaaacttacatgttcttaggcagaaaaactcaatatactatcaatatcaattgtctttaaggtaatttagaaatttaattttgttctaatatagatatcattagatattgaggtaggcattttactataaaatagcatataggctgggtgcagtggctcacacctgtaatccagcactttggaaggctgaggcgggtggatcacctgaggtcaggagctcaaaatcagcctggccaaaatagtgaaaccccatctctacaaaaatacataaattagccaggcatgatggtggatacctgtaatcccagccacttgggaggctgaggcgggaaaattgcttgaacctctgaggcagaggttgcactgagccgagattgcaccactgcactccagcctgggcaacaaagcaagactctgtctcaaaaataaataaataaataaataaataaataaaacagcatacagatgaaaagccaagaaaagccaagaaaactgtggaaaaaaaaacacacacaacaaaacacagataatattggccagccgtgggaaaaatcttgattgattaaaaaagctaataatagatcattggaactaaaaattcagaaatagactaaagtgcctaagaaactgtcttagtccatccaggctgctgtaacaaaataacttaggctgggtaatgtaaaaacaacagaaatttatggctcacagttctggaggctggaaagtgctagatcaaggcaccaagaaatttggtgtttggtgacggcccagttcctcacagatgataccttcttggtgtgtcctcacatggcaaaagagacaaggacactcccttcaacctcacttattccattcaggaagatgaagctctcttggtttagtcacttcccgaaaggtcgcatgcctaatactatccacatatgaatttggagggggacacaaatacttaaaccacagcaaaaatttaataagcaggaaaaactagtggaggatggcatcactaatacttgacgtgtgaaaaaccgatgttcctatcacaaaggaaagaaatgactcattcttcatgacatagaacaaaataaaggtccaatgaaagataaatctatacagaaaaataaattggtgttgataaggtgaattctacaggttgtatcaggattttggaggtttctggggatgggcagggccccagagtttcctcctgtgacattttccctgaagttgctcacgctcttactcaatttgaaagtggataaaaatgttttttcctgttctaatatttaagaaattcaaaacaaaaaggcctatgtatgcacgattatcaaacaatccgtcagtggtgctctgctaaggaagggcaaagaatcccacatccacaaaagtacgatgttctgtcagataaagatgtctccctgtgccagagccacatattttacacatgatcagaggctttcccagggaagcattgctctgcagcccttccacagacttaaccctgagaatttgacttagaagatcactgatgaacacacgcccaagcgttctgatctacatgaatcctctcttaatggttccttccagggatctgggatctttcccaaagtcatctgtcacacacagattgactcaaaaatgtggacaaaagctttgatcctcactggcacacctgctctgtcttatcagcttctctagaagtatgctgctctaattgctcctgagagaccccatcttaaggtatctctctgtgccaacataattgatttcataaagtgggaagagaataggcaagagtcaagctatgctgggggctgtctaagattcccttacctatgtctctaatttacgcacatattgactaatacagattcatctctaagtggtaggaaatgggaaggaggagccccagttctcagaaagagaagccccagttcacagaaggagaaaatgtaatcaatgctgcctagcttccagcttcagcttacctatgggggactgagtctcttctgaaaaaagcagctgttctccatagtattagcctgttctcatgctactaataaaaagacatacccaagactgggtaatttataaaggaaggaagtttaattgactcacagttctacatggctggaggtgggcggtcggttcaaaatcatggaggaaggcaaggagaggcaaagtcacatcttacactgtggcaggcaagagagcatgtgcaggccaactgccctctataaaaccatcagatctcgtgacatatattcactaccacaagaacagcttgggaaagacacacacccgtgattcgattacctccctccaggtccctctcatatcacacgggaattatgggagctagaattcaagatgagatttgggtggggacacagccaaaccatatcatccatcatttgaaggaactgtggtctcaggaagctaggcattgagtgtgcacgctgccccctagaattccacacctacatcacagagacagaatagtctcaaaggattcttaagggtaatatgggcagccaaaaggaggagatgaattcacagcctctgccttaccttctggtctaacaaatactactcctatcctggcccaaaaggattcccatactcttttctgggttgcacaaggagtaattcagaaagacaaaaacttattaatgccccttcattctccataacttctgaggtaagttgttcattccctgggttttaggttgttgttctctctctacctccacagaaccagtgtgtcccattccattacctataatttcacccatattcttcttacctcctactttctcctagacattttatccagtagagccaggtgaaatacagacaagtatatttacacaaaacttaaccagaactaagttggagtcccataagccctattgggctgcgatggcactcaggctggcctaaggttgtggttatggaaaagaatgccacattttgcccaggaatgatcaatgtggaatctcaaatttgggaaatagatccttagagcccccaaccgtttcatccttctcttggaggcaatcaggaagagataatccccttttggaggaaaccatgtctaatcaacaaattacctaaccaacatgtgtggaaaaggaggtaaaatcagacagttgacccattttagtagatttggtaataaatgccacaaagtcagagttcaagtggtctcaaaagcctaaaaggcgacacagattagtttcaaggaacacatggtgtcactgagtgttccaacttcccagagggtgagtaccatggcaactttgagcaggctgggaaacgatcccagacccttgagggtctgtgagaaatcaaactttcggcactttggaagtcaggaaaccagcacgttgggggaggcgggatcacagttacttgctgagacaagctgccctggctacgttcactcccgtcaggtaggagaggttaaagaacaggaaggctccccctccgcagggcggaactgctctgaaggcatggaggagcgacgctgaaggtggaggcttcgcccaccatgccgggagctaaaatttcttaaccaatgccggccagcgatggcagggctgcgggactacaatcccagcgcgcacagggatcagggactgtgcgcatcactggaagaagcggcagaacggcgcgcgcctcgctgagctttctgggagatgtagtctcatggcaactcccagccttttggccacaaggctacgggacctacaatcccagcctgtaccaggatcgggagcagttcgcagcactagaggaaggggcagggcggtgcgcgccgcgcctgatatgctgggagctgtagtctcttcacggtttttagccaatgagtaggtagcttcagaactacaatcccagtatgcatgggggcggtgcgtagtcctggaggtaggggctgagaggtgtggacttaccggtgtccaaagcattgctagcagccaattccatgccgccccgttgccagggagagtgaatacagctagggacgtgaagggtaggtctgggctgggcattgaggagggtattaggctaggaagtatacctcacctttgtccaaatcgggtggttcggcctcctctcattggccctatgcagctgggttgcctctctcacccgcacccaagggtctttccagagtgttgcgtcatttccagcccagggagctgccttctttcctaaactgcaatggaaactgtcctgatgtctgagacaatgtccgttgtgccgcagccctctgccttctctagccagagcgcgagctcagctgcttttgagagaaatcagccacctggcccacctgtgcacaacttcagagctttgtagggggtgacaaggactgtgtcttcagggaaatgtcacgggcattagcgcctttttcgcaaatgtgaaagttgagaaatcaagaaggttaattattgggttgcccaagatctgctaagagcaaaggagaaaactccgtttcccaggcatgtgtcttgtgagccatttttaaatcaaccctcttaagtggacaagctccagaacacaacatgaagctgatgatgacttaggcaatttatgcttgaactcattggcctcatctcaagtcagtgtctcagagacacaggtgggacctgatccccaaggaacagatagcattccagattcatgggagcaacttttgagatgtggagcacccggggggtcatttgaaacccatcaggttgccgggcgcggtggctcacgcctgtaatcccagcactttgggaggccgaggtgggtggatcacctgaggtagggagttcgagaccaaactgaccaacatggagaaaccccatctctattaaaaatacaaaattagtcgggcatggtggcgcatgcctgtaatcatagctactcggaaggctgaggtaggagaatcacttgaatctgggaggcagaggttgcggtgagtcgagatagcgccactgcactccagcatgggcaacaagaggaaaactccacctcaaaaaaaaaaaaaaaaaaaaaaaaaggtgtgtgtaatcttcagttttcaagatgattacaaagataatatttatagaaagtatgcaaaataaaatacaatcaaagcatgccaatagaaagttaaataaaaattaagaaagtaaaacaggctgggtgtggtggctcacacctgtaatcccagcactttgggaggctgaggcgggtggatcacaaggtcaagagatggagaccatcctggctaacatggtgaaaccctgtctctactaaaaatacaaaaattagctgggcttagtggcacgtgcctgtagtcctagctactcgggaggctgaggcaggagaatcacttgaacccgggaggcagagattgcagtgagccgagatcacgccactgcactccagcctggtgacagagcaagactccgtctcaaaaaaaaaaaaaaagaaaccaagtaaaacagaaaatgagaaaaatataactactagaaacacataaaacaataacaatataactagtaataacttcatttccttaataaattattttaaatataaattaagtaaactacttaataaaatgaaatgtagtcttaggactttggaaggccaagatgggctgatcacttgacctgaggagttcaccaccagcttgggcaacatgggaaaactctgtctctacaaaaaaatacaaaaaagctagctgggtgcgatggcaaatacttgtaaatcagctacttgagaggctgaaatgagaggatcatctgagtttgggaggttctggcagcagtgagccctgcaaatcagcctggttgaccgaatgagaccctattgaaatacaaatgaggcctggcgcgttggctcatgcctgtaatcccagcactttgagaggctgaggcaggcagatcacgaggtcaggagttcgagaccagcctggccaatatggtgaaacccccatctcgactaaaaacacaaaaatcagccaggcattgtggcacgtgcctatagtcccagggacttgggaggatgtggcagaagaatcgcttgaacccgggaggcagaggttgcagtgagctgagattgtaccactgcactccagcttgggtgacagagtgagattccatctccaaaaaaaaaaaaaaaacctacactgaaaaaacacactaatatgaaacttcaaaacaataataagagaaatgtttactctcataaaacctggtatgcaacattgatgtatcattaaaaaaaacttgtcaggctgggtgcagtggctcacacctgtaatctcagcactatgggaggccgaggcgggtggatcacctatggtcaggagtttcagaacagcctggccaatgtggtgaaaccctatctcatataaaaatataaaaactagctgggcgtgatgacgtatgcctgtaattccagctgcttgggaggctgagacataagaactgcttgaatccaggaggtggaggttgcggtgagccaagattgcactactgcactccagcctgggtgacagggtgtcactccatctcaaaaaaataattaaaaaatatttgtctcagtaactgcagtatttagctgttactgtgtacttattaaatgcaggtattttgaatcattggcatgcactgtgtggcaatagaatttgagagaatatgcagtatagttataaatagattctaatgagaaacttttaataaaaaagcatttaaaaaactagagttactttttatgttttaaatatacattattcttacacaagatgaaactgctgaaatctaactttagaagcaaagaatagccttacttttttttttttttttttttttttttttttgagacagtgtcttgctctgttgcccaggctggagtgcagtggtgcgatctcggctcactgcaacctccgcctcccgggttcaaacgattcttgtgcctcacccttttgagtagctgggattacaggcgcctgccaccatgcccagctaatttttttgtatttttagtagagacagggtttcaccatgttggtcaggctggtctcgaacccctgaccttgtgatccacccgcctcggcctcccaaagtgctgggattataggcatgagccaccgcgcccgacctacattgttaaacatagaaaaaaaaaaatatatatatagatatatattttgcagaatagggttagaccctctgatgtgtaaaacatatattaggaaataaactatgttattatttagttataggctgaagaaagtagataaaaatcttataattccttattgcctgcagcaaacttaaatttataagtaactattttagtaaatatggagtgcctactaattatctcatttacttctggcataccatgcaaatcatctcacatctcacatctcttcatagtcaaaggtttttttttccttgctccagacaggtgatcaggtcttgcttagagacaacaatacctgttttattaaaaataagaaacataaatcttgctcgcattctctaattacaagctagtaatgtgctcggcagagaggatgtgataaaatagtctagtaaattaatacaaaaatactaagttataaaagaaatttctaaatatttagaaaatactttcaatttgtaggtttcttaattttactatctggtactattgaatcaaaaattggtggtggcaattagattttcaggtgcggcaacaatcaatattttatgccactaaatttctggaattgccactaatttacagtgaagaatacagctcaactcaggaatgtggaaagttaggattacgatgaaacatcttgaaattcttatctaaatgaacaaattttgaagattttctgggaaaaggggatctgaaactcttttatgcaaagaataaatgactaaaacacattctacaaaaatgagaaataaaacctttagggtatattatgaattatgtactcaagttatcctcaccaaggaagatcaggtttctgtagttctctaacatcacatccctatataaattccactgtgcagtgtccaggcaatgccactcctccagagagaattctatggccacgtctctaaattgcaatggtccctgaaacacacccacacacccacacacccacacacacatacatttttaccatgtggccatggacagaacttttaatttgacttaaggtgtaatgacaaagtaaagagaactggctctgacttatgggactgactaaaattatccaataaaataattttcaacacagaaatattctctaatgtattctctaactgagaaaaaagagcagcataagatccacaacatcagttcttataatgatatttttctagataataagtataaaattaagggcgtgaacagaacatgtgtatatatatattttttttttggagggggatggggtctcactctgttgctcaggctggagtgcactggctcaatctcgactcactgcaacctctacctcccccaggtgcaagagattcttctgcctcagcctccctagtagctaggattacaggcatctgccaccacgactggctaatttttgtatttatagtagagacggggtttcactatgttagccaggctggtcttgaactcctgacatcatgatctgttgggaacaggatccccaaaatctggccataaactggccataaacaaaatctctgcagcactgtgacatgtttgtgattgccatgatgcccacgctggaaggttgtgggtttaccggaatgagggcaaggaacacctggtccacccagggcagaaaaccatgtaaaggcattcttaaaccacaaacaataacatgagtgatctctgccttaaggacatgctcctgctgcagataactagccagactcattcctttacttcagcccatccctttatttcccataaggaatacttttagttaatctataatctatagaaacaatgcttatcactggcttgctgttaataaatatgtgggtaaacctctgctccaggctctcagctctgaaggctgttagaaccctgatttcccactctacacctctatatttctgtgtgtgtgtctttaattcctctagcaccgctgggttagggtctccctgaccgagctggtctcgggaatgatccacctgcctcagcctcccaaagtgctgggattacaggcatgagccaccgcacccagcctcacgaacgtgtatatttttcagtgctatattttcttcatatggaatgagttgtgaatatttttcagatggaaaagacatgttgtgttagaaggcacctctcaaattttaatatgtacagtaagttgaagaccttgttttgcaggtttcttttttccagaagatctttaataaagtctgatttttaaattaattaattaattgattgattttgagatggtgttttgctcttgttgcccagcctggtgtgccaccacacctggctaatttttgtattattagtagagatggtatttcaccatattggctagtctggtctcaagctcctgacctcatgatccacctgtccaggccccccaccaaactgttgggattccaggcatgagccaccatacctggcatttttagggaaattttattagaaaataaatatgtacacttagcaaggtaaaggaaatacaaattttacagccgggtatggtggcttacacatgtattcccagcactttgggaggccgaggccagcagatcacaagttcagtagtttgagacaagcctgaccaacctggtgaaacaccatctctactaaaaatacaaaaattagctgggcacagtggcaggcacctcacctgtaatcccagctactcaggaagctgaagcaggagaatcacttgaaccagggcagcagaggtttcagtgagccgagatcacaccactacactccagcctgggtgacagagactccatttaaaaaaaaaaaaagaaattataataacaattcttctgttcctaaatgtgccttcagatgtagaatcagaagtcacaacaatataaagaaagtggcctaaataaagcccaaggtgttggacacatctttttattgtaccaaccatatgatgcacaattcaattatttatccagtcgctagtgtagactaaaagtttctggattgtagaaactatgactgcttcatgtattttttttaatggccatgtgaaattgaagcaactagtttatctatttcggtcttcagatctcctccttctttattatccaagtaccaggaaactggagaaactctcatctgggtaccaaccaaagacacctcttgtatgaggggatgaacaaacacagatgactcatttctcatacactgagacagaagcagaattaaccactcttgtcagcctgacacaattctgcattgtacatcctcaaatgcctcaaagacacctaggtgattttgagggaattcccagtgaccctgggctgatagtccagtgataagccactctggagagactcaggctgattctaaatagaaaatggaactgccttggtggaactccagaacctggatcatttgtccttatttgctagctcttggataaaagaaagaacaaaaatactaatttttcaggtaaaatacaaaaatcacattttaaaggcaaatatagttgtggtcatggctctggatgttttgcggccttgatctctcactcctaagatgcttatttatagttacagattctgccatcagattctatttcctcctgggtcctctcacataactgtagcaggtgaacaagatatgaaaaatctcaaagaaccacactcccgaatgggggctgtaagatgtgtatgttgatatctcacaatgcagaaaatgccttttgttagttttctgtacattctttatccaaactccggcccttatttgtaaatccgaagcagagcccagaccttatctgcagattctaggtaggatccacctggctctgcatcctttggtgttacagcaagtggagtacaatcaaagaagagatcccctcatagaggctgctctagcacattctaaatgataagtctacatgaaaaaaaaaaagctgacacaagatgaatgtaagtactgtcaggcctctgagcccaagcctagccatcgcatcccctgtgacttgcatgtatacgcccagatggcctgaagtaactgaagaataacaaaagaagtgaaaatgccctgccccaccttaactgatgacattccaccacaaaagaagtgaaaatggccggtccttgccttaagtgatgacattaccttgtgaaagtccttttcctggctcatcctggctcaaaaagctccgccactgagtaccttgtgacctccactcctgcccgccagagaaaaaaaccccctttgactgtaattttcctccacctaccgaaatcttataaaacagccccacccctatctcccttcgctgactctcttttcggactcagcccgcctgcacccaggtgattaaaagctgttattgctcacacaaaacctgtttggtggtctcttcacatggacgtgcatgaaaagtacacagtttatttgggtcaagtttatggattacaacctgagagcaaagattcaagttgtctgaaacctctactgtgatcagcagcagttacaggaagatttgtaaagacaacaagagaggaacagagagtgggctgatacaaagttgattgtcagaaattgttatttatttacagaaataacattgattattaattagatatatatcattatggtttagggtatgggatatagtgtccaatgtggcattattagtttaatttttacctacctgtgccaatagtgaacagtttcaagagatgaatatatagttcaaaggggggagaaatacataactacactttcttttaactctctctgagtttgaagttcgtagaaatgtgatttagcctctctagaagtgactgtagaggactgtaagtaccaactaggcagatacacaattctgtctgcatatttagggaacagcatgcactgtgctacacaactgtcagttgactagaatcctcagagagaaagtcccttttagagtacattctggttggcaccttctgtgtgtacatcatgtctggtaattctagacagtgtttggaaacattaattaaaagaaaaatattctccatccccagagaaactccacaataatagaacagaaagaaaatggttttattacacaattaaacttgaatgtgacatgcatcatcatcagtctgcttaacagatcgcaaaaacataaagatggtcaccataattagtccacaagtagaagaatttacagcaccatgtcatacatagttcatgctaaattcacctggagaatgatgaggccatttgtgtatgctaattgcttatattcaatgacaaataaacttttcccatcttcattgatgcaataacatcgataaagctggagatcattattcttagaaaactaatgcagagcctgggcacggtggtttatgcgtgtaattccggcactttgggaggccgaggtgggtggatcacctgaggtcaggggtttgagacaagcctggccaatatggtgaaaccccgtctctactaaaaatagaaaaattagccaggcatggtggtgcgtgcctgtagtgtcaactacttgggaggctgaggcaggagagtcgcttgaacccgggaggcagaggttgtagtgagccgagattgcaccactgcactccagcctgagtgacagagtgagattccatctcaaaaaaaaaaagaaaatttttttatttatttacagaaataacattgattattgattagatatatatcatatatcatatatatatcatatatcatatatatatccttatggtttacagtatgggatatagtgtccaatgtggcattattagtttaatttatactactcgtgccaatagtgaacagtttcaagagatgaatacatagttcaaaaggggagaaagacataactgtacttctattttaatgtctgtctgagcttgataacaaaaagacttccatttttcagacaaaagttttttatttcccaaatctcaagacctcaattcaaaatttggagctacagatttagagcctgaattgctggagttgcagcaggtgttacctgcacgtttgttgggattttagcatgaggaggaaggggaaagtggagattctcatgtctacatgtctactcaatgcacacatgttattctgattaagtttctgggctttatagtatctgaatcagtttcaggtctaaagacacaagagtcagtgaaagaggtaaaataattgattgctactctctgaaacttggagaaatgtggtctagcctctctagaagtgactgtagaggactatagataccaaatcagcagagacacaattctgcctgcatatttaggggatggcatgcactgtgctacacaactatgagatgactggaagcctgagagggaaactctcctctagagtaaattctggttgacaccttatgtgtttatatcatgtctggtaattctagacaatgtttgcaaacaatccttaaaagaaaaattgggctgggcatggtggctcactcctgtaccactgcactctagcctgggtgacagagtgagaccttctcaagaaaaaaaagaaaacagcaaaaaagaaaaattttatccagccccagagaaactccacaataatagaagagaaagaaaatggttttattacacaattaaacttgaatgtgacatgcatcatagtcaatctgcttaacagttcacaaagacagaaggatggtcaccataattggtccacaagtagaagaatttccagcaccatgtcatacagggttcatcctaaattcacctggagaatgaaaaggccacctgtgtatgctaattacttacattcaatgacaaataaatttttcacatcttcataacaggaggtagttttgcagcttgaagccaagtgcctgctgaaggtaggctttcactctgctacaaaaaagtttcagtaggattctatatttttggctatttacattttagagcagtggctctgtactcactggcacttggctacagcactcctgcttgctttctcctggttgctagtgtcctctattcacctctaccatctgccactgaggcacagccaacagcacagctcacattttatgtgaaccccatttgccacagcagcactctagtgtcacatgagcgagtgaggcctgagctgcaggaggagagcctgcaggcctcatgggtagaattacaccttcacaataatggaaatgggagtagtgtttcagcctcagtttccacttataatggtgacaaggaaaaaatactgctgaatttccagcctgagtccagatagagatagctccaaaagttctcactgtgacagcccaccccattcagacaccatgggatactaatactaacagggcttctgaaacagacaaagcattggagagaaaaacagatctccatctgagcgagattattttgagagaagaaagttaaaaagattttaagaaaaagctcagattagatatgagattgatcaagtcagtcagaaaatattcccttaaaagaaatttctgtctaaacacccaaaccgcacagctactctcagcatgagaaacatgagcaatatgaagaaaggtggcagaatttcagaagaattttataaagtttcttttcgatctctgctgctttctcatctcctagccattgaataggggttctatctcttttttaccctctctctttttgaatgtattcaacaacgtttactttggtaatagtgcattatcaatactaaagctaattttaataacactttataaataaataaaatttgtcaattttgaccactccagatttacatatatattttgtaatctcttgtaattttttgtctgtatttcatttttatccatattcttttttttaaactatatttgtaatgctttatttcttttttttttttttttaattgatcattcttgggtgtttctcgcagagggagatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaaccagcatgttgccttcaagcatctgtttaacaaagcacatcttgcaccgcccttaatccatttaaccctgagtggacacagcacatgtttcagagagcacagggttgagggtaaggtcatagatcaacaggatcccaaggcagaagaatttttttttttttttttttttttttttttttgagacagcgtctggctctgtcgcccaggctggagtgcagtggcgcaatctcggctcactgcaagctccgcctcctgggttcacgccattctcctgcctcagcctctcaagtagctgggactacaggagcccgccaccgctcccggctaattttttgtatttttagtagagacggggtttcactgtgttacccaggatggtctcgatctcctgacctcatgatccacccgcctcggcctcccaaagtgctgggattacaggcgtgagccaccacgcccggccgaagaatttttcttagtacagaacaagatgaaaagtctcccatgtctacttctttctacacagacacagccaccatccgatttctcaatcttttccccacctttcccccttttctattccacaaaaccaaccttgtgatcatggcctgttctcaatgagctgttgggtacacctcccagacggggtggtggccgggcagaggggctcctcacttcccagtaggggcggccgggcagaggcgcccctcacctcccggacagggcggctggcctggtgggggctgacccccacctccctcccggatggggtggctgccgggcagagacgctcctcacttcccagacggggtggctgccgggcggaggggctcctcacttctcagacggggcggctgccaggcggagggtctcctcacttctcagacggggcggccgagcagaggcgctcctcgcatcccagatggggtggcggggcagaggcgctccccacatctcagatgatgggcggccgggcagagacgctcctcacttcctagatgggatgacggccgggcagagatgctcctcactttccagactgggcagccaggcagaggggctcctcacatgccagacgatgggcggccaggcagagacgctcctcacttcccagacggagtggcggccgggcagaggctgcaatctcggcactttgggaggccaaggcaggcggctgggaggtggaggttgtagccagccgagatcacgccactgcactccagcctgggcaccattgagcactgagtgaacgagactccgtctgcaatccagacacctcgggaggccgaggctggcggatcactcgcggtgaggagctggagaccagcccggccaacacagcgaaaccccgtctccaaaaaaaaaatacgaaaaccagtcaggcgtggtggcgagcgcctgcaatcgcaggcacttggcaggctgaggcaggagaatcaggcagggaggtgcagtgagccgagatggcagcagtacagtccagcttctgctcggcatcagagggagaccatggaaagagagggagagggagaccgtggggagagggaaagggagagggagagggagagccattctttttattttttcaatttgaaacaccctttaagtaatttcaaactgttataggagatagaaagaaatcatttttgggaggccgaggcaggtggatggatcacttgaggtcaggagttcaccaccagcctggacaacatggtgaaatcctgtctctgctaaaaacacacacacacacacacaaaatttagggagtgctggctcacgcctgtaatcccaacattttaggaggccgaggtgggcagatcacttgaggtcaggagttcaagaccagcctggccaacatggtgaaaccccatttctactaaaaatacaaaaaaattagctgggtgtggtggtgcatacctgtagtcccagctactatggaggctgaggcaggagaatcacttgaacccagaaggcagagtagtgtaactgcccaaggggttcaccttgccctttgcctagacagagccaattcatcaagacaggaaaatttgtggaggaaaagttaaatattaaatttgaactcaattgaaaatggacacaaccaatggtcaccaagtcctggaacaggttgtgtgagccccttgatgcattcatccagcactgttttggagatatctctatttcaatctattccttttttttttttttttttgagacggagtctcgctctgtcacccaggctggagtgcagtggcgggatctcggctcactgcaagctccgcctcccgggttcactccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggctcaatctattcctatatattagttgttgaaaaacaatagagaattgcaaaagcaagttgacttttttgtgttgcttgagcccaatcatgaacgactctcttgactgggccttatgccaaacaactcattaccaaagagctagggtcccagagtgtgcccaagcttcatgagacctctcctcatctgtgcatagatgagtgtctgattctggagcccagactgttgcttcccactctggtggtgaatcctccatagtctggcgagcataatatatatatctcttttcccttctcctctttccattgcaatttgcttattgtatcaatctgcttatttcattgatttgcttatctcatttgcttattatatctgcatttccatttatgtaggataaagcttgttgacctttaaaggtattgtgtgtgtgtcttttcttctccccttgcgcgtttcccacacagaacatttttggcatcacaaacaggatttgaaaaccaaactgccacttttttgccacaatgacagagctggaaactcgaggaattcccatatccaggaatgggaactcccccagttctcacctttggggactgaatggttaaggggaactggtctttgtgggaactgagaatctaaattagtgcaatttaaacctttgactgtgcgggaagtgctgcaggggattccagtgagcaaaggagatgctgagggatctcccggagtggatggtgtttgcttactgcttataagttaatgtatcaagataggggctggttgctacaagagaaaaggtaagctggaaaaaaaaatgctaatccgacttccagactgaccctggcccaaagccaggcctatgtcttgactgatcaggctcaaagatatcagcctattgatgaaaaaagcagctgtcccaatggtcttatcagggtaaaattgaagaactaatcagctggggcctggagcaggtaaaaacccagctcttatctcaaggataggaaattaaccttagtaaaattcaaggacaagcacaaactgtaaaattcctcggcattctatggaatgcagggaaatagtccattttaccaaaggccaaggctaaaatactagaatttgcaacccctaccactaaaaaggaggcccagaaatgtattggcttgtttggattctggagacatgatattcctcacttgggtaacattttacaacctctgcatgcagccactagaaaacgctatgactttctttggggagagaaagagagcatggcttctgaacaagctaaacaagtgggtcaactggccctgggtctatgacctgtacggggtgggccagtagaactgcaagtaactgtcctaaatcaacatgctaattggagccttaggcagaagcaagatgggaagagggtacctttcaggttttggaaccagaaactgccagaggatgacaaagcttatacccgtttcgagaagcaattgttagcttgctattgggttttgctggaaacgaaacacctctgcttcaaccatgatgtctttatgaggcctgaaattcctactatgacttgagtcatgggttcccccaaaactcaccagatagggcatgcccaagaaagtagcatcatagaatggaaatggtatgtacaagagcatgctaagccaaagccaaagcgtatcatttttacatgaggatgtgcaaaacttgccagctcgggagatcaccaaggaagtcctgcaggtagggaaggaaacctcccccacccaatggggcaactcctttaaagtgtaaagcccaatcttgtattaacacgaatagactttcccttagatacctaaccttgtttttaacatgaatagactctcccttagctgagagaaccggaagaactccatttggctccttcatttacaagacatcaagtgctccttacccagcccctttcctcaaggacttaacttgtgcaagctgactctcaatatatcaaagagtgcaattaactgataaggtgctgaggcaagcgaagtccgctggaatttgctcggagatggtgccataaagcccccgcattttgtccggtagataacacgcagagcccccgcacctatcactttgtgatgaaataaaagcccctgcacctggaactgtttgttttcctgtaaccatttatctttttaactttttttgtctgtttttcttctgtaagattgctgcagctagaattccccctcccctctgtaaacccaagtataaaagaaaatctagccccttcttcggggctgagagaatttcgtgcgtcagccatctctcggtcgccggctaataaaggactcttgaatttgtctcaaagtgtggcgatttctaactcgctcaggtacaacaaaagaactaagcctagaggatcagaaacatgcttgatttatgatggatccaccaaatacattggtgggacccgatgctggaaggctgtggcttataaccctgttaaaaaggtaagcacttctgatgaaagaaggggtgggagcagcaagttagctgaactagtagccatcctctgagctatacaggaggaagccagagggatttgtcacttttttcatgcgcgtccgtgtgaagagaccaccaaacagtctttgtgtgagcaataaaagcttttaatcacctgggtacaggcaggctgagtccaaaaagagagtcagcgaagggagataagggtggggacattttataggatttgggtagataaattacagtcaaaggggggttgttctctggtgggcagagtgggggtcacaaggtgctcagtaggggagcttttgagacagggtgagccaggagaaggaatttcacaagacaatgtcatcagttaaggcaggaatgggccattttcacttcttttgtggtggaatgtcatcagttaaggcaggaacaggccatctggatgtgtacaggtcacaggggatatgatggcttagcttgggctcagaggcctgacaacttgtataccaacactttatcagtagcaaatggtcttactacctggatgctccaatggtaatgaaacaaattgttaattgggaataaagaggtttggggaaaacaatactgggaagatgtctgaatcctggcacacactaccattattgctgtcttccatgttgatgcccatgcatctctgctttctcttgacagactatttaatcaccaggaaaatcaacaggccaaaatttttattataactgcaaacttgaatgcagatgaatggattacaacgtgtttcaagccttgcaatgacaggcattataatggatggtggtataatttatagcgattagtggcctaaatgtgccacttaaaagatacagaatggtagaatggataagaatttaccaaccaaatatctgctatcatcaagagactcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccgcctgggcgacagagcgagactccgtctcaaaaaaaaaaaaaaaaaaagagactcacccaacacataaagactcacataaacttaaggcaaagggttggaaaaagataatcatgcaaatgtaccttaagagcaagcagtagtcgccattcttacatcagacaaaacagatattgaaacaaaaacggttaaaagaaagacaaagagggacattatataatgataaagggacaggaaactatcacaattctaaatatatgtggacctaacactggagctcccaatttattaaacaattactactagacctaagaaatgagatcaatgtcaatacaatgataatggggaacttcaatactctactgacagcactagacaagtcatcaagacagaaagtcaacaacaacaacaaaaaaacaatagacttaagctatagcctagaacaaatggacttgaaaaatatttacagaacattctacccaacaactacagaatatacattttattcctcagaacatgaaacattctccaagatagacatatgataggccacaaaacaagtctcaatacatttaagacaatcaaaattatatcaactactctctcagacaacaatggaataaaagtgaaaatcaacttcaaatgcaccctcacaaccatgcaaatacacggaaattaaatgaaaaataaaatttaggatcaacctgtttctgaatttttttgtatgaaatcaagatggaaatttaaaaattaattgagctgaatgataataatgacacaatctatcaaaatgtctgggatacaccaaaagtggcgttaaaaggaaagttcatagcatcaagtgcctacatcaaaaagtctgaaagagcataagtagacaatctaaaataacacttcaaggaactagagaaacaagaacaagccaaacccaaacccagcataagaaaagaaataacaaatatcagagcagaaccctagggggaggggtggctgcagtctctgtggacaagcagacttagcctttcctcctgctagttctgagcatttccagcagctcagatgagtgtatttgcccccagcaaaacactcctcctccaccaaacgacagtcaaagtgcttcattaaaagggttcttctccccatgcactggatgagacccctcaacaggggttgtcaggcaccctatacaggagtgatcctactggcttcaggttggtgcctcttgaggtcagagatcccagaggaaggtgcagacactcttctttactgctctgcagcctccttgagtgacctctccaggcactggagtgaaccagatgaatagggcctgaggtgaacccctagcaaggtgcagcaaccctacagaagagggacctgaccactgaatgaaaaacaaacaaacagaaagcagcaacaacagcatcaacaagaaaaaaatatacccagaaaaatcccacccaaggctgcacatggtggctcacaccataatccaaatactttgggaggttgaggcgggcagagcacttgaggtcaagagtttgagaccagcctggccaacgtggtgaaacctggtctctactaaaaaaaatacaaaaattagccaggcgtggtggtgcacgcctgttgtcccagctacttgggagtctgagacatgagaatcacttgaaccttggaggcggaagttgcagggagccaagatcctgccactgcactccagcctgggtgacagagcaagactctgtctcaaacaaaacaaaacaaaacaaaaaaatccaagggtcagcagcctcaaagatcaaaactagacaaactcatgaagatgagaaagaatcaacaaaaaaacattgagaggctagagtgcctcttctccaaatgatcaaaatgtttcttcagcaagggtacagaactggacagaggatgagatgcaggaattgacagaagtaggcttcagaagatgggtaataaaaaaactctgctgagccaaaggaacatgttctaacccaatataaagaagctaagaaccttgataaaaggttagaggagccgggcgcggtggctcacgcctgtaatcccagcactccgggaggccgaggcgggcggatcacgaggtcaggagatggagaccatcctggctaacaaggtgaaaccccgtcactactaaaaaatacaaaaaaaattagccaggcatggtggcgggagcctgtagtcccagctactcgggaggcagaggcaggagaatggcgtgaacccgggaggcggagcttgcagtgagctgagatcacgccactgcactccagactgggcgaaagagcaagactccgtctcaaaaaaaaaaaaaaaaaaaaaggttagaggaactgctaactataataacaagtttggagaggaacataaatgatctgatggagctgaaaaacacagcacgagaacttcatgaagcatacaaaagtatcagtagccgaactgaccaagcagaagaaagaatatcagtatttgaagaccaccttgtcaaaataaggcatgcagacaagattaaagaaaaaagaataaaaaggaacaaagaaagcctctgacaaatatggtgttctgtgaaggaaacacatgagggtagaagaaaagacacctacacaatacctttaagggtaaacaagctttatcccacataaatggcaatgcagatataagtaaattttttttttttttttgagacggagtctcactctgtcacccaggctggagtgcagtggcgcgatctcggctcactgcaagctccacctcccgggttcacgccattctcctgcctcaacgttctgagtagctgggaccacaggcacgtgccaccatgcccggctgattttttgtatttttagtagagacggggtttcaccgtggtctcgatctcctgacctcctgatccgaccgcgttggcctcccaaagtgctgggattacaagcgtgagccaccgcgcccggccaagtaaattgatataagaaaattgcaatggaaaggggagaaggaaaaagatatatatatatacacacacacacacataaatatatatatatacacacatataaatatatatatacatacacacataaatatatgtacatatatatacactcaccagactatggaggattcatcgccacaccggaatgcaacaacctgggctccagagtcagccacccatccatgcaaggacaaggagaggtctctttaagctttagtgcgttctggggctctaggtcattttgtaacaagttgtttggcatgaggcacagtggagggcccttgagactgggctcaaggaacacaaaaagttaacttgtttttgcaattggctattgtttttcaataacaatataaaggaatagattgaaatcgagatttctctgaaacaactctagatgaatgcatcaaggggctcgcagaacctattctcaggcttggtgaccatcgtttgtgtccacattcaattcaattcaaatttaactttttctccacctttggcctcaattggatactcaattgtaggaaaatacccttacagatacatagggaaggcatagtcgatatagattacagatacagggtaaggacaggagaattaaaagcacaattaataaaaaccacacccagcatggctttctaaggagagtcatattgtgagaattgccagggatatacacaccacatttagcatgcaatatggcacaaatccctccttgggctgcggtaagcatatctaatgccatttgattttgcaacacaacagtactcagctgagcaaatttatctggtaacaacataagtctagtgctaatatcattaagagctttttctacatataaccttaatattttagtttgttgctgaagcaggattgtaccagtggcaggggagaatactgtgatagggtactgccaccagggaggccagggaggctggcacattcataaccagtgatgtttgtaagtatctaaattacttgggagaggaatattaacccggatggtgaatggaattaatggctatccccaagttcatctccctgtccagtgtggggacaggtatcaccactcataggatctgcatacccagagggctcccccaggggacagcaatggagctactgtaatcacagtgtactcatgtattattaaagtaggaaagagattgtggttcactgggggcaatgttgatttggagtatgtgttgacaattgtctggagaaaccccagagtaatattagaggaaccttttaaggcctccagactaagcgggggctatagggaatccaggcaccagcacagctggtttccaaaatataccattccaggaatattgggcaggataccaaggcttttgatgaaaggagaatgtggagttcaccttttgtctgacttgggcaaagatagattgcttagtgtggtcaaaggaagtacaggttggactacaagtgttgttgtgaccccgttggtaactacatagccattcagaaatgttgtcaggatgattctccaaggtagcccattcctggcggcctttggcaactcgacgtatagaaaacattgtctgtgattggcttctattgcagcggtggctacccagttcatgaatttattcttggcctcagacacaaagacacaggtgctgaccattagtagatagattattccctgtaataacaaaaaaggataggaacatcatattgtttttcatctttaggaaattgtactatgccttcattttctgttttcacagctacaaggtcaccagacttaggggtgggatctgatggatgctgtacccatatattggctccaggatttaagctacatgaaccagtggatctgaatccccgagttctgtatgtagcctctgttgggacagagatttcctcaggggttaattgttgacaaggtaccactaataattgagcaacccacatttgtggttttatagcaaaagaatctggagtggtattgtataaaacaacctttaactctccccagtaatcaccatcaattataccaccaaacactataatgcctctcattgcaaggcttgaacacattgtaatccattcatccacattcaaatttgcatttatggtggaaattttggcctgtcgatcttcctgctgattaaatagtctgtcaagaaaagcagagatgcatgagcatcatcatggaaaacagatccaggagtggtggcccaagcctgtacttctaccaatttgggaggctgaggtgggttgttcacgaggtcaggagattgagaccaccctggtgaacacagtgaaaccccgcctctactagagaagtacaaaaattagctgggcgtggcggtgcatgcctgtaatcccagctactcgggaggctgaggcaggagaatcacttgaacctgggaggcagaggttgcagtgagctgagactcagccactgcactcaagcctggtgacccgagactgagccactgtactccagcctggtgacagagctagactccgtgtcaaaaaaaataaattaattaatacaggaaaacaatgataatggtagtgtgtaccagaattcatgtatcttcccagtattgttttccccatacctctttattcccaattaaccatttgttttgttgtcattggggcatccaggtagtaagaccatttgctactgagcaagagttggtatacaagtgacaaatccttcttccttcctttcgaagagctcagaggatgtctactagttcagttaactggctgctcccacccctttcttcatcagaaatggttatgtttttcggttgtttgtttttgagatggagtctcagtctgtcacataggctggagtgcagtggtgagacctcagctcattgcaacctctgcctcctgggattccagtgattctcctgcctcagccccctgagtagctgggattatagatgcatgccaccacacctggctagtttttgtatttttagtagagatggggtttcatcatgttggccagcctggtctcaaacttctgacctcgtgatccacacatcttggcctcctgtggattttgagggaactcgtgacctaaatcataacaggaaatttaggcctcataaagacatcatggttaaagcagaggtgttttgtttccagtaaagtccaatagcaagctaacaattgtgcacaggtgaggagagctgtcacgaagctttggcgcagtctgggaccctagctcttttgtaatgagttgtttggcacgaggcttagtcatgaggacccttcgcgactgagctgaagaaacacaaaaaggtcacttgtttttgggattgtctgttgtttttcaagaacgaatgtataggaatagattgaaatacagatttctctgaaacagcgctggatgaacgcctctaggggctcacacaacctgttcccggacttggtgaccattgtttgtgtccacgttcaattagcacaaatttattatttaactttgactccacaccagactatggaggattcaccaccagaccggaaagcaacaggatgggctccagagttggccacccatcggtgcacagaccaggagaggtataatgacgcttctgcgcggtctgggaacctagctctttttgtaacgagttgttcagcatgaggcctagtcaccagggcccttcatgactggtctcaaggaacacagaaaggtcaacttgtttttgtgattgtctattgtttttctttttctttctttcttttttttttttttttttgagacggagtctcgctctgtcgcccaggctggagtgcagtggcgcgatctcggctcactccaagttccgcctcccaggttcacaccattctcctgcctcagcttcccgactagctgggactacaggcgcctgccaccaggcctggctaattttttgtatttctagtagagacggggtttcagcgtgttagccagcatggtcttgatctcctgacctcgtgacccgcccgcctcagcctcccaaagtgctgagattacaggcgtgagccaccgcgcccggccttgtctattgtttttcaataacgaatgtataggaatagattgaatagattgacatagagatttctctaaaatagcactggatgaacgcctcaaggggctcacacaacctcttccaggacttggtgaccattgtttgtgtccacgttcaattgagttcaaattaaatatttaacttttcctccacaaattcccctgtcttgatgaattggttttgtctgggcaaagggcaaggtaaactccttgggcggttacacaacctccacctcctaggttcaagagattctcctgcctcagccttcggtgtagctgggactacaggtgtgcaccagcacgcccaggtaaggttttgtatttttagtagaaatggggtttcaccgtgttggccagggtggtcttgaactcctgacctcaagtgattcgccctctttggcttcccaaagtgctggaattacaggcgtgagccaccgcgcctggccctaaatgatttcctttctgtctcctataacagtttgaaattacttaaaagttgtttcaaattgaaaaaataaaaagaatgtagataaaaataaaatataaaaagttaaaaaaattacattagattacaaaatatatatgatgtatatgtaagtctcgagaggtcaaaaatgacaaatttgatttacttacaaggttttattaaaattagctttcgtattgataatacactattaccaaagtaaaagttttctcttgaacaaaaattttttgtattattaatatgacagccaaatacttctgttcaccttttgaatacattcaaaaagagaaagagtaaaaaagaattttcccatgctctccggtgggcctggctcagctcaaggaggaagcccggcctgaaaaggctgcagctgaggctgtgactctttcttcactcagcccagcatgtgatcacatcttctgtcactcagggactgaggaggcggggccttaagcattatccaatcagggacgctgggttggaaaccgtccaatcatgcaggcagctggagcgaagaggaaggctttcgggtttggcgcggccatttgtctcttgctgcagctggtgctccaaatctggtcttagctgcttcgtgtcttcttctccagcctctgtggccctgtgacctgcaggtattgggagatccacagctgagggacccccggaagcctagaaatggtgagagtgcctttccagcattccgagagaggggagggactggttggaaccgatgggaagtggctgtggcgggacttaggcctccccgcagtcagctccacaatctgcgaccgacttctccttgcccagttcggcctcagtccccttcagccataagatggcaacagcgccgacagccgggccccgcggcgtcctgtctcttccctgccctggcctggagccctctctgggcagctctgcacccacagcgctgcgtctctcccagattgtgcagggagcacgggagggttctcgggggagaatcctgactcggggtgcaggttcatgaatgggaagagctttggtccatggggttgacagtttctcttttctcctattaaaaacttatggggccggtcgctgtggttcatgcctgtaatcccagcattttgggaggtcgaggcgagcggatcacttgaggtaaagggttgttagtacaacgtagttcttcttcaaagacgcaacttcctggtcataagttggaaaagttgtaaatcacccctaccccttcttctcccttctccttttctcacaaatcgcgcattacccgatttggaaaaagcttgagtgtaagccaaccgggatcagcttagattgtgcggtctgaccccagccaatggagggaaaacaaaaacagaactgcattagggctaataaccccttcccggccaggcgcggtggctcctgcctgtaatttcagcactttggggcgccgaggcgggcggatcacgtggtcaaatttctagaccagcctatccaacgtggtgaaacctctctctactaaaaatacaaaaattagcctggagtggtgccaagcgcctgtaatcccagcaacttgggaggctgaggcccgagaattgcttgaactcgggaggcagaggttgcagtgagctgagatccctccatcgcgctccagcatgcgcgacagagggagagtcctcaaaaaaaaaaaaaaaaaaaaaagtaagcatcttaaaatttccatcctttatgtaaacactgtgttttagtaacttcactgtattttccaacacttagtttcaaaaacccagtgaataactctggcatggaaattaaagcttgaacctagtgattccgagctaaggctaatattaagcctgcaaaaggagggttttttttttttttttgagatggagtttgtccaggcagatgcagttaagattaagatgaaaggaaactggatgggtcttactgataatgatgttattgttttgaggcacttgtttgactttgtaaaataaaaacgttagatttatggaaaaaaatgaattccaaaaacatattgcaacaggaggaagtaccaacaaagtataacgtctttatggcttgcaaaaacgtaggcagaaaagtgctttcttccctagggaggagcaaagaagtttagaaaggaggtgggaggggaatggcaaatggagggtgcaaaagtcagattttatatcagagaatgtcttactctgaaatcagcatgttcttaggagggatgtaaaatgtggttgtatgttgactcagactgagggtagctcaaagttcaggagcttgagggaggcatataagcttaagaaaagtttcattgagaaatattttgttttaggccaggcgcggtggctcacgcctgtaatctcatctgctcggccaccctgtcccggccctgaagcgatgtaagcaagaagctgccctgctggaactgctccttcgggagactgctgattttggcattctttttcctttcatcgtatttcctctttttttttttttttgagatgaagtttctctcttattgcccaggctggagtgcaatggcacaatctcggctcactgcaacctccgcctcctgggttcaagcgattctcctgcctcagcctcccgagtagctgggattacaggcatgcaccaccacacctggctaattttgtatttttagtagagacagagtttctccatgttgaggctgcaagaattgcaggtcagcaagaattgctgcccaggggcagcacataatgggactagtaccaccgtcctgacggtgtgctgttgatgagcacgatgcaattcttcaccagggtcttggtacggactagctcgttattagatgtattgtagacaacatggacgatccttgttttaccagtacaacactctgagccacaggagaaattcccccgtccagcctcagggcaccgtatttcttcttacctccccacaaacggactgtgtggatgcggcgggggccaatcttggtgttggcagccgggcgccacaactcatccttctgcttcttgtggtagggctttctcttgcccctggacttgcagcgtttgtgccagttgtcccaagagatgcccatctctcagcgctggctggaaagagttctcttttctttgatctatgcatttcttccatttggcttttcctgggccacatcttatacattaaaccggtaaacatcactacagtgttttcctgagttctgtgaatagctctagcaaattatttgggtgtccccaattttcaaacaataggtgagaagcatagatgggccatggggtttgtgactggcatctgcagtgaggacaatgttgtgggactgagcactgaaacggggtctgtgctgactctgggtggtgtcagatttcaaatgttagataatgagttgttgttggagagttgtttgacgttcagcaaactctgcagatttggtgccagcaaaagatatcacggaggcctggcctggaataaaactctgggtgtttgggaataggaggctctcctgtacacaggctgtcacactgcccattgtcctgtgattccagatcttctcccagggtgacagaggactgaaaacttagaggaaaagagctctgatgacagacaccccccttttcttgcaagtgccacaataggattcccacctactcacaaacacacacactagacatagacgtgcccatactcctcccaggactaggcaccaccttcaggaacttcattatgccatttttttttctttttctgagacagagtcttgctcttttgcccaggctggagtgcagtggtgccatctcggctcacttcaacctctgcctcccaggttccaacgattcttctgcctcagcctcccaagtggctgggattacaagtgagtgccaccacacccagctaatttttgtatttttagtagagacttggtttcaccatgttggccacgctggtctcaaaatcctgacctcatgatccacccaccttgccctcccaaagtgccgggattacaggcataagccatcgcacccagccagcatttttgatcctagtgtttcttgccaagaacccacaagtgtctacaagtctcctggcatatccccacccccagacactgaatctgcagcagcaacctattttctccatcaacctaaaggtctggacctcctctttataatctcatctgcctgcatgcatacagaaataaatcagagtgtggccccacctgggccactatctgtagcgaaaatcagtctgttcatctacattgcagtctttcccacacagggatttgttttttttctttctttctttcttctttttttttttttgagatggcgtctcgctctgtcatccaggctggagtgcagtggcgagatctcggctcactgcaaggtctgcctcccaggttcacactattctcctgcctcagcctgctgagcagctgggactacaggcacgtgccactacccccggctaattttttgtatttttagtagagacggggtttcaccatgttagccaggagggtctcgatctcctgacctcgtgatccacccgcctcggcctcctaaagtgctgggattacaggcgtgagccaccgcgcctggcctgtttttttttcttgtagcttttatttttggtttagggtacacatatgggtttgttatacagctaaaattatgtcatgggggtttggtgtgcagattttatcactgagatactacgtatagcaccaaacatgtctgttttctgatcctcatggtcctcccactctccaccctctactaggtctcagtgtctgttattctcctgttgtgttcatgtgttcttattatttagctcttacttataaataataacatgcatttggttttctgtttctgcatttgtggggaaaagagagatcagactgttactgtgtctatgtagaaagaagtagacataagagactccattttgttctgtactaagaaaaattcttctgccttgagatactgttaatctgtaaccctacccgctaccctgtgcttgcaggaacatgtgctgtgtccactcaaggtttaatggatttagggctatgcaggatgtgctttgttaaacaaatgcttgaaggcagcatgcttgttaaaagtcatcaccactccctaatctcaagtgcccagggacacaaaacactgtggaaggccgcagggacctctgcctaggaaagccaggtattgtgcaaggtttttccccatgtgatagtctgaaatatgacctcatggcaagggaaagacctgaccatcccccagcccgacacccataaagggtctgtgctgaggaggattagtaaaagagaaagtcctctttgcagttgagataagaggaaggcatctgtctcctgctcctccctgggcaatggaatgtctcagtgtaaaacctgattgtatattccatctactgagataggagaaaacccccttaacgctggaggtgagacgtgctggtggcaatactgctctttaatgcaccagatatgtttatgtatgtgcacatcaaaacacagcacattttctaaccttgtttctgacactgagacatttcttcacgttttcctgctgacccttcccccgctattaccctattgtcctgccacatctccctctctgagatggtagtgataatgatcagtaaataactagggaactcagagactggtgccggtgccggtcctccatctgctgagctcttgtcccctgggcccacttttctttctctatactttgtctctgtgtctctttcttttctcagtctctagtcccacccgatgagaaatactcacaggtgtggaggggcaggccacccctttagcattagttttcttttttttttgttttttgttttgttttttgagatgaagttttgctcttgttgcccaggctgcagtgtaatgttgcgatctcggctcattgcaacctttgactcctgggttctagcgattctcctgcctcagcctcccaagtagctagtattataggcgtgcaccaccacgtttggctaattttgtgtttttagtagcaacagggtttctccatgttggtcaggatggtcttaagctcccgacctcaggtgattatcccacttcagcctcccaaagtgctgggattacaggcctgagccaccacgcccaggctctgcattagttttctaagaataatgatctccagcatcatcgatgttattgcaaaggacataatcatttcttttaatggccacagagtattcatgatgtttatgtatcatattttgtttttactaaatcttttatttttggagacagggtcttacttattgttcaggctagagtgctgtggcatgatactgacatacattagcctgaacctttcaggctcaagcaattctctcctacctcatcctcacaagtagctgggactacacatttgcgttaccacccctggccaatttttctttttgtattttttgtggagacaggattttgccatgttgcttaggctggtcccaaacttctaaactcaggcaatccaactgccttggcctcccaaaatgctgggaggacgggcatgagccaccacatttgaccataccatattttctttttttttttttgagacggagtctcccaggctggagtgcagtggtgcgatcttggctcactgcaaactccacctcccaggttcaagcaattctcctgcctcagccttctgtgtagctgggactacaggtgctggccaccacgcatggcaaattttttttgtatttttagtagagacggggtttcaccatattggtcaggctggtctcgaactcctgacctctggtgatccgcccgggtcagcctcccaaagtgctgggattacaggcatgagccactgcgccaggctgaccataccatattttctttatccagtctaccattgataggcatttacagcctgtccatgtctttgctattgtgaatagtgctgcaatgaacatgcatgtgggtatgtctttatgatataataatttatatttctttggctatatacccagttgtggggctcctgggtcaaatgaggattctgtttttagttctgtgaggaatcgccacactgctttttacagtttttgaactaatttacactcccaccagaagagtataagcattcccttttctctgcaaccttgccagcatctgttattttttgactttttaaaaatagccattctgactggtgtgtggtggtgtctcattgtgatttttcttttaatttctctaatgattagcgatgaccactttttttcatatgctagttagcttcatatatgtcttcttttgaaaagcatctgttcatatattttgcctaatttttaatgaggttgttcggttttttcttgtaagcttgtaggttgtctgtttactctgttgatagtttcctttctgttaggaagctcttaagttcaaatgggtcccattggtcaatttttgcttttgttgcagtagcttttggtagcttcctcatgaagtctttcccagtttttatgtctagaatggtatttcctaggttatcatggctgggtttcttataattttaagtttttcatttaattttttaatttatcttcagttgatttttgtaaatcaaaatgaaatgaaagggtccagtttctgtcttctacatagtgttaggtatttattccagcaccatttatgaaacaattcttcccacattcctcttgacagctttgtcagaaatctgatggcggtaggagggtggcattatttctggcctctctgttctgttgcattggtcttttttttttagacggagtctcgctctttggccgagactggagtgcagtggcccgatctcggctcactgcaagctccgcctcccgggttcatgccattctcctgcctcagcctcccgaatagctgggactacaggtgcctgccaccgcgcccggctaatttttttgtatttttagtagagatggggtttcaccgggctagccaggatggtctcgatctcctgacctcgtgatctgcccgcctcggcctcccaaagtgctgggattacaggcttgagccaccgcgcccggccagttgcattggtcttatgcattaataagtttcatataatatctttctctcttttggtttttccctcataaaccttctttcaagtgcatacattgtacaaatttcagatgtccaagagttcaaaactctttgaaaacttccaaaaatgtttttgctattccctctttttgtaaggaatttagattatatgtagatatttttctttgttttattgaaatatatgtaaatcatattaacagctaaataaaccttttgtcattttttctgactccagattatctttatctagtacttcagatttattactttgtttttgcttccaaaatgtttatttttttcatttttagtcctttagacagatttgtttagataaaagctcattttaatagcatacagaagcttagcacaaagagaattaaatttagcaatacagaatgataaagactaaaagatactaaatttctttgtcagaaacctgatgatccaaggtaattatccaatatttgcaggctgaagcacttgtactgcaaaagcaagaacagttcagtgcataaactgaacagtgcagtctgtagttgtaccttgctttctattacttcataacaattagtatagttatgtgtaatgtttgcagactacctgcattcatataaattaaacagtattttcttttcttttttttttttttttttttttgagacagagtctcactcttgcccaggctggagttcagtggcgtaatttcagctcactgcaaccgctgcctcccgggttgaagtgattctcctgcctcagcctccagaatagctgggattacaggtgtgcccaaccatgcctgtctaaattattgtatttatagtagggatggtgtgttatcatgttcaccagcttaatcttgaatccttgacctcaggtgatccacccgcctcagcctcctaaagtgctgggattacaggggtgagccataaacagtattttctacaatagtatgagtacaaagctgcactacttactttgaattaatcacttaaatggttattttaatatcattatttacacttctgaaatataaaatgttttaactgaagtatagttttaatttttaaaactataattttaaactatacacatactatatacatactatatacattatgactagttcattaaaatgatttatacttacttaagtctaatatccaaataaaatttataccaaattgttacattaagtagatattagtgtgacatgtttattactttattcaatagggattattatgagtaaacacaattttaatatcttttatttcactaaattggtatgctgctattacaggacaaataaagacaggtgatgtggccacccaaaaactataatggttcttcagtttgctatgttgcaagctctaatatgttccactatatgaacacagtcagattctatttcttcatcaaaaagtgttgcttgaagttgtcagatgtatttcaatatagaacctccattcaatggctaggagatgagggaacagcagagatggaaaagaaactttataaaattattcttaagatctgcctccttcataatgctcatttctcatgctgagagtagcttgcactttgggtgtttagagagagatttcttttaggggaatattttctgactgacatgatcaatcttatatctaatctgagctttttcttagattattttaacttttttctcaaaataatcttgctcagatggagataatgtttttctctccaatgctttgggtgtctgtttcagaagatctatttgtatcacatggtttctgaataagctgggctgtcacagtgagagcttttggagctatctctatctggactcatgctggaaattcagcagtattttttccttgtcaccattataagtagaaaggagttgaaacactgctcccatttccattactgtgaaggtgaaattttacccaggaggcctgcaggctctcctcctgcagctcaggcttcactctctgatgtgacactggagtgctgctgtggcaaattgggttcacacaaaaggtgagctgtgctctgggctgtgcctcagtggcagatggtagaggtaaatagaggacactagctttcgtgcgtgtctatgtgaagagaccaccaaacaggctttgtgtgagcaataaagcttttgatcacctgggtgcagttgggctgagtccgaaaagagagtcagcaaagggagataagtgtggggccattttataggatttcggtaggtaaaggaaaattaaagtcaaagggggtttgttctctggtggacaggaatgggggtcgcaaggtgctcagtgggggtgctttttgagccaggatgagccaggaaaaggactttcacaaagtgatgtcaacagttaaggcaaggaccggccatttacacttcctttgtggtggaatgtcatcagttaaggtggggcagggcatattcacttcttttgtgattcttcagttacttcagaccatctgggcatatacgtgcaggtcacaggggatgcgatggcttggcttgggctcagaggcctgacattcctgccttcttatattaataagaaaaataaaacaaaatagtgttgaagtgttggggcggcaaaaatttttggggggtggtatggagagagaatgggcgatgtttctcagggctgcttcaagcgggattgggggggcgtgggaacctagagtgggagagattaagctgaagggaggtcttgtggtaaggggtgatattgtggggatgttagaagaaacatttgtcgtatagaaagattggtgatggcctggatacggttttggatcaattgagaaactaaacagaagatacaaggttcaaataaaggaaggagaaaaatgggtattaaaggactaagaattgggaggacccaagacatccaattagagagtgcccaagggggttcagcgtaattacttgcttggttggcaagtttttgggctctatccttgagtttttttatgttgtcatacaccaggccagattgatttaggtaaaaacaacactcttcatttaagaatatgcagggtcctcctttttcagcagtgagtaagtcaaggcctcggcagttttggaggacaactgcagctaaagagtcaacttgggcctggaggactgataaagtttgtgatatgtctgtgatgctagcagagaagtcattacacaggctacagaaggtcgtgacagaggttgaaatgcctgctattccagtaccaagagcaatagtggaggcagaaagtcctaaacggaccatcaagggaattagtggaagaactcttttttgtcatgttggtgtcatgaggggaacagggagctcttcggtcctatttgcaaattgaattttgggggtaaggaagactagtgtacatgtgcctgtccaattagcaggtagacacatgtaggtagaggatccacagaggaagaagagaccttgtgtgaggcaaaactggagatgtaaagtaaaaagatgagaaggagtgctgaaaggggtgtcttgtacccagactcctagggatccagctagggcggcagctgtcagaggttgtaatggggactgatggggtaactgcatagagggggagttttgattttcatggtgtatgagaaaacattgagtatctatgagcaacctttcactgttattttcggggctgggtataagtaaacgagaagagggcctgggaggagagtctgacgagcaaggggaaggtagccaaggatggagtgaaatacagggcaagtgtcttcctaagcaataattgctgcgaatttttttaagtttgcctgtattgatagagggcttgtctgtaatatgcagctggaaggctccagttgtttcagtgatgtgtgtagttgggcttcggagatgaagagtaaaggaacatcgagaaggtaaaagattacctaggggaattccagtgggtctttgcggagagatacataaaggagtggccactggaatagtaatttgtgttgtgagaggtccaaataggggggaagtagagttaatataaggagaaaggttttttaaataagtgcgaaggagggcggcagcttgctgatgtgaaatgtctggggaagtcttgctggacctgtccagaaagtaaatgagttcttcaggagggtaaagttgagggctgttaaaggaagttcggaggtgtagggagacggggggtgttgcccagtctgtctgtaaggtggggacagctgtgtaggcactggaagaaagggaaatgcaaaggcagcagttgttcgccaaggagggattagaagcggctaggagagaatgggtaaggttgatactgtggtggagatagctggggagaggtagagggtgacataagaatgggaatgagaataagagtgagcataaaagtaaagagtagaacttcatcagggttggaagtattggagggtgccctgccagcaaagatcatctatccactctaagagggagttaagagtggtggtttggggatagcaccaagagatatcagctgtaatggcttgaagaaacagtgtaaactggcagtgtaaacaagagtagggcatttataagtagttgagaatggagaataggagtatgaccggacagaagatagtagggatgactagtttttggggctcggcctaagtggtgggggtgacttcgtaaagccctgttgcaaaaagtagggtaaggacgaacagacctaatagaatgaagggatgtattaggctcataagggttattactgttcttcagaaatacgagtgagtttaagggaagtgggggagagtacttaagtgggggagagtacttgtgacttctaggaggaagaggagggattaggctggctgtccgatggacacagctttattctggaatggtgaacccagtggggaggatcctgcaggcggacggcagtcggggactatagatgactaagtagggtcccgtccatcgaggttgtagagtttgaggggtcagattcttaacaacaactgatcgtccagctaggttgtcttcatatggctggcgatctggagtaggtaagagaagattagaagcctggtgaatttcctgtctagcctgctggaggactggaagatagtcacctagagggctggtgtctgggatgaggctggggccaagcaagaaagtgcgtccatataaaagttcaaatggactgtaccctgtagcatctcgaggacaggctctgattctgagaagagcaagaggtaaaagtactgtccaatcttttttaagttggaggctgagcttggtgaggtgtggctttaaaagaccattagtccgttctacctttcctgaagattgaggatggtaagggatatgaagtttccactgaataccaagagcctgagaaactgcttgggtgatttggctagtaaaggctggtccgttatcagactgtatagaggtgggaaggccaaaccgaggaattatgtctgacagaagggaagaaatgaccgcggtggcctttcagaccctgtggggaaggcctctacccatccagtgaaagtgtctacccagactaagatattttagttttctgactcgaggcatgtgagtaaagtcaatttgccagtcctgggcaggggcaaatccccgagcttgatgtgtagggaagggagggggcctgaacaatccctgaggggtagtagaatagcagatggaacactgagaagtgatctccttgaggatagatttccatgatggaaaggaaatgagaggttctaagagacggtctagcggcttgtaacctacatggaagaggttatgaaatgatgacagaatagaatgggcctgtgaggctggaagaagatattttccttggtctaagaaccatttgccttgtgtgggaagagattgataggtggaagtttccgtgggggagtaggtgggagtgactgaagcgaaggagaaaaactggctgtgagggacagaagttggagagctagctgcttgtctagccactttatcagcataagcattgcctagagcaatgggatctgatgccttttgatgccccttgcagtgaatgaccccagcttcttttggaagtaaagtggtcttgagcagagtttttattaaagaggcattaatgatggaggacccttgtgtagtgaggaaacctctttcagcccatatgactgcatggtgctgcagaatatgaaaggcatatttagaatcagtatagatattgatgcgtagtccttttgcaagagtgagggcttgagttaaggtaactagttcggcttgctgagaggtagtggagggaggcagagcggtagcctcaatgatagatgtggaagatactatagcatagcctgcctttgctggtgagtggtgattaggcctggtggaactgccatcaataaaccaagtgtgatcagggtgagaaacagggaagaaggaaatttggggaaatgtgaatgtcaggtggatcagagagatgcagtcatgagggtcaggtgtggtatccggaataatgtgggaggccgcatttaagtccaggccaggaacaatggtaattgtgggagactcaacaaagagtgagtatagcagaaggagccggggagcagaaagtatatgtgtcaggtgtgaggaagaaaatagattttggaaattatgagagctgtagagagtgagttgagcatagtttgtgattttgagggcctctacaagtattagggcagcagcagcggctgcacggagacatgatggccagcctaaaacagtaaggtcaagttgtttggacaaaaaggctacaggatgcgatcctggtccttgtgtaagaattcagactgcacagccctgcacttcggctgtgtgtaatgaaaagggttgggatgagtcagggagagctagaataggggcagtctctaaagctgtcttcaaggaatggaaagaggagtggggaaaggatttaggatctatggggtcagctaggtttccttttgtgagtttatataattgttttgttaggttggcaaaaccaggtatccaaaggtgaaagtatccaaccatgccgaggaaggaaaggagttgttgttttgtagaagggattggggtttgagagattagtcggatacgatcggcagggagagcatgtgtgttcttatgaagaattatgccgaggtaggtaacggatggagaagaaatttgagctttggagggggatacccgatatcctttggagaataaacactgaaggagcagaagtgtgtcttgttgagaagattcaaaggaggggctacaaagaagaaggtcatcaatatattgaataaggtgagaagcggaggggtggaaggaaagtagatcatgagaaagagcttggctgaagtaatgagggctgtccctgaaaccctgcggcagcacagcccaggtaagctgctgggactgatgggtgtcagggtcagtccaggtgaaagcaaagagaggctgggacgaggggtgcaggggaatagtgaaaaaagcatctttaagatcaagcatggaatagtgagttgtggaggaaggtattgaggacaaaagagtgtacgggttgggcaccacagggtggataggcaaaacaatttggttgataagacgcagatcctgaactaatctgtaagacttatccggtttttggacaggtaaaatgggggaattgtaaggagagtttataggttttagaagcccatgctgtagcaggtgagtgataacaggctttaatcattttaaagcatgctgtgggatggaatattggtgttgagcagggtaagggtgattaggttttaatgggatggtaatgggcatgtgatcggttgccagggaaggagtagagatgtcccatacttgtgggctaaggtggggggatatgagaggaagatgcgaaggaggcttttggttggggagaagggcggcaatgagatgtggctgtagtccaggaacagtcagggaagcagataatttggttaaaatatcttggcctaataagggaactgggcaggtggggataactaaaaaagagtgcataaaagagtgttgtccaagttggcaccagagtgggggagttttcaggggttttgaagcttggccgtcaatactcacaacagttatgggggcaaggaaaacaggcccttgaaaagaaggcaatgtggagtgggtagcccccgtatcgattaaacaggggatggacttaccctccactgtgagagttacccaaagctcggcgtccatgatggtccagggggcttccgaggcgatcgggcaatgtcaatcttcagttgctaagccaagcagatctgggaaggagtcagtcagagagccttgggctagagctttaggggttctaggagtggctgccgggtgagctgggcagtctgatttgcagtgagtccctgcacagatgggacatggcttgggaggaatcccgggctgcgggcattccttggcccagtggccagatttctggcacttgaagcaagatcctgatggaggaagtcttgtaggaatgcttgactgctgtggcttaggcattctgaagttctcctatgcaggaggtgtggctgggttttgtctcacagtaggggcaagtaactgtaactcagaaatgcattgccgtctggctgcttcctccctattattgtgcaccttgaaggtgaggttgattaattcctgttgtggggtttgagggccagattctaatttttgaagtttttttgtaatgtcaggagctgactgggtgataaaatgcatattgagaataaggcggccttctggcccctctgggtctagggcggtaaagcgtctaagggttgctgctaagcgggccacgacctgggctgggttttcatcttcaccttgggtagtttctttaagtttgtcataattaacagctttgtaagctgcttttttaagcccttcaactaggcaggaaaccatgtaatctcgcctagctatacctggggaatttgcctgatggttccattggggatcctctcggggaactgctctaatgccttcctggaggtctggctcgtgaagccggcggttatcagcatgagattgggctagagaagaaactctttcccattcatctggggagagggtagaagtcaggatgacatttaagtcactccaggttaagttgtaggacagagttagacattggaattcctgtgtatatttagtggggtctgatgagaaagagcctaaacattgactgatctgagaaaggtctgatagagaaaaaggtacatgtaccctgactatgccttcagctccagccacctctctaagaggaaattgttgggcaggtggggaagagctagtcgcggaactaaactgtaagccggaccgggtgtgaggaggggaggtgatagaaggattatagggtggaggagtggaggctgaggaagaattgggacttagctcggcctggcaatgagcagcctggggaggaggggaaaggtcagatgggtctgtagaaaaggaagactggaaagactcagcgatgcttggggttgggactgaggggacaggcgggagggaaagaaggaggatctgggaggaatcgcattgggaacagaggctagggagggaacgaagtgtgaaaaatgcctggacgtaaggcacctcagaccatttgcccatttttcgacaaaaattatttaggtcttgtaggatgaagaaatcgaaagtgccgttttctggccatttagagccactgtcgatttgtattggggccaagcagtgttgcagaagaaaataaggcatttaggttttaggtcaggtgtgagttgaagaggttttaagttcttgaggacacaggctaaaggagaaggaggaatggagggtggaaggttgcccatagtaaaggaggcaaaccaagagaaaagagagcatagagacacggagggaaggggttcggaggttcttaccctccagaaaagcaggaaggggggtcagggcatggaaataagggattggggcacagagataagaggttgggctgcagaaataagggattggggcacagataagaggttggggtgcagaaataagggattggggcacagagataagagataagagattggggcacagaaataagggattgggggttcttgccccctagaaaagtgggacttgccgctaagggtgaaggagaaggggttgaggggttcttgcccctgccccagaaaagcagagaaggggtagagacaaggagagaaggggttgaggggtacttgtcccttccccagaaaagcgggacttgccgctaagggtgaaggaccaaggcaggtgtccctgtgtggtctgacacccttgaaacgtgagtgtataatcagagaggcatccctgcaatgattaaacaccaagggaaggctgccttcccagtccgtgaccggtgccggagttttgggtccatggataaaacgtgtctcctttgtctctaccagaaaatgaaaggaattgaaattaagagaagggagagattgaagtgtggcgccaagattggaaggagaaagaggttgagggatagtgagggaggttggagaagagagtaaaaagaggccgcttaccggatttgaaattggtgagatgtttcttgggctggtcggtctgaggacctgaggtcataggtgaatctttctcatggagcaaagaacagaggacaggggattgatctcccaagggaggtcccctgatccgaatcatggcaccaaatttcatgcatgtccgtgtgaagagaccaccaaacaggctttgtgtgagcaataaagcttttaatcacctgagtgcaggtgggctgattccgaaaagagagtcagcgaagggagataagggtggggccattttataggatttgggtaggtaaaggaaaattacagtcaaagggggtttgttctctggtgggcaggagtgggggtcgcaaggtgctcagtgggggtgctttttgagccaggatgagccaggaaaaggactttcacaaggtaatgtcatcagttaaggcaaggactggccatttacacttctgtggtggaatgtcatcagttaaggtggggcagggcatattcacttcttttgtgattcttcagttacttcagaccatctgggcatatacgtgcaggtcacaggggatgcgatggcttggcttgggctcagaggcctgacactagcaaccaggagaaagcaagcaggagtgctgtagccccctgccagagtgtacagagccactgctctaagtagccaaaatgatagaaccctatttaaccttttttgtagcagagtgaaaccctaccttcagcaggcacttggcttcaagcagctaaaccacctcctgttatgaagatgggaaatgtttatttgtcattgaatatgagcaattagcatacacacatggcctcgtcaatctccaggtgaatttaggatgaactatatatgacgtggtgctggaaattcttctacttgtggactaattatggtgaccatctttctatctttgcagtcacttaagcagattgactatgatgcatgtcacacttaattgtgtaataaaacagttttctttctgtactattattgtggcatttctctggggctggagacatgttttctttattgtttccaaatactgtctagaattaccagacatgatataaacacataaggtgccaatgagaatttactctagaggggacttttcctctcaggcttccagttgactgacacttgtgcagcacagtgcacgctgtcccctaaagatgcaggcagaattgtgtctcagcctatttattaatctatagtcatctacagtcacttctagagaggctagatcagatttctataaatttcacagggcagcaatcagttattttacctctttgactcttgtattttcagacctgaaacggattcagagaccatggggcccacaaacccaattagagtaacgtgtgcattgagtagacatgtagataagagattctccactttcttctttctactctgctaaaatgctcacaaatgtgctataaacatgctgccactccatccattcttgccctaaatctgcagctccatattttgaatccaggtcttgagatttgggaaataaaaaactttatctgaaaagtgcaagtactttttctccctttgaactatgtattcaaatgtatgtatctgttgaaactgttcacaattgccacaagtagttataaattaaactaatgccacattggacactatatcccataccctaaaccataacaatatatatctaatcaataatcaatgttatttctgtaaacaaatataaatttctgataaacaactttgtgtcagcccactctgtgtttctcttattgtctttacaaatcttcttgtaactgctgctaatcaaagtgtagatttcaggcaacttgaatatttgctcccaggttataatccataaacttgacccaaataagctgtctacttatattcacgttgtgtcagctttttgtttttttcatgtagacttatcatttagaatgtgctagaacagcctctattaggggatctcttcaccaaaggatgcaaagccaggtggatcctacctagaatctgtagataaggtctgtcctctgccaggaatttacaaaaaagggtgggagtttggataaagaatgtacagaaaactaacaaaaggcattttctgtattgtgagatgtcagcaaagacagcttacagcccccatttgggagtgtggcattttgagattttcacatcttgttcattgacctgctacagtgatgtgagaggctccaggaggaactagcatctgatggcagaatctgtaaatgtaaataagcatcttaggagtgagagatcaaggccacaaaatatccagagccatgaccacaactatatttacctgtaaaatgtgatactggagtagagtatttttgttctttctcttatccaagagctagcaaatcaggacaggagatccaggttctggagctccaccaaggcagttccattttctattcagaatcagcctcagttcctccagcctggcttatcattgggccatgagcccagggtcactgagaattctgtcacaatcatctagatgtctttgaggcattggaggatgtcagagcagaattgtgtcaggctgacaagaatggttttttcttctgtctcagtgtaagagaaacgagtcatcctgtgtttgttcctcctgtcatacaagaggtgtctttggtacccagatgagagtttctccagtttcctggtacttggatgataaacacggagatctggagacccaaatagataagctagttgcttccatttcatatggccattaaaaaaaatacatgaagcagtcatggttccaacaatccagaaacttttagtctagactagcaactggataaataattgaattatgcaacatatggttggtacaacaaatacacgtgtccaaaatactgggctttatttaggccactttctttatgttgttgtgacttctgatgtctacacccgaagggctatttatgaacagaagaaatattattatgctttttttttttgagatggtgtctcactgtgtcacccagactggaattcagtggcatgatttcagctcactgaaacctctgccaccagggttcaagcgattctcttccttcagcatcctgagtagctgggattacagatgcctgccactgcacacgtttgagcagaccaattatgaggcaattctcctaactctgcttccagaagagtctccctatcaattactgaatacccattgtggttttttccctcaatcacatgggaggaacggtctatcatcctgtcctgaagggagttcctcctaggtcagctcagacttttgtatggtaatgaagatttaaatcccctgttaggaaacctgctggacactggtgtggccttcttagccttactcttttgtcttggacaactgtcctccagatctgtcactatctgaggcgtcccacgacaggcagtcactagatacttctcccagccactaagttgtgactggagaactttgctgtcttcacatgcttttctaattatgcctgaaagcccaaatcctttgttagggagagacatcctagcaaaagcaggggccattgtacactagaattaggagaaggaaaaagggtaaatatatatacagactctaagtatgcttacttagtcctccatgcccatgcagcaatatagagagaaggggaattcctaacttccaagggaacacctatcaaacatcaggaagccattaggagagtattattggctgtacagaaacctaaagaggtggcagtcttatactgctggggtcatcagaaaggaaatgaaaaggaaatagaagtgaaccgccaagcggatactgaagccaaaagagctgcaaggtgggaccctctattagaaatgattatagaaagacccctagtatggggtaatcccctccaggaaaccaagccccagtactcagcagaagagatagaatggggaacctcaggaggacatagtttcctcccctcaggatggctagccaccaaagaaggaaaaatacttttgcctgcagctaaccaatggaaattacttaaaacccttcaccaaaccttttacttaggcattgatagcacccatcagatagccaaatcattatttactggaccaagccttttcaaaactatcaagcagatagtcagggcctgtaaagtgtgccaaaaaaataatcccctgcactgcaggccatacatttcaatccctgtatcattaacctccttgttaagtttgtctcttccagaagcaaagctgtaaaactaaaaatgttcttcaactggagcctcaggtgcagtccatgactaagatctaccatggacccctggactggcctgctagcccatgctccaatgttgatgacattgaaggcacccctccccaggaaatctcaactgcatgacccctactacaccgcaattcagcaggaagaagttaagagcagtcattggccaacctccccaacagcatttgggttttcctcttgagagggggatgactgagagacaggactaactggatttcctatgcctgctaagaattcctaagcctagctggggaaggtgactgcacctgcctttaaacatgggacttgtaactcagctcacatctgacaaatcaggtagtaaagagagctcacgaaaataccaattagactaaaaacaagaggtaaagaaataatcaaatcatgtatcacctgagagcagagggggagggacagtgattgggatataaaccccaggcatttgagtcgggagtgcacaaccccctttggatcccctcccattgtatgggagttctgttttcactctattaaatcttgcaactgcacactcttctggtctgtttgttacggctccagctgagctttcacttgccgtcgaccactgctgtttgccgccatcccagacccactgaagacttccacccctccccctccggatccagcagggtgtccgctgtgctcctttgccactcccgattaggctaaaggctcgccattgttcctgcatggctaagtgctcgggttcatcctaactgcactgaacactagtcgctgggttccacggttctcttccatgacccacggcttctaatagaattataagactcaccgcatggcccaaggttccattccttggaatccatgaggccaagaaccccaggtcagagaacaaagggcttgcagccattttgtgagcagctgccaccatcttgggagtggcctgccaccatcttgggagctctaagaacaaagacccaccccttaactaaattgctggtgtctgtgctagaaaagggcacttgaggatgggaaaggagaaacttttatttttatcttcatggagcagcttattgtttttgaatctctaattgtttttgaatctcttctattttaaaggacataaatgggtggactttttctgtctttgtttttctgccatttgttgtcatgctaggaggtagacatgtggcactgacacctttaaaggcatattctccagatgcaggtgtaatttctccagagaatgtcatttgataaggaattccagagaaggaggagaaagaaaaaaaaatggcttttcttcaggtaaacatgtctcagatgcagagctgtgtccactttgcctcctggactgccatgcatttagcactcagaaaactttacatctgtacatgtgtttatcctccctaatgagtttggttgaactacttaaaattcttatggtagtcaagggtctctgaaaaatatttctttcctatattccagagccttctctacattctccatgtcatagcttcttatatgccatgcagaattcttagcaagaatttatgatcctcaatgtgggatacagtaaatttgtcctcaaaggtttcagcttgttaacttcctttaaaattgaagaggggaaattaagtacaatgagttctgaggttctcttcaaagaaccaaaatgtcagtatgttcatctttcctgttctttgttctctattttaaagttcaacttcctcgatcttaatgtctccttgctcctagtttcagtaaacaatcccttctaactcatgtatttagggtcgttagtcatccctagtcacctgctctgtcctgagtcactcctactcacctgacttatacccatccttcctgctgactattcatcccaccactctggctcttaccattgctctctttaaaatagccaatcagaattagcttagactgtggtccaaccctagccaatagcagaaagacacagcaatagggactagtggtgttagcgataaggcccccttcccctcccttgcccaagtgtactcttgccattgctccatctgtgagacacacccttctatagaagtatatttgccttgctgagatgttctctttttgagtgctcattttccctgagactctgagcaattgtttccaacatgcaatcttaaaaatgtttcctttgtagctgttgaacatgaaaagatatggatactcaagatttctactggggaaaactgtggtccttagttaagatggagaatatgtcatgttgaggctccatctgtgttccattagctctatgcagaacaggattaagaaaatgcttatttaaatggaatggcatttattacccagaaagttctgaaaaaagtattaggagatagctgctctctagggtgctaaatgacgcctacttaaaattcctactaaaaattacagaacataggagttatctgtactttgaagtttgtataaaacatgttcctttatggttaaattcatattttacttactttttttgggaggaatatgttggggtggccagaccaaacaccaggtcgtgggggtgacaaagtctgatggactcaatcctttgagtcctttgagaaaaagacagtttgagagagaaaggtgggacaccagggggccattgcgatcctcgaggctgtgaaggcccagagctctgggagcccacgctgtttattggtaatccaacagagaaacaggtggtgagaatgtggaggtcgaaaggacaggcacatgatctacagctgtgaaggtttagcatttataaggaacctgttctgctacttgagataatgggaataggagcctaggagggctagaagcaaggaaccagcaagtctagacacattccagaggacattatgtcagtcatgcaagccctgcctcagctttcttcccaaccctcaacttttttctcaacaggaatatttcaacagtgatgctgtattcttctgtgcgcattagcacatcataaaatttgtcctagtgcacttaatggtgaatgattcacttggtgaaatagctctgtaacagatttctttcactatagagttaattattttaagtatctttgtgcagctgatatgtataaaccagcacatttaatctggcagctgtccttttttcttattttttctacatatttttgtttggaaaatgaaggctctttgtttacaggccagaaaaactgggaaaaacaaaggttcttccacttggtggatgtttgacaaaatatccttcttgggccaaaaacattgacattattcgtgagcttgttagaaattcaaaaaatcagactttatttcagatcttctggaaaaaaaaaaagaacctgcataacaaggtcttcagcttattgtacatattaaaatttgagaggtgccttctaagtcaccgtgtcttttctgtctgaaaaatattcacaactcattccgtatgatctaaatatagcactcaaaaatgtacatgttcatgttcatgcccttaattttataatttattatctagaaaaatatcatatatgaactgatgttgtggatcctattctgctcttttttctcaggcaatatattagaaaatatttttgtgttggaaattgttttattggataatttagtgagtcttgtaagtcagaaccaattctctttactctccaatttcaccttaactcaaattacaaactttgcccatgaccacttggtaaaaatgtgtgtgtgtatatgtgtgtttttcagggaccattggaatttagagatgtggccatagaattctctctggaggagtggcattgcctggacactgcacagcagaatttatatagggatgtgatgttagagaactacagacacctggtcttccttggtgaggataagtggaatacataattcataatataccctaaaggttgtttttatgtttttttgtggaatgatttttagtaatgtattgtttgcataagagagttttagatcccccttttcctgaaaatcttcagaatttcttttagaagtgaatttcttcaagatgtttcatcttaatttaaactttccactttcctgagatgagctgtattcttcactctaaattagtggtaattccagaaatttagtggcataaaatattgttacctccacctgaaaatctaattgccaccaccaacttttgattcagtagcaccaggtaataaaatttaaaaacctacaaattaggacaaggcgcagtggctcacacctgtaatcccagcactttgggaggctgaggtgggcaggtcgcctgaggtcagcagtttgagactagcctaaccaacataaagaaactctgtctctactaaaaacatgaaattagcttggcatggtggcacatgcctgtaatcccagctactctgaaggctgaggcaggagaatttgttgaacctgaaaggcagatatttcactgagctgagattgcaccattgcacaccagcctgggtaacaagagaaactccgtctgaaaaaacaaaaaacaaacaaaaaacaaaacaaaacaaaacaaaaaaccacacacacacaaaagaaacctatgatttgaaagtattttctaaatcttttgaaattttttttataactctattttggaatttactagactattttatcacatcttctctgctgagcacagtactagcttgtaattggagaatatgaggaagattcatgttatttatttttaataaaacaggtattgttgtcactaagccagacctgatcacctgtctggagcaaggaaaaaaacccttcactgtgaagagacatgagatgattgccaaatccccaggtaggtgcgagtgaaaatgaatacaacagacaacacagataagaggtcccaaggtcaaagagaaagccggtccttaaaatgtgatttaggaagctgtgttccaaagagaatagttcctgggattctgttttttgttttgtttttaatttggctctcacaaagggacatcttctgtcttatgcttttaaattttctaaggattctacttttctttcggtgagcttccttcaacttcacagtgagagccagagtcctcttcatggcatataagagactgcacaatctggctgcttttacatcgtcttggggacacagaaatatctgcatgactttgagaaactaaactgtttttagtctttttgcatcaggcctgaaatgtgtgagggcagtagtatcagtttcatttctttgttcatttttctgcatggtccattctgtttttattactatatagtcttaaaatatcatttgaaagtataagtatgatatacttctgctctgttctttttgtcaagattgctttggctattcaaagtttattttagtttcatgtaaattttagaattgtattttccatttctgtgaaaaagataccactgcaattttgctaggaagtttattgaatctatagatcactttggataatatggcacttgaataatatttattctttcaatctatagacataaaatattttaaaatttatttggaacttctctaattttttctttttttttttttttttttttttggtaaagagtttttacctccatggttaattttttttctcagaaatttattcaatgctatagtaaataagattttttctttttattttatgagagtttaagtatataaagctgtacatatacttgtatgttaattttatgttttgctaatttactgagtatttattatttgagacagtttttactctgtttatgatttttaaaatataagattgtatgatctagaaacagcaactttttacttatttttcttcaatttcaatggattttttatttatttcactaattcttctgccacatatttccagtgctacattaaaatagaagcattgacaatgagcacaatatagttttgcattgctgtctgaatttgatgaagcaaatacctcttcaggttttctttttttgagacggagtcttgctctgtcacccaggctggagtgcagtggcgcgatttcgctcattgcaagctccgcctcccaggttcacgccattctcctgcctcagcttcccgagtagctgggactacaggcacccgccaccacgcccagctaattttttgtatttttagtagacacggggtttcaccgtgttagcctggatggtctcgatcttctgacctcgtgatccacccgccttggcctcccaaagtgctaggattacaggcgtgagccactgcgcccggcccaggttttcataaattggttttagaaggtaaagatcttttgttgggcccttagtgtgatgagatgccctctgaattgatagtgaagaggggttgtagcttggtcacaaggctgctgggtctgcactagggtccacctttagttggcttgttacaggggcttgggttgttgtaattctcattttatttttggacaggctgaatatccttcaggactttgctctgtagggcagacactagggcatgtttttgcagtcgggtctgcatatggtgggccttgtatcaggatgtggatgagtatggctctgactgagtaccagacagcatttcctcaggtaactgtgtgggtttctatgtgggcagaattggccatgatctgtggctcaggtaactgacactgagtcattgaaccgcttcagggaccccagtaaaggccaatgtcttcatgcctgcctgtatagctataattgggtgcctttctccaggtctctggagtggcagaacctcagccagactgtggctgggaggagtttgggatggttacagagtaagttctgaattctcagcgggaccaagttgggtaaataaacccgatcctggtctgtagccaagaacagcggccctttagtttcccacctaaatgagggcctgccttctgactagaaggcttctcaatctttagctttaacagcatttcacaactccctccctggatctcaaatctctcttagaggcccttattttggaatggcatcttgctgcataatgcatgcaggtctcaaaatcctggcctgaagcagttctgtaaccttaatgttccatgtagctgtcattacaggtgtgaaccataatacctttttctctcataaaggcatttttgtcagggatggctgacttttttttgctgtaaggggatatgaaaataggacaatttaactctttccttcttactgatgtcactctccatatacatttttactttctattttctatttcaaatttgtctgcaattttagtttcagatatttaggacaatatgccagaatttgatggtatacttgaagtgaattacataattattgggcacccaatatttaactaaatatgataaataactaaaatagttacttataaatcgaagctttgctgcaggcaaaaaggaattataggattttcatctacttttttcagcctatatctaaataatatagattatttcctaatatttgttttacatatcagagggtctaaccctattctggaaaaaaaatatatattttttctatatttaacaatgtaagtctactcttttcttctaaagttggattacagcagttgcgttttgtgtaagaataccatatatttaaaacatttgttttttaacaaatctagttttaaatgctaatttattaaaagtttctcattagaatcttctatttataattatgctgcatattctctgaaattttactgccacagagtgcatgccaatgattcaaaatacctgtatatgatgaatacatagtgatggttaaatattgcagttacttagacaaattgttaaaaaaaattttttggagaagtagttactctctctcacccaggttggagtgcagtggtgcaatcctggctcactgcaaccttcacctcctgggttcaagcaattcttgtgcctcagcctcccaaatagctgttattacaggcacttgccaccactcccggctaatttttgtatttttagtagagatgaggatggggtttcaccacgttggccaggctggtcttaaaactccttacctcatgtgatccactggccttggcctcccaaagttgctgagattacaggcatgagccaccgtgcctggcctgactactttttttaaatgatacattaatgtagcataccagattttatgagtaaacattcttttattattgtttgtagttctatattagtgtgtttcttcagtgtaggtttctcttttttttttttttttttgagatggagtctcattctgtcatccaggttaaagtgcagtggcacaatctcagcacaatctctgccttctgagttcatgccattcttctgcatcagcttcccgagtagctgggactacaggcgtgccaccacaactggctaatttttgtattgttattagcaacggtgtttcaccatattggccaggctggtctcgagctcctgacctcgtgatctgcccacctcagcctcccaaagtgctgggattacagtcttgagccaccgtgcccggcttcagtgtaggtttcttaacatcagtttattgtgtctattggttttacttatgtagtaagtagagaatttgcaattctttttgtatgctttaagtcaatttgaggtttagctaagagataaattatgcatctctatcacagtcagattacatatgtatgtgtgtttatctataaatatttagacaatttgcaattctgtttgtacactttaagtccatttgaggtttaagagataaattgtgcatgtctatcacaatcagattacataagtatgtgtgtttgtctgtaaatatgaccccaattttagatattttttcttagctgaatttcaatgggagttttatcttgtctaagtgagtagtcatggagatagtcttactttcaccatgtgtttaataattaatatatatttttccttttgtgagagaaacacttttgtgatctgaaggtaattttcagaaagatgtataattctggattttttttcaatttttctttaaaagcattgttttaaaaacacataacataaaatttaccatcttaaatttattaaagtgtacatcacagggtcaggcatggttgtggctctcgtctgtaatcccaggacttcgggaggccaagacaggaggattcctgtagcccaaaggtttgagaccagcctgggcaacatatggagacccatttctgtaaaaaaaaaaaaattaataatagccaggcatggtggtgtgcagctgtggtcccagctacatgggagattgaaggggagtcaaaattgtgcctctacactccagcttgggtgacagagtgagactctgtctccaaaaaaaaaagctgtttatttcaggcatgttgttatgcaaaagacttctagaaactttacatcttgcaaaactaaaacttagtacccattaagaaacaactgctcattttaccctctctccagcccttgacagacaaaccttccactttctgattttatgattttgactacttatttcatataagtgaaatcatacagtatccataattttgttactgtattaattcaagtgacacaatattctcaatgttcatcttaaaatgtgacaagattgttctttttaaggtggaataatattccattgtatgtatatgttactttttttgatgtttataaatcgggagacatctggattgctttgggcttttggcttttgtgaatacatatacaataaacatggattttcaaatatgttttccaggtcctgtgttgttttgctttgttttattttttttgagatggagtcttgctctgttgcccaggctggagtgcagtggtgtgatcttggctcactgcaacccctgcctcctgggttcaagcaattctcctgcttcagcctccctagtaactgggattacaggcacccactaccatgcctagctgattttttgtatttttggtagagacggggccaggctggtctcagactcctgacgtcaggtgatctgccccctcagcctcccaagttgctagatttacaggcttgaaccactgcacctggactttgttacatattttggatatagatttctaaatgaggaacatttataactttttaaaataatggctgtatctttgttttccaccaacgtttaacatgggtttcatttttattgcatcatcaagagattcgatgttttctaaaaaatttatagtggccattctaatgggtgtgaggtgattttgtttgtcattgtgggtttttctttttcagttctctataaatagttttttgtgccctttcaaatgctttttctcatttgtgtacttttctaatgaaaacttgtttatctatttctaaattaagttattcacctttattgtttagttttaagggttgtttatatattttgaatattaacttctttcacatgtaatttgcaaatgttttcacccattttctaaaggacgttgttactcttgaattgttttttaatatgcagaaattttgatgtctagtgtagttaaacttttctgttatttcatttattgctcatgcatttaatttcttatctaagaaaatggtgccatgaccaatgtgatgtctttttcctatatttttttgaaaggatttgttagttattttatttctcagtattttatttaaatactgagatctctgtgcctcagcctcccaaagtgctgggattacaggcatgagccactgtgcctggcctcctttatttttgagatagggtctcactctgtcaaccaggctaacttgcaaggctcagtgctacccaaacctcccaaattcaggtgatgatctcatttcagcctttcaagtagctgggttacaagtaggtgccatcaaaccctgctagcttttctgtattttttgtagagacagagttttgccatgttgcccaggctggccttgaactcctgggatcaagtgatcagcctatcttagccttccacagtactaagattacattttattttattaagtagtttaattaattcatacttaaaatgattgcttaaagaaaaattaccagttatataattattgtgttatgtgtttctaatagttatgttctcatttcctattttattttcttaattttcatttaattttgtactggtatgctttattttttatttgcttttgtatactttctataaattttatctttgtaatcatcttgaaatgtggagattacatacatcttaaagttaaaactatattttaatcttataagaacttcaattgaatacaaaaactatgcctctatattttcagcttataattgatattaaaattattttatatgctgtatttattaacagatttatgcagatttttttttttgggatggagtctcactctattgcccaggctggagtacagtggcatgatctcagctcactgcaacatctgcctcccaggttcaagtgattctccttcctcagcctcctgtgtagctgggattacaggcatgcaccaccatgcccgcctaatttttgtatttttagtagagagagcgtttcacaatgttggccaggctggtcgcaagcttctgaccttgtgattcacccgcctcatcctcccaaagtgctgggattacaggcatgagccgatgtgcccagtcgatttattcagattcacatattgttttttatattctataaaaaagaactttaaaggtttcatgtataataattttgattttttttttttttttgagactgagtcttactcttgcccaggatgaagagcagtgaagggcagtgggcactattgcacctggcctttttattattattatttttttgagatggagtctttctctggcacccaggctggagtggcatggcatgattttggcaaactgcagcctctgcctcctgggttcaagcaattctcttgcctcagcgtcctgactagctgggactacaggtgtgtgccaccacacctgggtaatttttgcatttttagtagagacggggtttcaccatgttgtttaggctggtctcagactcttgatctcaggcaatccacccacctcggcctcccaaagtgttgggattacaggcatgagccagcatgcacaacctcttgtagtacatcttgtaggactgcgcaaatgctgatgaaccctcttaacttttattttggaaagtctttatcttctttttgaagtaaaataatttaaaatcgagtattgctggttagaaatgtttttttgttacatcaaaatttgggaagttctcaacttttttgttttttttaatcttcaagtacttctgtatttctttttccctatattctaagatttcttttatgaatacattgatctacttgacggtatccaataagttttgtgttccatgttttactgctttttttgcaatttaatatttttgtgttatatatttttgggtatgtcacatcacagcaattaattgtggtttgatttttttgtttataattgtatatgacaatatttaactctgtaccacttaagacagtgtggagcaaaattaaatatgaataagccatatgtctattaccaatataattatttctgtttcttttcctgtataaatattatccctgtagttttgtgtcacttgtgtgtttgttgtgtaggtttgttgtaacggttttttatttttttttcttttttttttctcctttgagagggagtttcactcatgttacccaggctggagtacaatggcaggatctcagctcactatacaacctctgcctcctgggttcaagcccttctcctgcctcagccttccaagtagctgggattacattcgtgcactacaacgcccgcctaatttcattcatactttagtagagacagggtttcactatgttggtcaggctggtcttgaactcctgacctcaggtgatctgcccaccttggcctcccaaagtgctgggatacaggcgtaagccaccgcacgcagcttgtaacagtgtttttaatcctgtctaggtgagtagtcataaaaactctcctaatcttgccgtgtgcggtggctcacgattgtaatcccagcactttgggaggccaagacgggcggatcatgaggtcaggaaattgagaccatcctggctaacacggtgaaacccgtctgtactaaaaatacaaaaaattcgccgggcgtgttggcgggcgcttatagtcccagctactagggaggctgaggcaggagaatggagtgaacccgggaggcagagcttgcagtgagcggagatcgcgccactgcactccagcctgagggacagagtgagacctggtctcaaaaacactcctaatttcaacatcaatttccttgtgaatctatcttatttttgtgtgtcagaaacacttttggatttgaagataatttcaaaacaatactaactctgtatttttttaaggtattattgtttacttatgtgttatgtgtcaaaaaataataaaatttataataaaatatttctaggccgggcggggtggcttacgcctgtaatcgcatcactttcagaggctgaggcgggcagatcacaaggtcagaagatcgtgaccatcctggccaccatggggaaacatggtctctactataatacaaaaaattagccaagtgtgttggcatgcacctgtaatgccagctactgaggaggctgagacaggggaattggttaaacccgggaagtggaggttgcagtgaaccgatattgtgccactgcagtttagcctgggagacagaatgagaagtatatatttctaaatattcagtttgttcatattaattatattgacattgttatgcaacatatcactagaatgtttttatcttgcaaagctaaatctctatacacattaaacaactaccaattcttcccatttcgtggcactcttcaaacaccacattgttttctgtttcaaagagcataactgatttatatatcttatacaatatctgtctgtttgtggctggctcattttgcataatgtcatcaatatttatcttaataattgttagaatatgtgttgtatcatttctatatatttgtacatttattaattatttgtattattattttatactctaattccgtttttgtcatagaaagtaatctattttcagctttaaaaaatgtgttatgactttgtttttggcctaacaggtggtccataaagaagaaagttgtatgagctattgagaaggctgtgtatcctgatgttgttgaggagtgttctctataccttcattagaaataattgttttttactgccttctagtcccctgttcccttactaatattctgtcttgttttattattataacagaaaatgcattactgaaatagcctattataattatatttctctctatgtgtttattccgttttcttactatttgctttatatatttgaaaccctaatttgagacacacacgcacacaaatacacacatggataaacaaatttgtcataggtccccagcgaatgaatctacatattgtttaacatctttttgaagttttgacttaaattacattttataaaatatgacagtttttgacttaagatgtagcttgtgtaatactattgtgacctcttctgctctcatttggttaatatttacatgacatttctacttccatcttgccactttcagtctttttttgttattagatctcaactgactcttgtagaaaggcaagttaaatcttgatttcacaaaatttttaataaacttttttattgaaagaatgtctcttgattggaaagataattatacatataaaattttaaatagttttctgaaagagaaaagcttactaatgttattttattttttgttttatttgattcttgtatctttgtctctcattttcctttctgttttttttttttgtattaatatgctttcaggtttttaaaaattttcttttgtgtatctttacagatattttcttagtggtaccatgggggattctataaaaactctaaaagatccaacaatatatttgaatgtggtaaaaaaataacttaagttatatgcaaaaattcttcatcattacatctgctgctccgaaaatgctcttatatgtgaattttgaaattttacttatatatgtgtttgttataagtatctttatgtgtatcctagtttgtttgttcagcttttttatgtttacatcatttttcttttgataaatttttcagttactttttgtaatttttatatccaaaatttttattttttgctattttaatatttcttgttatcctcattttcctgatcttcagtagttgtctgtgtttccatttcacttactgtatattattatgttttatttatttctgtatttattttatctgagatggagtcattttctgtcaagctggaagcagtggtgcaatctcggctgactgcaacctctgcctcctaggttcaagcgattctcctgcttcagtctcctgagtagctgggtacaggtgctttccactatgactggctaagtttttgtatttttagtacagacagggtttcaccatgttggctatgctgaccttgaactcctgacctcaaatgattcacacacctcaggctcctaaattgctggtattacaggcgtgaaccactgtgcccagcatattttattttatttttgagacagtcttgctctgttgcccaggctgcagtgcagtggtacaatctccactcactgcaaccatcccctcccaggttcaagcaattcttgtgtgtcagcctcccaagcagcttggattacaggcttatgccaccatgcccagttaatttttgagtttttagtagatacagggtttcaccatgttctctaggctggtctcatactcctgacctcatgtgattttcccaccttaacctctctgtgttgaaattacaggaatgaccaccaaccctggcctgttcaatttatttggaattttaaaaattactttatatgctttttatagttgcttttgaaatgtttttcattgggccatgtttctctaatattttgtgtacattgcaatctttgattgagatttggacattgacaaaaagctacctgttacaatctttttataatatagctttgtcctggcatagtctgaaatcaatagtcttggctagagattctgggaatttctcaaacatgttcttaggatgtgtcttgtctaaattttgtgtttattgtttagttaaatggcttattttttttaataatcagtaatcacttgctgcagccattccctgtttggggtactgcagtttctctgcttctctaacatttatctttagactcagtagactcaaactgtcattccaatgtatatcaccacttctttaagcgttttatgtcatgggagacattaaccagtgtctaagaagcacatagaagccagaaataaagatgtatgtgccaatgtttttctttaaaaaaaaaaaaaaaagaattggcaacttacatttgtgtgtgtgtgtgtgtgtgtgtgtgtgtgtgtgagagagagagagagagacagaatgtcattctgttccctatgctgaagtgcactggcatgatcttggcccaccacattctctacctccacagttcaagcaattctcctgcctaagcctcccaagtagctaggattacaggtacctgttaccatgcctggctaatattttgtatttttagtacagatggggtttcatgatgttggtcaggctggtctcaacctcctgacttcaggtgatccacctgccttggtctcccaaagtgctgggattaaaggcatgagcctgggtggaaatttctttttctttgtttcgtttcttttcttttttttcctttcttttcttttcttttctccttccttccttccttccttcctttcttccttccctccttccctccctccctccctccttccttcttctggctctgctgcccagggtggagtgcagtggtgtgatcttgggtcaccgcaatctccgcctcccaggctcaagcaattctctgcctcagcttcccaagtagctgggatttgcccaccaccatgcctggttaattttgtttgtaaatgtaacctgtatttatcagaatctagcaattgaagtaatgtgttcttattgtttctttcagttatgtgttttcattttgcccaagatgaggttaattttgtttgtaaatgtaacctgtatttatcagaatctagcaattgaagtaatgtgttcttattgtttctttcagttatgtgttttcattttgcccaagacctttgtccagagcagagcctaaaagattccttccaaaaagtgatagtgacaagatatgaaaaacgtgaatatggcaatttagagttaaaaaaaggttgtgaaagtgtggatgagggtaaagtacacaaaagaggttataatggacttaaccaatgtttgacagctacccagagcaaagtatttcaatgtgatacatatgtgaaagtctctcatatattttcaaattcaaacagacataagataagagatactggaaaaaaacctttcaaatgtatagaatgtggcaaagctttcaaccagtcctcaacccttgctacacataagaaaattcatactggagagataacctgcaaatgtgaagaatgtggcaaagccttcaacaggtcctcacaccttacttcacataagagaattcatactggagagaaacggtacaaatgtgaagattgtggcaaagaattaaagtattcctctacccttactgcacataagagaattcatactggagagaaacggtacaaatgtgaagattgtggcaaagaattaaagtattcctctacccttactgcacataagagaattcatactggagagaaaccctacaagtgtgataaatgtggcagagcatttatttcatcctcgatcctttatgtacataagataagtcatactgaagagaaaccctacaaatgtgaagaatgtggcaaagccttcaagctctcctcaatccttagtacacataagagaatccatactggagagaaaccctacaaatgtgaagaatgtggcaaagccttcaggcgctccttagtccttcgtacacataagagaattcatactggagagaaaccctacaagtgtgataaatgtggcaaagcatttatttcatcctcactcctttataaacataagataagtcatagtgaaaagaaaccctacaaatgtgaagaatgtggcaaagccttcaagcgctcctcaacacttactatacataagataagtcatactgaagagaaaccctacaaatgtcaagaatgtgacaaagtcttcaaacgctcctcagcccttagcacacataagataattcatagtggagagaaaccctacaaatgtgaagaatgtggcaaagccttcaagcgctcctcaaaccttactacacataagataagtcatactgaagagaaactctacaaatgtcaagaatgtgacaaagccttcaagtactcctcagcccttagcacacataagataattcacagtggagagaatccctacaaatgtgaagaatgtggcaaagccttcaagcgctcctcagtccttagtaaacataagataattcatactggagcgaaaccctacaaatgtgaagaatgtggcaaagcctttaagcgctcctcacagcttactagtcataagataagtcatactggagagaaaccctacaaatgtgaagaatgtggcaaagcttttaacttgtcctcagaccttaatacacataagaggattcatattggacagaaagcctacatagtgaagaacatggcaaatctttgaaatattcctcaacccttaataaacataagataattcatactggagagaaaccgtataaatgtgatgactgttggaaagcctttgaccacccctctactcttactaaatatgagaatttatatgaaacataactcctacaaaaataaagaatgtgacaaatcattttaaggaagttctcaacccttactacacataattcatactggacggaaactctacaggtgtgaaaaatgcagcaaagcctataacaagttctcaattctttttttttttttttaagaaggagtttcatgcttctcacccagcctggagtgcaatggcacgatctctgctcactgcaacctcttcctcctggttcaagccattaacctgcttcagcctccaccaccatgcccaactaatttttgtatttttggtagagacagggttttgccatatttaacaggctggtctccaactgtgattcacacaccttggcctcctaaaatgctgggattacagtcatgagcatccatgcccagccacaagttctcagttcttaagagacatggtgataattcatgctgaagaggaactttacaaacttgaaagatgtgacagtgcttttaccaccacctccaacttttctgtacataaagatgattatactagtgtgaaaccctagaaataatagaaaatttgacaaatcctttatatggttgcaagacttgattgtaggtaagataattcatactggcaaaactcctacaagtgtgaagaatgtgggaaaactttttaatcagtgcatacaccttatttcacaggaaagctagtatccttgagaaaaattgcacaattataaaaaatatggaaaacccattaatgcctactcacatcttacccaacagaaggtggttcacagttaatgaaagcatttaaagtgcaattatgctcaagaaatctttcagaaaatagaagcctttaaagtgaagaagagtattctgaagacaaccattacacatataaagggggttgtattacctttacttgcatcacagatttcattgcacacattttgtactagaggaaaaccctgaagcagttgctccagctttgttcaacaacagggaatttatgttagagaagaatcctgcaaatgtagtgaatttggaaacaaattttttttcaaaaactacagcttagaaaacaccagagagttgatactaaaatatatgtttgcagaaacagtaaatataaaaaatatttaattcaaaatgaattccatgtaaatatcagagaatttacagtagaataaggcactgatacttcagacattacactaaaacagtgttgagtataaaaaagaatccacaacaaaaattgttagataaattatatatagctttaaaaggttttttgaagcattgtaattacattgaaagtatacttgctttcttgagaaaaaatttttgaaaagtgaataaggtaatagagctttcaaatttatgctgttactttatttctattcacatgtgaaagcatgtgatcaattgatgctgcatcagagatattacagattctttattgggcattccttataaccttttctattaaagagaaaggatattaaaatgtaagatgcatgatgaaaatataagtggacaggctgttcgtatttgacctatattaagtaatgtataaggtagtgttcagagtaatacttttctacattatagtgagagaaattatgaattacagttaaaggtatattaaattactgtattattttactaattttatgtaataaaatacactacattaaaaaattgttagattgtgtgtgaagttaattttgttgtatccatttatttttttttttgagatggagtccactttctcatccaggctggagtgcagcagcgcaatctctgtgtgatcattgcaaccttcacctcccaagttcaagcgattctcctgcctcagtctcccaagtagcaaggactacaggtgtgtgccaccatgcccggctaattgtttcaccatatcagtcgggctagtttcgacctcttgagctcaagtgatccacctgccccggcttcccaaagtgctgagattggcctagttttattttattttttaccatattaagactattttgcatttaatgaagccatattatgccactaactttaacctatcccaccttactcaagggtatagttacaagatggtagcagtatactatttggtatatagtagaataacatcattagtaatcactttgccagtggctttaaattaattgagttgaagaatatttttcccataggttaaatttttattcttacagaaatttattcttagtatttgtgggtatatagtatgtgtttacgtttatgctttatatggcatactgtgattcaggactacaatatgtagtaattacattagggtaaataaggtatccatcacgtctagcatttatcctttgtattacagtgtaattatacacttttagttatttgaaaatgtacaattaaattttaattgactacagggttatttttatggtcgtaataaaaattatacagaaatataaaaagaatatggccagatgaagtggctcatgcctgtaatcccaaccatttgggaggctgaggcagctggattgcctgacgtcaagatttcaagaccagcctggccaacatggggaacccctgtctctaaaaatataaaaattagccaggcataggagcacctgcgtggaggctgaagcaggagaatagcttgaacaagggaggtggagtttacagtgatccgagattgcaccactgcattccagcctaggcaacatttctgagtcctgaaaaattattaataaatatttgttacatagttttctataaacttgtggtttctctgcctgcaaacacaagagttttagttttaattttcatagagtgaaatatccacatattactctgaaggtaaaccttaggtgtaagaaaaatataaagtgagtaagtgtatttgtgagtttgctttggtacatattttcagaagaaaagcacaattattgaaacaaaacaacttattttaatttggtgaataacagaaaacaccttcaaaatgttgaaagcaaatctacactttctgctttgtattgaatttattaatgtaaaattttatagcttatgtttcaaattctttccagaatctgcctattgaagcacaggcaattttgtctccataaataacactcttgagtacaacaataaaagccctcttcaaacaaacaaattatttataacacttattttaatgaaaatgtaaccaaaagtatataattgggtatatttttgttgttctatgtgtgtgcgaatgtataaattggtacataaggacaaaataatttaagccagaaaaaaagatgttagctaatatttgtaatgaataaaactggaaagtagttaattattatttgcacataatgtctttgtttacgtagataacaaaacagcagaaagactattttaaaattttattcaagtgggtaggtaacattctaagataatacgctggattcccagtctgttgcacacctgctgtgtaatactttttccttgagtgtaaaaaaatgtgcaactggtgggaaaatcactcaagaaattaggttactcatgtgttgactttgtgtttatcaaaatggagattgtcctgactgtgctaaacttaatcagaggtgcttttaagagaaagacacatcatagaaaaacacccctgcttgcctgaaagtaagtgacttctaggtgggccatgttgcaagctgcttatggtgaccacatggcagaaaacatatttgtacattgttatcattcctgcccttctgcatgttgcttccagtagggagaatctaaggatcctatgacagggaaaaaaaggaaatctcattcatgcaagaaataatcacctctcacctgggatagcttaagagaagcaggagaccacaacagaaccacataaatgggaggaaaatggtaacctgggtaaaagtgctctctggcattatggaacaacatttagtaagctgtagtgaatggtcagcctctgggataccaatagtttaccaacaaggctgaactcattctaattcaatcagcatgtctgcatttacactatccattacagaaataccatgaagaccagtgggtaatgtcctagaattgaacttatttcaaatcatacctaattgtttttcacatttgaaaaaccttaaaaacaatgaattcataaataattaacttctaattatagaggattctactatactgtaatacaagattaaagtgtaaacaccttaagatttcttgaatgcatgattggttatgtagtttattttaaataattaacgtgataaaagtaacaaatagataaaacattggaaacggacaaaattaataaaaaccacatcttttcaatggcttggcgtaattgctatgcttttggaaatggccagattactaacaagaaacaaaaacaagattttggctttgctcagtcattgtttttgaccttctgaaatctaaaatccaggccaaagtgttgaatgggagtattttataggtggcttccttgggtttccaatgcaatgaagggaaaactttgataggcaggaaaatgcacactatatacacacattgctcttctctgatttgctttaacattgaaaaattgaagattgtaaatgtagtctcaattagagtaaattaacaaaagatttgtttttcaaaaagcaaatgtataaaattaatgggtaacagatgccattagctgctaaaaaatagtatgactaaattcagtaagtatctagccatgcaaataacagcccaattaaatgaagaccctcataggtgcatgtggaaagcattgctgtgcagtgtggtgcctccactcagcattttcttctacctcttcacagagaaaccagtttcccctgagtgactaaggatgcatactgggagctgagaatgctgtgttcagagtgattactgaaaacatggttaacacacttcttccatatgataataaaatgatataaatctttctctgcctcggaaaagcttttagtaaaagattattcaatttaggttcatgaaaaatgttaaattccagataatttagacacttaaatgtcaatgaaatcccataaaacatatttgaacagtgtttgacacgagtcgcaccgaaacaaatgctcttcacgatcattgttaaagtagcaatagcgccacgtgctttcctgggaactgctggcctgttttccactcatacaaagtggagaaggctttgaaatagcaaaggagggtgacataaattgaatacttatatgaaatttttaattaaaaatagcatttgatgttatacaactataagtgagactattagtgtgatgtcatattcttaattatattgacaaaataaccattcacagtattcctatttaaaataacatgttttgtcggctgtatatttgctagcttttggttaaatagtaccagagctcaatagcaatcaacaaaatgaatctttattttaccgcaagcattagtgatgcatatgcctgtttttcttaaagttcattagctttttgccttttccggttgcagcgccgcgcggtgaggttctctagtccacgctcgcagccatgccgtccaagggcccgctgcaatcggtgcaagtcttcggacgcaagaagacagccacagctgtggcgcactgcagacgcggcaatggtctcatcaaggtgaacgggcagcccctggagatgactgagccgcgcatgctacaatacgagctgctggagccagttctgcttcttggcaaggagcgatttgctggtgtggacatccgtgtccgtgtgaagggtggtgctcatgtggcccagatttatgctatccgtcagtccacctccaaagccctggtggcctattaccagaaatatgtggatgaggcttccaagaaggagatcaaagacatcctcatccagtatgaccggaccctgctggtagctgatccccgtcgctgcaagtccaaaaagtttggaggtcctggtgcccgtgcttgctaccagaaatcctaccgataagcccatcatgactatcaaaattcacctgtataataaacagtttttgagggattttaaagtttccaggaaaaaaaaagttcattagctttttatgaaggatttatccttttttttcagtgtgctgtttattgctgagaagtggctgccctgccagaaaactgctattctcagctgtaaccacattgactaatagtgagtggaagtgcagtggataaaaagcaaatgtgtcttctctgtatcttttttcatttattggctgaagaacaggaggatgcggaagatggaagaaaatataatctctgaaagataatgaagaagctctcctaaatagaagaaaacctcataggggatttttttttcatcattttactctctgcttctatgcgtttaaattttttttttttttttttgagacagtctcgctctgttgaccaggccagagtgcagcggcatgatcccgactaactgctccctccacctcctgggttcaagcgattctgcctcagccttctgagtagctgggattacaggtgtgtgccaccacgcctgactaatttttgcatttttagttgtggtgcggtttcctcatgttggtgaggctggtctcgagctcctggcctcgtgatttgttcaccttggccttccaaagtgctgggattacgtgcatgagcccctgcacctggtgagtttaatttttttttttttacactttacatagaaataggattatgtggactgggcacggtggtctataatcagcactttcagaggctgaggtgggtggaccacttgaggttaggagtttgaggccagcctggccaacacggcaaaacactgtctctactaaaaatataaaaattagccaggagtggtggtgtgcgcctgtaatcccaggtatgggggaggctgaggcaggaaaatcgcttgaaaccaggaggcagatgttgcagtgagccgagatggtaccactgaaccatcgcgtgcctaggcaaaactccatttcaaaaacaaaacaaaaaaattttgtgtgtgtgttttcctgtgctggcttattttacttagcataatatcgttcaggttcatgaatgttgttgcaaataacaagactcttatttttaaggactgaatagcattgcattgtgtacatacaccacattttctttttccatttacctattgatggacatctaggttgattccataccttaggtattgtgagtaatctgcttctttccttctcttttgttttgtttttgttttgtttcagatggagtctcattctgtcgctcaagctgaagggcagtgccgtgatcttgacccactgcaacctccgcctccaaggttcaagcaattctagtgcctcagcattccaagtagctgagattacaggtgtgcaccaccaaacccggctaatttttgtatttttagtagaggcaggctttcaccatgttgaccaggctgattagtttgtatatttctttcttcctttccttttttatttctagaagcatgttaattttaaaatataaattatgacatgtaaaagccttcatttctctgtctttgattactattatggctgatgaaaaaataagcttttttgaaatttcctggataaaagttattactttatattaacataacttgagacaatgtagaaatgaaaatgaacatttgatagtaaaacagcaattatctagctcctggtagtcatttagtctctcacccgctctttagaacttccaccaagacaagaactctattttttttccaagaatgtgtgatgtaaaatcacactcttatctttttgtttttgtggcagaagttgggtatttaaggttatgaaaaaaaagtataggtctccttttagtagacaggtgatgatggaagcaaatataatagtacatggtatttggccacatttcaaatgggtgatagtgaacattcactgaagtgtcatagatggctcttatttgccaggtcaaatcttctttgcgagaaagtctcagccaactgttgtcaagcatttctggtggttcctagatacatgaacaaaacctcactagactggtttactgagagcagaattaaaaacacccgggtgccaggttattaaaaacatttttacatttttacatttatggaaaaaaaaatgtgatgtggtgtgtggcttggtttgaatacatcttcactgagctaagtagctgattgaatttacctaacctgaaggaaaaaaaaagaaaaaagaaaaaacctacactgaaaaaacacacatggaactgcaagacagtgattaagaaaaatgtttactcataaactctggtacgcaacatcgatgtatcattaaaaaagtttgtcagtttgggcatggtgtctcacgtctgctatctcatcactttgggaggccaatgcaggtgtatcacctcaggtcatgagttcaagaccagcctggccaatgtggtgaaaccccttctctagtaaaaatacaaaaattagctgggcatggtggcacatgactgtaatcctagctacttggcaggctgaggcatgagaattgcttgaacctgggaaatggaggcagcaataagccaagatcacaccactgcactccagcctgggtgacagatcatgtctctgtcaaaaaaaaaaaaaaaaaaaaaaaaatatatatatatatatatatatatatatagtctaggtaactgtaatatgtaactgttacggtgtactcaccaactgcagatcttttgaatcattggcatgcactgtgtggcagtaaaatttcagagaatatgcagtatatttatacatagaagattctaataagaaactttccataaggaagcctttaaaagaaacttgagttactttttatgttttaaatgtatgctattcttacacaaaatgaaactgctgcaatccaactttagaagcaaagaatagtcttacattgttaaatatagaaaatatataactattttaagaatagtgttagaacctctgatatgtaaaacaaatattaggaaaaaactatggtattatttgatataggctgaagtaagtagatgaaaattctataattcctttttgcctgcagcaaatttaaatttataagtaattattttagtaaatatggagtgcctactaattatctaatttatttcaggcataccatgcaaattctagcatattgtcctaactgtataaatctaaaattatagacaaatttgatatagaaaatagaaagtaaaaatgtatagggagagtgacatcagtaagatgaaaagactaaaagtgctcattttcatctccccttacagcaaaacaatgtcagccttccctggcatgcctttattagagaacgagacattatggctcacacctgtaatgacagctacatggtacattaaggttatggaactgcttcaggccaggatatggagaccagcctgggttatgtagcaagacgccatctccaaaataatgtctctaagagttatttgagatccagggttgcagttgtgaaacactgttaaagcttaagattgagaagtgttctattcagaaggcaggtcctcattcatgtgggaaactacaggaccgctcttcctggctacagaccaggatcgggttcacccaacttggtcccagtaagaattcagaacttactctgtaaccatcccaaattcctcccaggtacagtctggcagaggtcttgccattccagacacttgggaggaaggtactcgtttacagccatgtagacaggcctgcagaacttggcctttactgtggtccttgaagcagtttaatgactcagtttcacttacctgagccacagttcatggccagttctgcctacatagaaacctacccaattacctcaggaaatgctctctcatatacagtgaaagccacactcatccacatcctgatacaaggcccaccatatgcagagctgactgaaaaaacatgccctagtgtctgccctatggagcaaagtcctgaaggatatgcagtgtgctcaaaaataaactgggaattacaactacccaagcccctgtaacaagccaactgaaggtggaccctagtgcagacccagcagccttgtgataaagctgcaacccctcttcactacaaattcagagggcatctcatcactctaagggcccaacaaaagaagatctttaccttataaaatcagtatatgaaaccctgaagaggtgtttgctccatcaaattcagacaccaatacaaagctatattgtgcctattgccaatgcttctattttaatgtagcactggaagtatgtggccgaagaactagtcaaagaaataaaaaaatccattgaaattgaagaaaaataattaaggtgctgctgtttgtagatcatacaatcttatatttaaaaaaaaccataaacagtacattaaaacctgtctaaactaataaatacactcagtaagttagcaaaatataaaattaacatacaagtatatgtatggtttcacacacttaaactatctaataaaatagaggaagaaaataatcttatttatttatttattttgagacagtctcagtctctctccaggctggagtgcaatggtgcgatctcggctcactgccccaatgtcagtgaaataaatggttaattgggaatagaggggcttggggaaagcaatactgggaagatatctcaatcctggcacacactaccattattactgttttcctttttttttttttgacacggagtctagctctgccaccagactggagtgcagtggtgcaatctaggctcactgtaacctctgcctcccaggttcaagtgattcccctgcctcatcctcccaagtagttgagactacaggcacatgccaccatgcccagctaattttttgtatttttagtagagacgggatttcactgtgttagccaggatggtctcgatctccagacctcatgatttgcctgcctcagcctcccaaagtgttaggattacaggcatgagccactgcaaaaattttattttctaaagcattaaatcataaatttctgaggaaaaaattaaccaaggagggaaaaaatctttacaataaagaaaaaataaaaaaattagagaagatacaaataaattttaaaatactttgtctatggattgacataatattattaaagtaccacattatccaaagtaatctatagattcaataaacttcctatcaaaattgcagtgattttttttcacagtaatggaaaatacaattctaaaatttacatgaaactaaaataaactttgaattgccaaagcaatcatgaagaaaaagaacagagcaggaggatatcatacttaaaatttcaaactatatttcaagactatatagtaataaaaacagaatgtactgtgcagagaaatgaattaaaaaaatgcaacagaaactactactctcacacatttcagacttgatgcaaaaagtgatctaatgcataattttcttttttttttttttttttttttttgagacggagtctcactctgtcacccaggctggagtgcagtggcataatctctgctcactgcaacatctgcctccagggttcaagtgattctcatgcctcagcctgcctagtagctgggattacaggcacccaccaccatgcctggctgatttttgtatttttagtagaaacaaggtttcaccatattggccaggctagtctcaaactcctgacctcaggtgatccacctgcctcggcctcccaaaagtgctgggattacaggcgtgagccaccacgcccagtctatgcagtctgttatatgtcatgaagatgaatttggctctccctgtgaagctgaaagaagctcagcgaaagaaaagtagaatccttatttaaaagcatcagacagaagatgcccctttgtgagagccaattaaaaacaaaaaaataaacaaacaaacaaaagcagctttccacgaatgatttcctttggaacacagcttcccaaatcacatttaaggactgactttctctttgaccttgggacctcttatctgtgttgtctgttgtattcattttcttcttttttttttttgttttttttgagatgactctgtcacccaaaatggagtgcagtggcataatcttggctcactgcaacctctaccttctgggttcaaagcgattctcctgcatcagcctcctgtgtagctgaggttacaggcgcatgacactatgcttggctaattattgtatttttagtagagacgtggtttcactgtgttggttaggctggtttcaaactattgaccttgtaattcacctgcctaggcctcccaaattgctgggattacaagtgtgagccactgaacccagcctgttgtattcattttcactctacctatctgggggtttggcaatcatctcatgtctcttcatagtcaaaggttttttttccttgacaacaatacctgtttattaaaaataaataccatgaatcttgctcatattcttcaattagaagctagtaatgtgctaagcagagaggatgtaataaaatagtctagtaaattaataccaaaatactaattcataatagaaatttctaaatatttagaaaatactttcactttttaggtttcttaattttactacctggtactactgaatcaaaaattggtggtggcaattagattttcaggtgggggcaacaatatttcatgccagtaaattttggaattgccactaatttagagtgaagaatacactcaactgaggaatgtggaaagtttggattaagatgaaacatcttgaagaaattatcttctaaatgaaagaatcctgaagattttctggaaaaggggcatctgaaacacttttatgcaaagaataaagtacccagaaacattccacaaaaaagggaaataaaacttttagggtatattatgaattatgtattaaagttatactcacaaaggaagaccaagtttctgtagttctgaaacttcacatccctatataaattccgctgtgcagtgtccaggcaatgccactcctccagagagaattctatggccacgtctctaaactgcaatggtccctggaaaacacacacacacacatttttaccaagtggccataggtggaatttttaatttgacttaaggtgaaatgaaagataaaagacaaatggttctgacttataagactcactaaaattatccaataaaataattttcatcacagaaatattatttaatgtattctctaactctgagaaaaaacagcagcataagatacacaacatcagttcatatgtgatatttttctagataataaagtataaaattaaaggcataaacgtacatttttgagtgctatttcatcatatgaaatgagttgtgaatatttttcaaaaggaaaagatgagttagaaggcacctcaaattttaatatatacaataagctgaagaccttctcatgcaggtttttttaatatttttccgcagaagagctggaataaagtctgatttatttatttatttttagttttttggagatggagtttcatgcttgttgcccaggctggagtgcaatggtgcaatcttggttaactgcaacctccacctcccagattcaagcaattgtcttgcatcaacctcctgagtagctgggattgcaggaatgtgccaccatgcctggctaattttttttttttttttttgtatttttagtagagatggggtttttccatgtttgtcaggctggtctcaaactcctgacctcaggtgatctgcccacctcggcctcccaaagtgctgggaatataggcatgggccaccacacctggccaattttttgaatttctaacaggctcatcagtaatgccaatgtttttggctcaagaaggatatgttgtcaaacatccaggaagtggaagtgtcggtgtttttcccactttttctagcctgtaaacaaagataagagtcttcattttccaaagaaaaatatgtagaaaaaaataagaaaaaagggcagctgccagattgaatgtgatggtttatgcacgccagcggcataaacatacctaataatacagcgaaaaataattatagtgaaaaatcagaaagctatttcaccaatcgaatcattaactattaactgcactaggacaaatttttattgtgtgctaatgcacccagaagaacacagcatcactcttgaaatattcctccccaaaaaagtaaattatagtctgaatttatgcaaacttcaaaacacagataatgcctatgttctgtaatttttagtagtaattttaagtaggcttcatttaacaccctagagagcaggtatctcctaataatttttttcagaactttctgggtaataaatgccatcccatttaaataagcattttttttttttttttgagacagagtttcgctcttgtcacccaggctggagtgcaatgatgcaatctcagctcactgcaacctccacctcctgggttcaagcgattctcctgcctcagcctctcaagtagctgggattacaggcatgcgccacaatgaccggctatgtttttgttttgttttgtttttttgtatttttagtagagatggggtttcaccatgttggtccggctggtctcgaactcctgacctcaggtgacccacctgcctcagcctcccaaagtgctaggactacaggtgtgagccactgcatccagcctaaataagcattttcttaatcctgttctgcatagagctaatttaacacagagatggaccctaaacattacatgtccaccatctttactaaggaccacagttttccccaatagaaatcttgagtatccacaaagggaacatttttaatgttatgggtcataaattcttgctgagaattttgcatggcatataagaagctatcacgttgagaatgtagagaaggctctgggatataggaaagaaacatttttcagagacccttgactatcataattttaacaagtagttaaaccaaactcattagggagcaaaaacacaagcagagaaggaaaggtttgtgagtagtaaattcatggcagtccaggaggcagagtggacacagttcttcatctgacacctgtttacttaaagaaaagccatttttttttctttctcatttttctctggaattttttctgagatgagattctctgaacaaattacacccccagcttgagaatatgcctttaaaagtgtcagtgccacatgtttacctgctagcatgacatcaactggcagaaaaacaaagacagaaaaagtccacccatttctgtcctttaaaacaatgagactcagaaacaatgagctgctccatgaaaataaaaatgtatctcttttgctgtcctcaggtgccctcccctgccacagacaccagtaatttctgctacagtaatggaaatatgcaccacactgacctgtccctaccaaattcaaacagaacaggccctgtgaccaccctttagtgcaaaggtggaacttaactctcatgaatgtgttttgaagcaatcatacttgattctggtctcaccttagagccatatgaggcccttcgttaaaacaacatggatgcttccacccagaacaataaacaagctgtggagagggcataagagatttctgcaaattagccatgtgatcctaatgagaagcctgggctgataatcactaagttaatcattgcctctcaagctttaacgagcttctaaatcacttggtaattttggccccactttatgtaaagtgattctggaagcttgaaaagggtccaggaatggttgttttatacaagtcccctgtgaatgctgatgttgctcccccgggctcattattagcattagtcagagaagcaggcacagctcagggtcccttacccttagcacttttgtcacaaccaaatgcttctggcacaaataaggacaacccatctccatcctaaagttttatattatttgctggctctttaaagtttacagatgaaacagagacctggaatctacacttcaattagcagcaattacaaaaggatttgtaaagacaacaagagagggacagagagtgggctgatacaaagttgtctgttagaaatttttatttatttaaacaaataactttgattattgattagatatatatcattatggtttagggtatgaaatataatgtccaatatggcattattattttaatttataactacttgtggcaatagcaaacattttcaagaaatgaataaatagttcaaagtgggagaaagacataactgcactttcactttaatgtctctctgagtttgataaccagaaagacttgcatttttcagataaaagttttttatttcccaaatctcaagacctggattcaaaatttggagctacagatttagggcctgaatggctggagttgcagcaggtgttaactgcacatttgtgggcattttggcaagaggaggaatgggaaagtggagattctcatgtctatatgtctaatcaatgcacagatgctactgtgattgggtttctgggctccatagtcactgaattgctttcaggtttgaagataaaagagtcattgaaaaaggtgaaatgactgattgctgcccgtgaagtttgtagaaatttggtctagcttctctagaaatgactgtagaggactacagataacaaataggctgagacacaattctgcctgcatatttaagggacagcatgcactgtgctgtgcacgtgtctgttaactggaagcctgagagaaaaagtcccctctagagtaaattctggttggcaccttatgtgtttatatcatgtctggtaattctagacagtgtttggaaacaataattaaaagaaaatttttctccagtcccagagaaactccacaataatagaacagaaagaaaatgcttttattacacaattaaacttgaatgtgatgtccatatactcaatctgcttaagagactgcaaagacagaaagatggtcaccataattagttcacaagtagaagaatttgcagcaccatgtcatacatcgttcatcctaaattcacctggagattgaagaggccatctgtgtatactaattgcttatattcaatgatgataaacttttcacatcctcataacaggaggtagtttagtagcttgaagccaggtgtctgctgaagctaggctttcactctgctacaaaaatggttgaatagtgttctatctttttggctatttacattttagagctgtggctctgtactccctggcactgggctacagcactcctgctcactttctcctggttgctactgtcttctcttgacttctaccatctgccactgaggcacagcccagagcacagctcacattttatgtgaatcccatttgccacagcagcactatagtgtcacatcagagagggaagcctgagctgcaggaggagagcctgcaggcctcctgggtagaattacaccttcacaataatcaaaataagaccagtgtttcagtctcaggttctacttataatggtgacaaggaaataatgctgctaaatttccagcatgagtccaaatagagatagctccaaaagttctttctgtgacagcccacctcattgagacaccatggaatactaatagggcttctgaaacagacaaagcattggagagaaaaacagatctccatctgggcaagatgattttgacagaagttaaaacgatcttaagaaaaagctcaggctgtctctgtctctccctctccctctccctctccctcctttccacggtctccctctgatgccgagccgaagctggactgtactgctgccatatctgctcactgcaacctccctgcctgattctcctgcctcagcctgccgagtgcctgcgattgcaggtgcgcaccgccacgcctgactggttttcgtacttttttggtggagacggggtttcactgtgttggccgggctggtctccagctcctaaccgcgagtgatccgccagcctgggcctcccaaggtgccgggattgcagacggagtctggttcactcagtgctcaatggtgcctagactagagtgcagtggtgtgatctcggctcgctacaacctccacctcccagccgcctgccttggcctcccaaagtgccgagattgcagcctctgcccggccgccaccccatctgggaagtgaggagcgtctctgcctggccgcccatcgtctgggatgtgaggagcccctctgcctggctgcccagtctggaaagtgaggaggtctcttcccggccgccatcccatctaggaagtgaggagcgtctctgcccggccgcccatcatctgagatgtgcgagcgcctctgccccgccgccccgtctgagaagtgaggagcccctccgcccggcagccgccccgtctgggaagtgaggagcgtctccgcccagcagccaccccatccaggagggaggtgggggtcagcccccgcccggccagccgccccgtccgggaggtgaggggcgcctctgcccggccgcccctactgggaagtgaggagcccctctgcccggccaccaccccgtctgggaggtgtacccaacagctcattgagaacgggccaggatgacaatggcggttttgtggaatagaaaggggggaaaggtggggaaaagattgagaaatcggatggttgccgtgtctgtgtagaaagaagtagacatgggagacttttcattttgttctgtactaagaaaaattcttctgccttgggattctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactgttgtcctatgaccctgccaaatccccctctgcgagaaacacccaagaatgatcaattaaaaaaaaaaaagaaaaaagaaaaaagaaaaaatacaccctggcagaaaacttctcgaatgtaagtaaagtgggagttttcaacttgcccacctccttacaaaaacatgcaataagaatgtgctagatataaagcttacaaatgtgagaaatacgggaagtttttcaattttaacaaatactttcaaagtcatgtgaaaattctcactagaaagaaatccaataaaggcaagttgaggcattaaaaaaaaaaaaagaaaaagctcagaatacatataagattgactaagtcagccagaaaataatcccctaaaagaaatttctctctaaacacccaatgtgcacagctactctcagcatgagaaacatgagctttatgaagaaaggtggcagattttcagaagaattttataaaagtttcttttccatctctgctgctgtctcatctcctagccattgaatgggggttctatattgaaatacatctgacaacttccaacaacactttttgatcaagaaatagaatttgactatgttcgtatagtggaatatattagaacttgtaacatagctaactgaatagctattatggtgtttgggtggccacatcacctgtctttatttgtccggtaatagcagcattccaatttaaagaaataaaagataccaaaattgtgtttacttttaattattcctattgaataaagtaataagcatgtcagactgatatctatcataacaataaattttgtttggatattatattagatataaatatttaagtatgaatacttttaatgaactagtcataatgtatgtagcatttttaaaaattgtaactatacttcagttaaaacactttatatttcaaaagcataaataacaatattaaaataacaatttaggtgattcattcaaagtaagtattggggctttatgttcatactattgtagaaaatactgcttatggctgatgcctgtaatcccagcacattgggaggctgaggtgggtagatcacctgaggtcaggagttcctgatcccatctttactaaaaatacaaaacttacccagggtggttgtgcacacttgtaatcccagctacttgggaggctgaggcaggagaattgcttgaacaagggaggaaatggttgcagtgagccgtgatcatgccactgaaccccagcctgggcaagagagtgagactgtctcaaaaaaaaaaaaactgtttaatttttatgaatgcaggttttctgcaaacactacacataactatgctaattgttctgaagtaataaatagaaagcaaggcacaactacagactccactgttcagtttatgcactgaactgttcttgcttttgcagtgtaagtatttctgcctgcaaatactggataattaccttggatcatcagatttctatcaaaggaatttagtatcttttagtctttatcattttgtattgctaaatttatctgtgtgttaagcttctatgtgctcttaaaatgaggttttatctaaacaaacctgtgtctactttaaaagactaaacatgaaaaaactaaacttttcagaaccaaaaacaaagcaataaatctgaagtactagatagtctggagtgagatttatttagcttttttttttttttgagatggagtctcgctctgtcaccgaggctggagtgcagtggcacgaactcggctcactgcaaaagctctgcctcccagcttcatgccattctcctacctcagcctcccaagtagctgggattacaggcaactgccaccacgcccagctaatttttttgtatttttagtagagacggggtttcaccgtgttagccaggatggtcttgatctcctgacctcgtgatctgcctgcctcggcctcccaaagtgctgggattacaggcatgcaaaaccgcgccctgcccttatttagctcttaatatgatttacatatatttcaaaaaagcagagaaaaatatctacatataatctaaatcccttaagaaaagagagaatagcaaaaaaatttttggaactttttaaagagttttgaactcttggacatctgaattttgcacactatatgcacttgaaagaatgttaatggggaaaaagcagaagagaaaaagacgttataaaaaaatccatgagtgcacaacacctatgaaacagaatagagagcccagaaataatgcctttcacctgcaaccatcagatttctgacaaagctgacaagaggaatgtgggaagaattctctctttcataaatggtgctggaataactatctaccactatgtagaagactgaagtggaccccttcattacaccatataaaaaaatcaactgaagataaattaaggacttaaatgtaaaacttaaaattataagaaaccctgcaagataacctaggaaatagcattctagacacagaaacaggtaaagacttcatgatgaagctaccaaaagcaactgcaacagaagcaaattgacaaatgggatgtatttaaacttaagagcttcttcacagcaaaggaaactatcaacagagtaaacagacaaactagagaataaaagaatatatttgtaaattttgcctctgaaaaaggtctaatatacagaatttattaggaacttaaacaagtttacaagaaaaaaacacactcattaaaaagtatgcaaaaaacatgaacagatgcctttcaatagaagatacacatagggctaacaagcatatgaaaaaaaaatgctcattgctaatcattagagaaattagaagagaaaccacaggctgggtgcggtggctcacgcctgtaatcccagcactttgggaggccaaggcaggcagattacaaggtcaggagatcaagatcatcctggctaacatggtgaaaccctgtctctactaaaaatacaaaaatcagccaggtgtggcagtgtgcacctgtagtcccagctactcaggaggctgaggcaggagaattgcttgaatctggtaggcagaggttgcagtgagctgagatcacaccactgcactcctgcctgggcaacagagcaagactccgtctcaaacacacacacacagacacacacacacacacacacacacacacacacacgcagagaaaccacaatgagataccacctcataccagtcagaatggctatttttaaaaagtcaaaagataacagatgctgacaaagttgcagagaaaagggaatgcttatactcctctggtgggagtgtaaattatttcaacaactgtaaaaatcagtgtgacaattcctcacagaatgaaaaacagaattatcattcgactgggaaacctcataattgagtatatacccaaagaaatatgaaatattataaagacacatccacatgcatgttcactgcagcactattcacaatagcaaagacacggacagactaaatgcctatcaatggcagactggatcaagaaaatatggtatggtcagatgcggtggctcatgcctgtaattccagccgtttgggaggctgaggcaggtggattgcctgagcttagaagtttgagaccactctgggcaacatggcaaaattttgtctccacagaagatacaaaaaaaaaaaaaaaaaaatggccaggcttggtaacacccgcatgtagtcccagctacttgggaggatgaggtaggagagaattgtttgagcctgggaagttgaggataaggtaagccaatatcacaccacagcactctagcctgggcaataagtgagaccctgactccaaaaacaaaagatttagtaaaaacaaaatatggtacataagcatcctggactactctgtggccattaaaaacaaataaccatgtcctttgcagtaacattgatgaagctggagaccattattcttacaaaacaaatgcagaggctgggtgtagtggctcatgtctgtaatcccaacactttgggaaaccaaggtgagtggatcacctgaagtcaggagtttgagaccagcctaaccaacatggagaaatcccatctatactaaaaatacaaaattagcagagcatggagacgcgtgcctgtaatcccagctactcaggaggctgaggcaggagaatggcttgaacctgggaggcagaggtgagctgagaacacaccattgcattccagcttgggcaacaagagcaaaaacaaacaagcaaaaatatctcaaaaacaaagaaacaaaacaaaaaaagaaaataatacaggaacagaaaatcaaatgcatgtcattatttataagtaagagctaaataataagaacacatgaacacaaagaggagaaaaacaggcactgaggcctagtagagggtggagggtgagaggagtaagaggatcagaaaacatacctgtttggtgctatgggtagtacctcagtgacaaaataatctgcataccaaatccccatgacataatttcagctgtataacaaacccacatgtgtacatcgaaccaaaaataaaagctaaaagaaaaaaaactccccgagtgggagagagtgcaatgtaggtgaaagaacttatttttgctacagataatggcccaggtagggctgtactctgatttacttctgtgtgaatacaggcagatgagattatgaacaagtggtccagaccctaggatggtggagaaaacaggttgctgctgcagattcagtgtctgggggtggggttatgccaggagacttgtagatactgtgggtccttttcaagaaacactgggttcaaaaatgccgtggtgaagttcctgagggtggtgccgagtcctaggaggagtgtggacatgtcaatgtctagtgtgtgtgtttgtgagtgggtgggaatactatggtggcacctgtgggaaaagggcgtctgtcatgggagtttctctccgctaagttttcagtccacagttgccctcggagaagacctggaatcacaggacaatgggcagtgtgacagcctgtgtacaggagagcagagcctcccattcccagacacccagagttttattccaggccaggcctccatgatatctttttttctggcaccaaatctgtagcatttgctgaacatcaaacaattctccaacaccaacttacggtctaacatttgaattctgacaccacccacagtcagtacagaccctgattcagggctcggtcccacaacattgtcctcaatgcagatgccagtcataaaccccatgggcccatgtatgtgtctgagctactgtttaaaaacgggagacggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaataaaaataaaaaaaaataaaaataaaaacgggagactcccataacgtccctgaagttcaataatttcatagagctactcacagaactcagcaggaaactgtagttacctttaccggtttaatatataagatgaaggccaggaaaagtcaaatggaaaaaatgcacagaacaaataaaagagatggaaaaagatgaaacacataatcctaaaaaatatttgtgattaataaaatcatcctaggtcgggcgcggtggctcacgcttgtaatcccagcactttggggggccgaggcgggcggatcacaaggtcaggagattgagaccatcctggctaacacggtgaaaccctgtctctactaaaaatacaaaaaattagcggggcatggtggcaagcgcctgtagtcccagctactcaagaggctgaggcaggagaatggcttgaacccaggaggcggagcttgcagtgagccgagatggtgccactgcactccagcctgggcgacagagcgagactctgtctcaaaaaaataaataaataaataaataaataatttaaaatgtctccatcctttgtgtgctccaggaacagtttatggaaggaaacacccttcccattatgacttaagtggtgctctcttttctttcctaaaacacaggctgacacacacactgcacattttctccttttttttttttgagatggagtctctctctgtcgctgaggctggagtgcagtggcgcgatctcggttttctgcaagcgctgcctcccaggttcacgccgttctcctgcctcagcctccggagtagctgggactacaggcgcccaacaccacacccagctaacttttttttttttttgtatttttagtgaagacggggtttcaccctgttagccaggatggtctcgatctcctgacctcgtgatccgcccgcctcggcctcccaaagtgcggggattacaggcgtgagccaccgcgccgagcctggaattcatttttttttttaaacataaatctaatgtttttattttacaaagtttagaaattgcctcaaaacaataaaaacttcatcatcagtaagacctccccagtttcctttcatcttaaccttaactgcatctgcctgtgggatcccagctttccagggctctgtagcttctctcaggataaaggcttcttctatggctggggtgagcaggctgagacagctgcatgggtggctcctcagaaagaactaactgggcctttaataacttcctcttgcatgcttaatattagccctagcttggagttactaggttcaagctttaatttccatgtcagagttattcacttggttttcaaaactaagtgtttgaaaaatccagtgaaattactcacagcgtttacataagaaaaggaaattttaaggtgcttacttttttttttttttttttgagatggaatctcgctctgtcacccacactggaatgcaatggctggatctcagctcactgcaacctccacctcctgggtaaaagctattcttctgcctcaccctcccaagtaggtgggactacaggcatgctccaccacacccagctaatttttgtatttttagtagagacagggtttcaccatgttgggcaggcgggtctcaaactcctgacctcaaggaatcaacccgcattggcctcccaatgtgctggaattacaggcgtgagctactgcacctggctaaggtgcttgcattttatgcctccataagaaaaacaaatatatctacttctttcagacaatatatgtattattttattatttatattaaaaaataatgtagtaaaaaattagtcatatgggaatgcttctaaaagttaccacgtttcatcacatgcaatttagcactaaactcagaaatcaagacaacaggatatagaatggagatattcactgtcacaaatttaccctgcaaaaagaggaactgatgttttgatgaatctgtgtaactcattcaccacattttcctatgaaaatatattcattgtctagagccaaaatggaagagagattttccctattttttcccttggtagctagcattataaagctaaggcttagaattctgtctgaaatcactaagacataaaaaccacacccaagaaaattcctaaactcactcttggaaagaaaaatgtaaatgagttattaacaaatggaatatatgattaaatattaattttttgaaactcatcttttattttctttgtaaatattttcttacctttcaagccctactaataaaatgcaaattacagataaaaaactgattcaggtgggtgctgtggctcactttaatgccagcactttgggaggccaaggcaggcagatcaattaagattaaaagtttgagtggggcacggtggctcatgcctgtaatcctagcactttgggaggcctaggtgggcggatcacctgaggttgggagttcgaggccagcctgaccaacatggagaaaccccatatctactgaaaatataaaaattagctgggcatggtggcacatgcccaaggctgaggcaggagaatctgggaggctgaacctgggaggcagaggttgtggtgagccaagatcacgtcatcgcactccagcctgggcaacaagagcaaaaatccatctcaaaaaaaaaaaaaaaatgactaaaagtttgggaccagcctggtccatctctactaaaaatacaaaaactagccaaatacagtggtgcacacgtgtagtcctagctactccggaggctgaggcatgagaatcacttgaacccagaaggtagaggttgcagtgtgccaagatcaagtcactgcattccaacctgtgcaacagagtcagactgtcttaaaaaaaaaaaaaaaaaggcagaatcaacaacaacaacaaaaacacctgaggtcaaaataagtgaacaaatctttcaaggtagatatccaatcactcaccccatcctgttcacatgctcaataaccaccctcccaggagacacagcgcagacacagcgtgactgccccagctgcattttactatgtaagtttttaccccatctcactggggtcattttcttttgtcttttgaaggtttttttcacaaactttttactatttttctttcactccccccaagagcatccagggggcagaaattatttgttttcccctcaataccagcatctgattggctcaccaacaatgtgtctccaagaaatggaagttaggttgggtcaagacaatcttcatgtctcaaggggctagcttttcaaaaaaaaaaaaaaaagtatatcaggagatgcctttcagccccaaggctgccacctgctcccttgagaggctacactctatacttcaggtggtcctaagggagaaagtgacccaagagctaatatccattagacattttagcagacatagccatagtgggtatcttggtttatctccagaaagtactaaaacccaggcccagaataaaactgaaggttagcagaggtcacatcaccctataatgtttccagagggtaatgttaacctaaaaacattctggtaagttctctggaaaaataaaagaaaaaaaggtacagatattttttacaatacagtgtcaggggattattctttgctttcttctcatgggaaatatttaaaaatagaaaacaaatcttttcaatagtgctatgcaatgctttaaacaatgattgaggaacgtggggtacaggaggccctgctggggacacatgtgaaaaatgccagagaaaatcagccccttgtgggttgtgaaaataattaagcggcaggcaattagactgagaaggctctagtcctcagattcctacttgtaaaaaaatgtaaactcaagttgatttgttaataaattactacatttggggaaacaaatttcaggcttaaacaactataaactgccaaataagctctgattacataaccaggaaatttccaccttgattatacaaattaagaagctacgtaagtacacctaaccaattgttgaatttggttttcttcatcactgattttacaaatgtctttccttcaagcccctcccatggaccacagactacaaactataactgggtgctctacaattcttgaatcactctttgattaaattacttgattttttgcagtgactcccataattttttttttttttgtaaaggacatatcatatttattcatacacatgctggaattattggtgcagacatttaaatacattttctttgagaaagtccttttttttttttttttggatggagtttccctcttgttgcccaggctggagtgcaatggtgcaatctcagctcacaacaacctctgcctcctgggttcaagcaattctcctgcctcagcctcccaagtagctgggattacaggcatgcaccaccacgcccagctaattttttttatttttagtagagacggggtttctccgtgttggtcaggctggtcttgaactcctgatctcaggtgatctgcccgccttggcctgccacagtgctgggattacagtcgtgagccaccacagctggcctgggaaactccattctttttttttttttttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaattaaaagtctcccatgtctacttctttctacacagacacggcaaccatccgatttctcaatcttttccccacctttcccgcctttctattccacaaagccgccattgtcatcctggcccgttctcaatgagctgttgggtacacctcccagacggggtggtggccgggcagaggggctcctcacttcccagtaggggcggccgggcagaggcgcccctcacctcccggacggggcggctggccgggcaggggggctgaccccccccacctccctcccggacggggcggctggccgggcggggggctgaccccccaacctccctcccggacggggcggctggccgggcggggggctgacccccccacctccctcccggacgggcggctggccgggcagaggcgcccctcacctcccggacggggcggctggccgggcggggggccgacccccccacctccctcccggacggggcggctggccgggcagaggggctcctcacttcccagtaggggcggccgggcagaggcgcccctcacctcccagacggggcggctggccgggcggagggctgatccccccacctccctcccggacagggcggctggccgggcggggggctgacccccccacctccctcccggacggggcggctggccgggcagaggggctcctcacttcccagtaggggcggctgggcagaggcgcccctcacctcccagacgggacggctggccgggcggagggctgacccccccacctccctcccggacggggcggctggccaggcggggggctgacccccctacctccctaccggacggggcggctggccgggtgggggggctgacccccccacctccctcccggatggcacggctggccaggcggggggctgacccccccacctccctcccggatggcacggctggccgggcgtgggggctgaccccccacctccctcccggatggggcggctggccgggcggggggctgacccccccccccccacctccttcccggacggggtggctgccgggcggagacgctcctcacttcccagatggggtggctgccgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggcggccgggcgtagacgctcctcactttccagactgggcagccaggcagaggggctcctcacatcccagacgatgggcggccaggcagagacactcctcacttcccagacggggtggcagccgggcagaggctgcaatctcggcactttgggaggccaaggcaggcagctgctccttgccctcgggccccgcggggcccgtccgctcctccagccgctgcctcccgggcggcgctcgccggcgccgactcccataatttactttttctagacagagtctttctctgtcgcccaggctggagggaagtggcatgacctcagctcactgaaacctactccttccgggttcaagcgattctcacctctgcctttggagtagctgggactacagacattcaccatcacacccagccaatttatgtatttttagtagagatggggtttccccattttggccaggcttatcttgaactcctgacctcaagtgatccacccgcctcggcctcccaaagtgctgggattacagacgtgagccaccgcgccaggccccataaattttttcttttccttctttcttttttttttgagacagagtctcgctctgttgccaggctggaatgcagtagcacgatcttgtcttactgcaacttccgcctcccaggttcaagcgaattctcctgcctcagcctcctaggtagctgggactacaggcccccgccgctatgtttggctaatttttgtgttttagtagagacagggtttcaccatgttggccaggatggtctcgatctcttgactttgtgatccacccgcctcggcctcccaaagtgctaggattacaggcatgagccaccacacctggccacccgtccccataaatttttaataagagaaaacagaaactgtgaaccccacagaccaaagctcttcccattcatgaacccacaccccgagtcagggttcccccccaaagatcctcctggagtccccgcacaatctaggagagacgtggcactgtgggtgcagggctgccctgagaaggtttcaggccagggcacagtcaccgcgcagggaagagacaggacacccctggaccgcctgtcagcgcagctgccatcttagggctgaaggggactgaggccgagctgggcaaggagaacttgtggcacagattgtggagctgactgaggagaggcctgagtcctgccactgccacttgtcaccggttccaaccatcccctcccgctcactcaggatgtcggaccggcactctcactgtttctaggcttccaggaggtcctggtgtcttagctgtggatctcccaatacctgcaggtcacagggctatagaggttgcgcctctaggagcagaggacacagactagtgaagaggagacccagagctcaggctgcagccagagacaaaggctgcagccaaacactgaagacgtcctgttcactccagctgcgtgcctgattgggcagttttcaggccagcgtttcttttttcttttttttttttattgatcattcttgggtgtttctcgcaaagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcataggtcaacaggatcccaaggcagaagaatttttcttagtacagaacaaaatgaagtctcccatgtctacctctttctacacagacacagcaaccatccgatttctcaatcttttccccacctttcccccttttctattccacaaaactgccattgtcatcatggcccgttctcaatgagctgttgggtacacctcccagacggggtggtggccgggcagaggggctcctcacttcccagtaggggcggccgggcagaggcaccccccacctcccggacggggcggctggctgggcggggggctgacccccccacctccctcccggacggggcgtcagcccagcgtttctgattggataatgcttaaggcccccgccccctcaggccctgagtaacagaaaatgtgatcaggactgagtgaagaaaaagtcacagcctaagctgcagcgtttttcaggcagggcttcctccctgagctgagccaggcccaacccagatcatgggaaaattctatctttttttttactctctctctttttgaatatattcaaaaggtgaacagaagtattttgctgtcatattaataatacataaaatttttttcaagagaaaatcagcttttactttggtaatagtgtattatcaatactaaagctaattttaataaaccttataaataaatcaaatttgtcatttttgaccactccggttttacatgtatattttgtaatctcttgtaatttttaaaaactgtttacattttatttttatccaaattctttttattttttcaatttgaaaccacctttaagtaatttcaaattgttataggagatagaaagaagtcatttagggccaggttcactggcaagtgcctgtaatcgcaacactttgggaggccaaggtgggtggatcacttgaggtcaggagttcaagaccagcctggccaacatggtgaaaccccatttctactaaaagtacaaataactagctgggtgtggtgctgcacacctgtagacccagctagtccggaggctgaggcaggagaattgcttaaacccagaaggcggaggttgtgtaactgcccaaggggttcaccttgccctatgtctagacagagctgattcatcaagactgggtaatttgtggaggaaaagttaaatactaaatttgaacttaattgaacgtggacaaactcagtagtcaccaagttctcaaacaggttgtgtgaggcccttgaggcattcattcagcgctgtttcagagaaatctctatttcaatctatttctatatattagttgttgaaaaacaatagacaatcgcaaaaacaagttgacagttttgtgttccttgaccccagttgcaaatggccctcatgactgggccttatgccaaacaactcgttacaaaagagctagggtatcagattgtgctgaagcttcattagaccctcctcatctgtgcaggaatgagtagctgactctggagcccaagctgttgcttcccagtctggtggtgaatcctccatagtctggtgagtgtaaatatatatatctcttttcctttctcctcttcccattgcaatttgcttattatatcaacatgcttattatatcaatctggttattacattgatttgcttattatataatttgctaattatatctgcatttccatttacgtggcacaaagcttatttacccttaaaggtattgtgtgtgtgtcttttcttctccccttgaatgtttcccacacagaatatttttggcgtcacgaacaggattcaaaaaccaaactgtgccactttttggccacaaggacagggctggaaactcgaggaaatcccaaatccagggatgggaactccccaatatcactgtcaattcctacaggattgaacgaaggggacgaatgcagaaatgaagacaaagacaaaagatttgttttaaaagaaggggtcaggcagggcgcagtggctcaggcctgtaatcccagcactttgagaggccgaggtgggtggatcgcgaggtcaggagagcgaaaccatcttggctaacacggtgaaaccccgtctctactaaaaatacaaaaaaatttagccaggtgtggtggcagacacctgtagtcccagctacctgggggggtgggggggtggggctgaggcaggagaatggcatgaacccaggaggcagagcttgcagtaagccaagatcgtgccactgcactccagcctgggtgacagagcgagattcggtctcagaaaaaaaaaaaaaaagaaggtatcaggggctccttgcttctagtgagcagaaggcagccctgtttctacaggccttagtatttattaggtagaatcaatagggagggagaggtaatggttggtcagctgcttgatttatcacaggtacatataattgctttctttgtacaacaggcttcagatattcctatagataaccacaaggaacactgcgcctggggcataactgccctcagcacccgttctggcagcagatgcagtttgtcagttttccaacatcctgctttcatgagaagagttttcccatatagcctctgtcaggcctctgagcccaagccaaatgaaatttggtgccatgactcggctcgggggacctcccttgggagatcaatcccctgtcctcctgttctttgctccgtgagaatgacccacctgtgacctcaggtcctcagaccgaccagcccaagaaacatctcaccaatttcaaatccggtaagcggcctctttttactctcttctccaacctccctcactatccctcaacctctttctcctttcaatcttggcgccacacttcaatctctcccttctcttaatttcaattcctttcattttctggtagagacaaaggagacacgttttatccatggacccaactccggcaccggtcatggactgggaaggcagccttcccttggtgtttaatcattgcagggacacctctctgattatacactcacgtttcaagggtgtcagaccacacagggacacctgccttggtccttcacccttagcggcaagtcccgattttctgaggaagggacaagtacccctcaaccccttctctccttgtctctaccccttctctgcttttctggggcaggggcaagaacccctcaaccctttctccttcacccttagcggcaagtcccgctttcctggggcaggggcaagtacccctcaaccccttctccttcacccttagtggcaagtcctgctttcctagggggcaagaaccccccaatcgcttatttccataccctaacctcttatctctgtgccccaatcccttatttctgcaccctgacctcttatctctgtgccccaatcccttatttctgtgccccaacaccttctctgcttttctggagggcaagaaccctccaccccttctccgtgtctctactcttttctctgggcttgcctccttcactatgggtaagcttccaccttccattcctccttcttctcccttagcctgtgttctcaaaaacttaaaatctcttcaactcacacctgacctaaaacctaaatgccttttcttctgcaatgccacttgaccccaatacaaactcgacagtagttccaaatagccagaaaatggcactttgaattttttcatcctgcaaaatctaaataattcttgtcgtaaaataggcaaatggtctgaggtgcctgatgtccaggcattcttttacacatcaatcccttcctagtctctgtgcccagtgcaactcgtcccaaatcttccttctttctctcccacctatcccctcagtaccaaccccaagcatcactgattctttctaatcttccttttctacagacccatctgacctctctcttcctccccaggctgctcctcaccaggccgagctaggtcccaattcttcctcagcctccgctcctccaccctataatctttttatcacctcccctgtaggggtgggttgcccctccacacctgtgggtgtttctcataaggtggaacaagagacttaggaaagaaaaagacacaaagtatagagaaagaaataaggggacccggggaaccagcgttcagcatatggaggatccccccagcctctgagttcccttagtatttattcatcattcgtgggtgtttctccaagagggggatgtgtcagggtcacaagacaattgtggggagagggtcagccgacaaacacgtgaacaaaggtctttgcatcatagacaaggtaaaggattaagtgctgtgcttttagatatgcatacacataaacatctcaatgctttacaaagcagtattgctgcccgcatgtcccacctccagccctaaggtggtttttccctatctcagtagatggaacatacaatcgggttttataccgagacattccattgcccagggacgggcaggagacagatgccttcctcttgtctcaactgcaagaggcatgccttcctcttatactaatcctcctcagcacagaccctttacgggtgtcggggtgtcgggcggggggacagtcaggtctttcccttcccatgaggccatatttcagactatcacatggggagaaaccttggacaatacctggctttcctaggcagaggtccctgcggccttccgcagtgtttgtgtccctgggtacttgagattagggagtggtgatgactcttaacgagcatgctgccttcaagcatctgtttaacaaagcacatcttgcactgcccttaatccatttaaccctgagtttgacacagcacatgtttcagagagcacggggttgggggtaaggtcacagaatctcaaggcagaagaatttttcttagtacataacaaaatggagtctcccatgtctatttctttctacacagacacagtgacaatctgatctctcttgcttttccccacatcccctcctcacacctggtccggcttacagtttcgttctgtcccccacctgcccagcaatttactcttaaaaaggtggctggagccaaaggcatagtcaaggttaatgctcctttttctttatcccaaatcggatagcgtttaggctctttttcatcaaatataaaaacccagcccagttcatgacttgtttggcagcaaccctgagacactttacagccctagaccctaaaaagtcaaaaggccgtcttattctcaaaatattttattacccaatctgctcccgacattaaataaaactccaaaaattaaattccggccctcaaaccccacaacaggatttaattaacctcgccttgaaggtgtacaataatagaaaaaaattgcaattccttgcctccactgtgagacaaaccccagccacatctccagcacacaagaacttccaaacacctgaaccacagtggccaggcgttcctccagaacctcctcccacaggagcttgctacacgtgccggaaatctggccactgggccaaggaatgcccgctgcccaggattcctcctaagctgcgtcccatctgtgtgggaccccactgaaaatcggactgttcgactcacctggcagccactcccagagcccctggaactctggcccaaggctctctgactgactccttcccagatcttctcagcttagcggctgaagactgacactgcccgaacgcctcggaagccccctagaccatcacggatgctgagcttccggtaactttcacagtggaaggtaaacccatccccttcttaatcaatacagaggctacccactccacattaccttcttttcaagggcctgtttcccttgcctccataactgttgcgggtattgatggccaggcttctaaacctcttaaaactccccaactctggtgccaacttagacaatactcttttaagtactcctttttagttatccccacctgcccagttcccttattaggctgagacactttaactaaattatctgcttccctgcctattcctggactacaactatatctcattgctgcccttcttcccaatccaaagcctcctttgcatcctcctcttgtatccccccaccttaactcacaaatataagatacctctactccctccttggtgaccgatcatgtaccccttaccatctcattaaaacctaatcacccttaccccactcaatgacaatatcccatcccgcagcaggctttaaaaagattaaagcctgttatcactcgcctgctacagcatggccttttaaagcctataaactcttcttacaattcccccattttacctgtcctaaaaccagataagacttacaatttagttcaggatctgcgccttatcaaccaaattgttttgcctatccaccccgtggtgccaaacccatatactctcctatcctcaatacctgcctctacaacccattattctgttctagatctcaaacatgctttctttactattcctttgcacccttaatcccagcctctcttcgctttcacttggactgaccctgacacccatcaagctcagcaaattacctaggctgtactgccgcaaagcttcacagacagcccccattacttcaatcaagcccaaatttcttcctcatctgttacctatctcggcatttctcataaaaacccacatgctctccctgccaatcgtgtccaactgatctctcaaacccaagcaccttctacaaaacaacaactactttccttcctaggtatggttagcatggtcagaattcttacacaagagccaggaccacaacttgtagcctttctgtccaaacaacttgaccttactgttttagcctagccctcatgtctgcgtgcagcagctgctgctgctttaatacttttagaggccctcaaaatcacaaactgtgctcaactctctctctacagttctcataacttccaaaatctattttcttcctcatacctgatgtatatactttctgcttcccggctccttcagctttactcactctttgttgcatctcccacaattaccattgttcctggcccagacttcaatccagcctcccacattattcctggtaccacacctgacccccatgactgtatctctctgatccacctgacattcacatttccccaaacttccttctttcctgttcctcaccctgatcacacttgatttattgatggcggttacaccaggcctaatcgccacacaccagcaaaggcaggtgatgctatagtacaagccactagcttgcctcttagaacctctcatttccttcccattgtggaaatctatcctcaaggaaataacttctcagtgttccatctgctattctactactcctcagggattattcaggccccctcccttccctacacatcaagctcgaggatttgccccacccaggactggcaaattagctttactcaacatgacctgagtcaggtaactaaaacacctcttagtctaggtagacactttcactggataggtacaggcctttcctacagggtctgagaaggccaccacagtcatttcttccattctgttagatataattcctcagtttagccttcccgcctctatacagtctgataacagatgagcctttattagtcaaatcagccaagcagtttttcaggctcttagtattcagtgaaacctttatatcccttatggtcctccatcttcaagaaaagtagaatggactaaaggtcttttaaaaacacacctcaccaagctcagccaccaacttaaaaaggactggacaatacttttaccactttcccttctcagaattcaggcctgtcctcagaatgctacagggtacagcccatttaagctcctgtatagacgctcctttttattaggccccagtctcattccagacaccagaccaacttagactgtgcccccgaaaaacttgtcatccctactatcttctgtctagtcatactcctattcacctttctcaactactcatacatgccctgctcttgtttacactgccagtttacactgtttttccaagccatcacagctgatatctcctggtgctatccccaaactgccactcttaactcttgaagtaaataaataatctttgctggcaggactatgctgaatctccttaggcattctctaatcagatatcctgagtcatcccaattcttagaccttttatacctgtttttctccttctgttattccatttagtttctcaattcatccaaaaccatatccaggccatcaccaatcattctatacgacaaatgtttcttctaacaaccccacaatatcaccccttaccacaagacctcccttcagcttaatctctcccactctaggttcccacgccgccccaatcccgcttgaagcagccctgagaaacatcgcccattctctctccatatcaccccccaaaaattttcaccgccccaacacttcaacaccattttgttttatttttcttattaatataagaaggcaggaatgtcaggcctctgagcccaagccaagccatcgcatcccctgtgacttgcatgtatatgcccagatggcctgaagtaactgaaaaatcacaaaagaagtgaatatgccctgccccaccttaactgatgacattccaccacaaaagaagtgtaaatggcctgtccttgctttaagtgatgacattaccttgtgaaagtcattttcctggctcatcctggctcaaaaagcacccccactgagcaccttgcgacccccactcttgcccgccagagaacaaaccccctttgactggaattttcctttatctacccaaatcctataaaacggccccacccttatctcccttcactgactctcttttcagactcagcccacctgcacccaggtgaaataaacagccatgttgctcacacaaagcctgtttggtggtctcttcacacggatgtgcatgaaagcctccagtggtatactgagttggtcaggacccccattttctctgcgtccaacatccccagttctcctctttggtgattgagtggttcagggaaactggcctttgtaagaactgagaatctaaattaatgcaatttaaacctttgactgtgtatgtgagaggagagaaagaccctctcacattgttttatattgttttatattcagtaaaaacaacaaggaagtaaaaccaaagacaggcagcctggcgccaggcctgaaaccaggcctgggcccacctggcctaaacccagtagttaaaaatcaacttatgatttagaagctgatgttattcatagattccttacattgtatagaagaacacggtgaaactccctgccctgttctgttcctccctgaccaccggtgcatgcagcccctgtcatgtaccccttgcttgctcacatcaatcacgaccctttcatgtgaaatctttagtgttgtgagcccttaaaagggcagaaattgtgcactcagggagctcagattttgagacagtagctggccgatgctcccagctgaataaagcccttccttctacaactcggtgtctgagagattttgtctgcggctcatcctgctacatgtgaagtgcagcaggggattccagtcagcaaaggagatgctgaaggatctccccgagtgaatggtgtttgcttactctttataagttaatgtatcaggataggggatagttgctacaagagaaataagagctggaaaagaaaaatgccaatccaactgccagactgaccctggcccaatgccaggcctatgtcttaactgttcagactcaaagatatcagcctattgatgaaaaaagtggctgtcccaatggccccatcagggtaaaattgaagaactagtcagtcaggtcttggagcaggtaaaaacacagctcctatctcaaggatgggaaattaaccttagtaaaattcaaggacaaattgtaaaattccttggcatcctgcacaaactataaaattccttggcatcctatgaaatgcagggaaatagtccattttaccaaagactaaggctaaaatactaaaaattgcaacccttaccactaaaaaggaggactagaaatttattggcttgtttggattcgggagacattatattcaccacttgggtaacattttacaacctctgcatgcagtcactagaaaatgctgtgactttcactggggagagaaagagagcatggcttttgaacaagctaaacaagcagtgcaactggccctggacctatggcccatatgagatgggccagtagaactgcaaataactgtcctaaatcaacatgctaattggagccttaggcagaaacaagatgggaagagggtacactttgggttttgaacccagaaattgccagaggccagcaaagcttatacccctttcaagaagcaattgttaccttgctattgggctttgctggaaatggaacacctctgcttcaaccgtgatgtctttataaggtctgaaattcctattatgacttgagtcatgagttcccccaaaactcaccaaatagggcatgcccaagaaagtaacatcataaaatggaaatacaacatagaagaccaggctaagccaaaaccaaagggggtatcatttttacatgaggatgtacaaaacttgccagctcaggaaaccactgaggaagtgctgcacatagggaaggaaaccgcccctccccccactcaatggtgcagttcctttaaagaactaagcccagaggatcagaaacatgcttggtttactgatcgatccagcaaacatattggtgggacccaatgctggaagggcatggcttataatcctgttaaaaacgtaagcatttctgatgaaggaaggggtgggagcagccagttagctgaactagtagccaacctccaagatattcaggaggaagccagagggatttgtcacttgtataccaactcttggtcagtagcaaatggtcttactacctggatgctccaatagtgacaaaacaaatggttaattgggaataaagaggtttggggaaaaaaatactgagaagatatctgaatcctggtgcacactaccattgttgctgttttccatgttgatgctcatccatctctgctttctcttgacagactatttaatcaccaggaagatcaacaggccaaaatttttattataactgcaaacttgaatgcggatgaattgatttcctgttcaagccttgcaatgactggcattataatgtgtggtggtataattgatagtgattagtggcctaaatattccacttaaaagatacagaatggtagaatggagaagagtttaccaaccaaatatctgcggtctttaagagactcacccaacacataaaaactcacataaagttaaggtaaagggttgggaaaagatagtcatgcaaatgtaccccaaaagcaagcagtagtagccattcttacatcagacaaaacagacattaaagcaaaaacagttaaaaataaaaaaagacaaagagggacattatataatgataaaaggactagtccaacaggaaaatatcacaattctaaatatatatgcacctaacactggagctcccagtttattaaacaattactactagacctaagaaatgagataaatggcaacacaataataatggggaacttcaatactctactgacagcactagacaagtcatcatgacagaaagtcaacaacaacaacaacaacaaaaacaatggacttaaactataccgtagaacaaatggacttgacaaatatttacagaacattccacacaacaactgcagaatatacatttcattcatcagcatatgaatcattccctaagacagacatatgatgggccacaaaacaagtctcgataaatttaagacaatcaaaattatatcaactactctgtcagactacagtggaataaaagtgaaaactccaagtgaaccctcaaaaccatgcaaatccatggaaattaaataaatacatggaaattaaataaaaataaaatttaggatcaacttgtttctgaatgattgttgtatgaaatcaagatggaaatttaaaaattctttgagctgaacgataataatgacaatctattaaaatgtctgggatacagcaaaagtcgtgctaaaaggaaagttcatagcatcaagtgcctactaaaaagtctgaaagctcataagtagacaatctaagataacacctcaaggaactagagaaacaagaacaagccaaacccaaacccagtagaaaaaaagaaataacaaagatcagagcagaaccctagggggaggggtggctgcagtctctgtggaccagcagacttagcctttcctcctgctagttttgaagaatttgagcagcccagatgagtggattttcccccagtgaaacacccccctccaccaaaggacagtcaaagtgcttcattaaatgagttctgcttcctgtgccacccaactggatgagacccttcaacagggattgtcagacaccctatagaggagcaattctactggcatcaggtttgtgcctcttgaggtcagagatcccagaggaaggagcgggcactcttctttgctgttctccaacttccttgagtgacatctccaggcacggcggtgaaccagatgaataggtcctgaagttagcccctagcaaactgcagcagcgctacagaagatggacctgaccattgaaagaaaaacaaacagaaagcaacaatgcatcaacaagaaaaaaatgtacccacaaaaacctcatccaaagccacacatggtggctcacacctgtaacccaatactttgggaggccgaggcagtgggcagagcacttgaggtcacgagttcgagactagcctggccaacatggtgaaaccttgtctctactaaaaaatacaaaaaaaaatagccaggcgtggtggtgcatgcctgtagtcccagctactaggtagtctgagacatgagaatcacttgaacctgggaggcagaatttgcagtgagctgcgattgtgccactgcactccagcctgagtgacagagagagagactgttaaaaaaaaaaaatccaagtgtcagaagcctcaaagatcgaaactagacaaactcatgaagatgagaaagaatcaacaaaaaacagctgaaaggccagagtgcctcttctcttccaaatgatcaaaatgtctcttcagcaaggtgcagaactggacagaagatgagatgcatgaattgatagaagtaggcttcagaagatggttaataacaaactctgctgagctaaagaaacatgttcaaacccaatttgaagaagctaagaacctcgataaaaggttagaggaactgttaactagaataaccagtttggagaggaacataagaggatgagatgcatgaattcacagaagtaggcttcagaagacggttaataacaaactctgctgagctaaagaaacatgtttgaacccaatttgaagaagctaagaaccttgataaaaggttagaggaactgctaactagaataaccagtttggagaggaacataagaggatgagatgcatgaattcacagaagtaggcctcagaagatggttaataacaaactctgctgagctaaagaaacatgttcgaacccaatttgaagaagctaagaaccttgataaaaggttagaggaactgctaactagaataaacagtttggagaggaacataaatgacctgatggagctgaaatgtttggcatgaggcccagtcactagggccctttgcgactgggctcaaggaacacaaaaacgttatcttgtttttcaataactaacatataggaatagattgaaacagagatttctctgaaatgacactacatgaatgcctcaatgaatgcctcaagggggtcacacaaccggttctgagacttggtgaccattgtttgtgtctgtgttcaatttatttcaaaattaatatttaacttttcctccacaaattcccctgtcttgatgaatgggctctgtctaggcaaaaggcctgtctttatgaatcagctctgtctagacaaaaggcaaggtaaaacccttgggctgttacacaacctccgcctcctgggttcaagcgattctcttgcctcagcctccggagtagctgggactacaagtgcacaccagcacacccagataattttttgtatttttagtagaaatggggtttcaccatgttggccaggctggtcttgaactcctgactcaagttatccgcccaccttggcctcccaaagtgctggaattagaggcgtgagccactgcgcctggttctaaatgatttctatttcctgtaacaatttgaaattacttaaaggttgtttcaaattgaaaaaaagaatgtagataaaatataaaaagttaaaaaaattacaagtgattatgaaatatatgtgtaaatctcgagaggtcaaaagtgacaaatctgatttatatataaggttttattaaaattagctttagtattgataatacactattaccaaagtaaaagttgattttctaacaaaaattttatgtattattaatatgacagcaaaatacttctgttcaccttttgaatacatgcaaaaagagagagagtaaaaaagagatagaattttcccttgctctagggtgggcctggctcagctcagggaggaagccctgcctgaaaaggctgcagcttaggctgttactctttcatcactcagcccagcatctgatcacatcctctgtcactcagggactgagtgggcggggccttaagcattatccaatcagagacgctgggctggaaaccgtccaatcaggcaggcagctggagcaaagaggacggcttccgggtttggcgcggcctttgtctctcgctgcatctggagctctaggtcgcctcttcgctactctgtgtcctctgctcctagaggcccaccctctgtggccctgtgtcctgtaggtattgggagatccacagccaagatgccgggaccccttagaagcctagaaatggtgagagtgcccattggacatcctgagagaggggagggactggttgatgggaagtggctgtggagggactcaggcctccccgtagtcagctccacaatctgcgtccggacttctccttacccagctcggcctcagtccccttcagccataagatggtggctgcgctgacagccggtcccggggcgtcctgtctcttccctgcgcagtgaccgtgccctggcctggcgccctctctgtgcagcagctctccacccgcagcttcgggtctctcccagatggtgcgggaaccacgagaaggtcatcaggggagaatcttgactcggggtgcgggttcacgattcggaagagctttggtccgtggggttcacagtttctcttttcttttgttaaaaatttatggggccgggcgcggtggttgacgtctgtaatcccagcattttgggaggcgaaggctggcggatcacttgaggtaaagggttgctaggacaactaaattcctcttcaaagactcaacttcctgatcagaagttgtaaaagttgtaaaacaaccctacccctttttctcccttttccttttctcgcaaatcgctcgtttatcctatttggaaaaagtttgggtctaagccaaccgggatcagcttagattgtgcggtctgaccccagccaataggggaaggacacaaaaacaaaaactacgttggggttaaaaacccattcctggtcgggcgcggtggctcacgcctgtaatcccagcattttgagagacctaggcgggaggatcttgtggtcaggagttctagaccatcctggccaacaccgtgaaccccgtctctactaaaaatacaaaaattagccaggtgtggtggcaggcacctgtaatcccagctacttgggaggctgaggcacgagaattggttgaacccaggaggcggaggttgcagtgagctgagaccgcgccatcgtacttaagtgtgcgtgacagagcaagactccttcacacacacaaaagaagggccaggcgcagtggctcacgcctgtaatcccagcactttgggaggccaaggcaggcggatcacctgagttcgggagttcgagaccggcctgactaacatggagaaaccctgtctctattaaaaatacaaaattagctgggcttggtggcgcatgcctgtaatcccagctactcgggaggctgaggcaggagagttgcttgaacccgggaggaggaggttgcggtgagccgagatcgtgccattgcactccagcctgggcaacaacagcgaaactccgtctcaaaaaaaaaaaaaagtaagaatcttaaaattttcttcctttatgtaaacactgtttgagtaatttcactggatttttcaaacacttagtttcaaaaaccaagtgaataacactgacatggaaattaaagcttgaacctagtaattccaagctaaggctaatatgaagtctgcaaaaggagggggttaaaaaaaattttttttttttgagacagtcttgctttgtggcccaggctggagtgcagtggcgcgatctcggctcactgcaacctccgcctccggggttcaagcagttctcctgcctcagcctcccaagtagctgggactacaggcactcgccaccacgcccggctaatttttgtatttttagcagagacggggtttcaccatattggccaggctggtgtcgaactcctgaccttgtgatccgcctacctcagcctcccgaagtggtggggttactacattttttttattttgacatggagtttagctcttattacccagtctggagtgcaatggtatgatctcggctcaccgcatcctctacctcctgggttcaagggattttcctacctcagcctctggagttactgggattgcaggcacgcgccgtcacgcccggctaattatgtgtgtttactaggggtttctccatgttggtcaggctggtctctaactcccaacctcaggtgatccatccgccttggcctcccaaagtgctgggattacatgcttgcgccaccgcgcccggccaacaggaggttattaaaggcctagttagttttttctggggagcctcgcctgcagatgtcccagcctgctcaccccacccatggaaggagcctttatcctgagagaagctacggagccctggaaagctggagccccacaggtagttaagattaaggtgaaaggaaactgggagggtcttactgataataaagctattgttttgaggcactttttagactttttaagataaaaacgtcagatttatgtaaaaaaatgaattagtattggaacaggagaaagtaccaactaattataaggtctctgtggcttgcaaaaatgtaggcagaaaagggcttttttcctagggaggagcaaacgagattagaaaaaagcggggaggggaatgacaaatggagggtgaaaaagtcagattttagctcagagaatgtcttaccctgaaatcaccgtgttcttagaagggacataagatggggttgtatgttttttttttttttttttttttgagacagtctcactccgtcgcccaggctggagtgcagtggcgcgatctcggctcactgcaagctccgcctcccgggttcacgccattctcctgcctcagcctcccgagtagctgggactacaggcgcccgccaccacgcccggctaatttttttgtatttttagtagagacgggtttcaccgtgttagccaggatggtctcgatctcctgacctctgaccttgtgatccgcccgcctcggcctcccgaagtgctgggattacaggcgtgagccaccgcgcccggccaaaatggggtgtatgttgactcagactgagggtagctcaaaattcaggagcctgagggagggagataaataaagtttgattaagaaatattttattttaggccaggcgcgatggctcacgcttgtaatcctagcaccttgggaggctgaggcaggccgaacacctgaggtcacagcctggccaacacggtgaaaacatggtgtctactaaaaatacaaaaattagccaagcgtcttggcaggtacatgtaatgccagctacttgggaggctgaggcaggagaattgcttgaacctgggaggtgaaggttgcagtgagcagtgagtcaagatggtgccactgcactccagcctgggcagcagagtgagacttcatcacaagaaaaaaaaaagaaatttgaccactgaagacatattcagctgatttttctaatgagaaaaaggagaaaatgtgcagtgtatgtctggctgtgtgacaggtaagaaaagagagcaccatctaagtcataatgggaagggtgtttctgtccatcagctttttctggagtacacaacaaatggagaattttattaatcacaaatgttttccatgattatctatgtgtttcatctttcctcatgtcttttctttgttgtatgcatttcttccttttggcttttcctgggctgcatcttatatattaaaccggtaaacataactacagtgttttgttcagttctgtgaatagctctaccaaattattgaacttcaggaaggtttcaggagtcccgagttttcaaacattagttcaaaagaatagatgggcccatagggtttgtgactggcatctgcagtgaggacaatgttgtgggaccgagggtctatgctgactttaggtgctgtcagaattcaaatattaggcaataagtttgtgttggagaaatgtttgatgttcagcaaactctacagatatggtgccagtaaaaagatatcacagaggcctggcctggaacaaaactctgggtgtttgggattgggaggctccactctcctgtacacaggctgtcacactgcccattgtcctgtgattccaggtcttctcccagggtgacagaggactgaaaacttagagaaaaggagctctgattacagacccccttttattgcagctatcaccacggtgttcccacccactcacaaacacacacactagacattaacgtgtccacactcctcccaggactaggcatcaccctcagaaacttcaccacggcatttttgatcctagtgtttcttgtgtttcttgtcaagaacccacaagtctctacaagtctactggcatgtctccaccccagacactgaatctgcagcagcaacctgttttctccaccatcctaggatctgggccacatgtttataatttcatctgcctacatgcacacagaaataaatcagagtacagccccacctgggccactatctgtagtgaaaatcattccattcacctacattgcactctctcccacccaggaattattttttttcttttagcttttatttttggttcgatgtacacatgtgggtttgttatacagttaaaattatgtcatggggatttgttgtgcagattattttgtcactgaggtactacccatagcaccaaacaggtgtgttttctgatcctcttagtcctcacaccctccaccctcaactaggcctcagtgtctgttgttctcctctttgtgttcatgtgttcttattatttagctcttaataacatgcatttggttttctgtttctacgttagtttccttttttttttttcctttcattttgttttgtcttttgagctggacttttgctcttgttgtccaggctggagtgcaatggtgcaacctcggctcaccacaacctcaacttcctggttcaagtgattctcctgcctcagcctcccaagtagctgggattacaagcatgcaccaccatgtctagctaattttgtacttttagtagagacaggatttctccacgtgggtcaggctgatcataaagttccaacctcaggtgattacccggcctcagcctcccaaagtgttgggattacaggtgtgagccactgcacctagcttttgcctactttttttttttgagagagagttttgctcttgttgcccagactggattgcaatagcgtaatcttgaccaactgcaaccttcaccttcgagtgattctcctgcctcagcctcctgagtagctgggattacaggcacctgcaccactcccagctaattttttgtacttttagtagaaagggggtttcaccatgttggccaggctggttttgaactcctgtcctcaagtgttctgcctgccttggctttccaaagtgctgggattacatgcatgagccaccatgcccggcctgcctactttttaatgaggttgtttgtttttttcttgtaaacttgtttaagttctttttttttttttgtgagatggagtcgcttagactggagtgcagtggcactatctcggctcactgcaacctctgcctcctgggttggagtgattctcctgcctcagccttctgagtagctgggattacagacatgtgccaccaccacaccctgctaatttttgtatttttagtagagacgaggtttcaccctgttggtcaggctggtcttgaactcctgacctcgtgatacacccgccttggcctcccaaagtgctgggattacagtcatgagtcaccacgcccagccaagttcttaataaattctggatattaggcctttgtcagaggcaaagtttgtaaatatttttgtttattttgtagattgtttactctgttgatagtttcctttgctgtaaagaagctctgaagttcaaataggtctcatttgtcaatttttgcttttgttgcagttgctttgggtagcttcctcatgaagtctttgccagtttctgtgtctagaatggtatttcctaggttatcttgcagggtttctcataattttgttttacatttaagtctttaatttatcttgagttgatttttgcatatggtgtaacgaaggggtccagctttagtcttctaaaaaatgctggctagttattctagcaccatttattaaagagagaatccttcccacatttctcttgtcagctttgtcaaaaatctgatgattataggagggtgacattatttctgggctctctattctatttcattggtcttgtgcactcatggattttatataacatctttctctcttctggttttaaccccactaacgttctttcaagcgcatacagtatgcaaaactcaggtgtccaagagttcaaaactccttaaaaacttccaaaaaaaggccaggtgtggtggctcatgcctgtaatcccagcacttttggaggctgaggtgggtggatcacgaggtcaggagatagagatcatcctggctaacatagtgatacccatctctactaaaaatacaaaaaaaaattagtcaggcgtggtggcgggcgcctgtagtcccagctacttgggaggctgaggcaggagaatggcgtgaacatgggaggtggggcttgcagtgagctgagatagtgccactgcactccagcctgggggacagagcgagactccgtctcaaaaaaaaaaaaacttccaaaaaaatttttgccattgtctcatttcttaagggatttagattatatatagttatttttctctgatttttaaaaatatatgtaaattatattaacagctaaataccttttgtcttttttctgactccagattatctagaacttcagatttattgctttgtttttggttccaaaaagtttattttttaatttttagtcctttaaatagacacagatttatttagataaaagctaattttaagggcacacagaagcttagcacaaagataggatcaaatttagcaatacataatggtaaacattaaaagatactatgtttctttgacagaaaccagattatccaaggaaattatccaatatttgcaggctgaagtacttatactgcaaaaagaagaacagttcagtgcgtaaactgaacagtggagtctgtagttgtgcctggctttctatttattacttcagaataattagcatagttatgtgtaatgtttgtagacaagctgcatttatatacatttaacagtattttgtttttctttctttctttcttcttttttttttttgagagagtctctgttgcccaagctgcagtgcagtggcatgatctcatctcactgcaactgctgcctcccgggttcaagcgattctcctgcctcagccttccgagtagctgggattacaggcatgcatcactgttcctggctaagtttttgtatttatagtagagatggttgtcaccatgttcgccagtttgatcttgaacttttcacctcaggtgatccacccatttcagcttcccatagtgctaagattacaggtgtgagccataaacagtattttctaaaatagtatgaatataaagccacaatacttactttgaatgaatcacttaaatggttattttaatattgtaatttatacttttgaaatatagtgttttggctgaagtatagttttaattattaaaaatgctacatatattatgactagtgagtaaacacaattttagtgtcttttatttcattaaattggtatgctgctattacaggacaaataaagacatgtgatgtggccacccaaaaaccataatagctcttcagtttgctatgttgcaagttctaatatattccactatatgaacatagtcagattctatttcttcatcaaaaagtgttgttggaagttgtcagatgtatttcaatatagaacctccattcaatggctaggagatgacagaacagcagagatgggaaagaaactttataaaaattcttctgaaaatctgccacctttcttcataatgctcatgtttctcttgctgagagtagctgtgcgctttgggtgtttagagagaaattgcttttaggagaatattttctggcagacatgatcaattttatatctaatctgagctttttcctaatatcattttaacttttttctctccagtgctttgggtgtctgtttcagaagccctattaatttttttttttttttttttattgatcattcttgggtgtttctcgcagagggggatttggcagggtcataggacaacagtggagggaaggtcagcagataaacaagtgaacaaaggtctctggttttcctaggcagaggaccctgcggccttccgcagtgtttgtgtccctgggtacttgagattagggagtggtgatgactcttaatgagcatgctgccttcaagcatctgtttaacaaagcacatcttgcaccgcccttaatccatttaacactgagtggacacagcacatgtttcagagagcacagggttgggggtaaggtcagagatcaacaggatcccaaggcagaagaatttttcttagtacagaccaaaatgaaaagtctcccatgtctacttctttctacacagacacggcaaccatccgatttctcagtcttttccgcacctttcccccctttctattccacaaaacagccattgtcatcatggcccgttctcaatgagctgttgggtacacctcccagatggggtggtggccgggcagaggggctcctcacttcccagtaggggcggctgggcagaggcgcccctcacctcccggatggggcggctggccgggcaggggactgaccccacctccctcccggacggggcggctggcctggcgggggctgacccccacctccctcccggacggggtggctgccgggcggagatgctactcacttcccagatggggcggctgccaggcagagggtctcctcacctctcagatggggcggccaggcagagacgctcctcacctcccagacggggtcgcggctgggcagaggcgctcctcatatcccagacggggcagcggggcagaggcgctccccacatctcatacgatgggcggccgggcagagacgctccttgcttcctagatgggatggtggctgggaagaggtgctcgtcacttcctagatgggatggcggccgggcagagaccctcctcactttcagactgggcagccaggcagaggggcccctcacatcccagacgatgggcggccaggcagagacgctcctcacttcccagacggggtggcggccgggcagaggctgcaatctcggtactttgggaggccaaggcaggcggctgggaggtggaggttgtagccagctgagatcacgccactgcactccagcctgggcaacattgagcactgagtgaacgagactccgtctgcaatcccggcacctcaggaggccgaggctggcggatcactcgcggttaggagctggagaccagcccggccaacacagcgaaaccccgtctccaccaaaaaagtacgaaaaccagtcaggcgtggcggcgcgcacctgcaatcgcaggcactcggcaggctgaggcaggagaatcaggcagggaggttgcagtgagccgagatggcagcagtacagtccagcttcggctcggcatcagagggagactgtggggagagggagagggacagggagagggagagtcgaagccctattaattaatcccatgatttctgattaagctaggctgtcacagtgagaacttttggagctatctctatctggactcatgctggaaattcagcagtattttttccttgtcaccattataagtagaaactgaggttgaaacactgctctcattttcattattgtgaatgtgtaattctacccaggaggcctgcaggctctcctcctgcagctcaggcctcactctctgatgtgacactagagtgctgctgtggcaaatggggttcatataaaatgtgagctgtgctctgggctgtgcctcagtggcagatggtagaggtcaagagagcatactagcaaccaggagaaagcaagcaggagtgctgtagcccactgccagtgagtacagagccactcctctaaactgtaactagccaaaatatagaacactattcaaccatttttgtagcagagtgaaatcttagcttcagcaggtacctgacttcaagctgctaaaataactcctgttatgaagatgtgaaaagtttatttgtcattgaatataagcaattagcatacacagatggcctcttcaatttccaggtagatttaagatgaacgatgtatgacatggtgctttaaattcttctacttatggactaattatgttgaccatctttctgtcattgcagtctcttaagcagatggactatgatgcatgtcacattcaagtttaattgtaaaataaaaacgtttgttttttgagatggagtttcactcttattgcccaggctggagtgcaatggtgcgatctcagctcactaaccccgcctcccaggttcaagtgattctcctgccttagcctccctagtagctgggattgcaggcatgtgccaccatgcctggttaatttttgtattttttagtagagagggggtttgtcagtgttggccaggctggtctcaaactcttgacctcaggtgatccacccgcctcggcctcccaaagtgctgggattacaggcacgagccaccacacccagccaaaacgttttctttctgttctattattgtggagtttttctggggctgtaaacatttgttctttttttttgagacgaagtctctcatcccccaggctggagtgtgatggcgcaaacttggctcgctgcaacctctgcctcctgggttcaagagattctcctgcctcggccctttgagtagctgggattacaggtgcctgccaccaggcccggctaattttttttttgtatttttagtagagatgggttttaccatgttggccaggctggtctagaactcttgacctcaggtgatccacccgcctaggcctcccaaagtcctgggattatagacatgagccaccatgtccagcgaagaaaattgttcttctcttttttttctttttgagacaaagtctcactctgtcacccaggctggagtgtgctgtggtgccttctcggctcactgcaagctccacctcctgggttcatgccattctcctgcctcagcctcctgaatagctgggactacaggctcccaccaccacacctggctaattttttgtatttttagtagagatggggtttcactgtgttagttagatggtctcgatctcctgacctcatgatctgcctgtctcggcctcccaaagtgctgggattacaggtgtgagccaccgcgcctggccaaagaaaattgttcttctaattattgtttccaaacactgtctagaattaccagacatgatataaacacataaggtgccaaccagaatttagcaaggcctttccctgtcaggcttccagtcaattcacacttgtgcagcaaagtgcatgctgtcccctaaatatgcaggcagaattgtgtctctatttgttatctatagtcctgtacattcacttctagagaggctagatcagatttctacaaatttcatagggcagcaatcaatcattttatctctttcaatgactcctgtatcttcagacttgaaacagattcagagaccatggggcccacaaacccagttagagtaacatgtgtgcattgagtagacatgttgacaagagaatctccactttcaccttcctcctcttgctaaaatgctcacaaatgtgcaggtaacacctgctgctcctcctgccattcaggccctaaatctacagctctatattttgaatccagatcttgagatttgggaaataaaaaacttttgtctaaataaagcaggttcttttggttatcaaactcagagacatgttaaaatgaaagtgcagttatgtctttctcccactttgaacgatgtattcatctattgaaactgttcactattggcacaagtgactataaattaaactaatgatgccacattggacactatcccatgccctaaaacataatgatagatatctaatcaataatcaatgttatttatgtaaataaataaaaacttttgacaaacaactctgcatcagcccactttctgtccctgtcttgtcttgacatatcttcctgtaaatactactaatcaaagtgtagattccaggcaacttgaatctttgctcccaggttataacccttaagcttgacccaaataaactgtctacttatattcatgttatgtcaccttttttttaaatgtagacttattatttagaatgtgttagagcagcctctatgagagctctcttttgactgtactccacttggtgtaacacaaaaggatgcagagccaagttgatcctacctagaatttgcagataaggtctgccctctgcctgggatttaaaaaaaaaagccagactttggatagagaatgtacagaaaattaacaaaagtcattttctgcattgtaagttgtcaagatagatatcttacaggccccatttgggagtgtggcattttgagatttttcacatcttgttcattggcctgctacagtgatgtgagaggctccaggaggaaatagaatctgatggcagaatctgtaagtgtaaataatcatcttaggagtgagagatcaaggccacaaagtatccagagccttgatcacaactataattacctgtaaaatgtgatactggagtagagtatttttgtttctttctctcatccaagagctagcaaatcaggacagatgatgtaggttctggagctccaccaaggcagttgttttctattcagaatcagcctgagtttctccagatggcttatcattgggccaacagccctggttcaccaggaattccctcacaatcacctaggtgtctttgaggcatttgaggatgtccagagcagaattgtgttaggctgacaagagtggttaattctgcttctgtctcagtgtaagagaaatgagtcatcctgtgttcattcatgccctcatacaagaggtgccttttttggtacccagatcagagtttctccagtttcctggtacttggatgataaacaaggaggagatctggagacccaaatagataaactagttgcttccatttcatatggccattaaaaaaatacgtgaagcagtcatggttcctacagtccagaaacttttagtctagaccagcaactggataaataattgaattgtgcattgtatggttggcacaatatatagatgtgtccagaaccttgggttttatttaggccactttatgccgttatgacttctgaattgtacacctgaagggatatttatgaatagaataattgttattataattttttttctttagtcagaatctcactgtgttacccaggcatgagtgcagtgacatgatcttggctcaccgcaatttctgccacttgggttcaagcgattctcctgcctcagcctccaaagtagctgggattgctggccccagccactgtggtcaggctggtcttgaactcctgacctcgtgatccacccaccttggcctcacaaagtgttgggattacaggtgtaaggcagtgcacccagctgtataatttctacttttttttaccttctaaagtgtacatattgattttctaataaaattaccctagaaaaccttaagggatttgtttaaattgtgtattagtatatagtataaagttgacagggcagtggctagaaaaattaaaattataggaactctgggatttaagtttcttttaggtaagcttagaagaaacaaaactggaagtaccccagtggcatagagaacagaattctacataagtcctcacactgcctgagacctgatcagattcatgctttttggaggcgttatttaggtctgaccctaccctggagtcttgcctcacaggactgattagtagagatcagagttttggctggtgaatcctgctgcctttctagagctggtgctcacaattccctgaatcccaaaagcagatgaaagggaaaaatagtccgggcgcggtggctcacgcctgtaatcccagcactttgggaggccaaggcgggcagatcatgaggtcaggaaatcgagaccatcctggctaacacggtgaaaccccacctctactaagaatacaaaaaattagctgggtgtggtggtgggcgcctgtagtcccagctactgaggaggctgaggcaggagaatggcgtgaacccaggaggcggagcttgcagtgagcccagatcgcgccactgcactccagcctgggtggcagcgagactccatctcaaaaaacaaaaaaaaaaaaagggaaaaataaagtacgtattttagggtcttagtttttaaattttctgttaaagccagtgtttgcagagacattctatttagcaacttgttttctattcttgcagatccagtagttgctccacaagtcacagaaaagtaaatatgaacagaataaaattttctctaaattacattaaattattcctttctatctctttcatctgtctatattttgcttttacagtgttttaaaaaaattcatgacagagaaacagaagaagaaataaaaatgccgcaccctttacctaaatcctaaagtttattaaacacttagtaccagctttcagggtgttatgagaattaaatcacagaatgtgctatgcccagcacagtgctctgtatcattctcttgagcacaaagtacctgcttaataaacattgcattagtacttgtgtacatgttgttttttaaatacagacttactctgtcatttctgccttcagtttcctctataaactttaaagagccagcgaagcatataaaactttagggtggagatgcgttgtccctatttgtatcagaagtatttggttgtgaaaagagtgctaaatgtaagggaccctgtgctgttcctgctttctctaactaatgctaataatgagccaaggggaagcaacttcagcattgacaggggacttgtttaaaacacccattcatggacccttttcaagcctccagaatcacattacataaagtggacccaaaattaccaagtgatttataagcccattaaagcttgagaggcaatgcttagcttagtgattaccagcccaggcttttccttaggaacacatggccaatttgcagaaacctcttgtgccctccccacagcttctgtttgttctgcatggaagcacttatgttgttttaatgaagggtctcatgtgactctaaggtgaggccagaatcaagtatgagcacttcaaaatacaatacaaaggagttaagttccacctttgcactaaagggtggtcacagggcctgttctgtttgggtttggtacagacaggtcagtgtggtgcataattccattactggaaattgctggtgtctgtggcagggagggcacctgaggacaggaaatgagaaacttatatttctatcttcatggagcaattcattgttccctgaatctcttctgtttcaaaggacagaaataggtgggctttttctgtcattttgccagttgatgtcatgccagcaggtaatcatgtgttactgatacctttaaaggcatgttctcaagatgcaggtgtaatttttccagagaatctcatctgagaaggaattccagaggaggaggaggagaaaaaaaagtggctcttcttaaggtaaacgtgtctcagatgaagagctgtgtccactctgcctcctggacccccatgagtttagtactcacaaacctttacttctctacttgtgttttccctccctgagtttggttttactacttaaaattcttatgatagtcaagggtctctgaaaaatatttctttcctatatcccagagctttctctgcattctctatgtcatagcttcttatatgccatgcagaattctcagcaagaatttgtaatctgcaatattaaaaatgttccctttgtggctgttgaacatggaaagatgtggatactcaagatttctgttggggaaaattgtggtccttagtatagatgaagaacatgtaatgttgaggcttcatctgtatgttccattagctctatgcagaacaggattaagaaaatgcttttttatatggaatggcatttattatccagaaagttctgaaagaaattattaggagatacctgctctcttgggtgctaaatgaagcctacttaaaattactactaaaaattacagaacataggagttatcaaaaactttgaagttagcataaaacatgtttctttatggttaaattcagattttatttactttctttgggaggaatatttcaacagtgatgctgtgttcttctgtgtgaattaggacatcataaaaatttatcgtagtgcagttaatggttaatgattcagttggtgaaatagctctctgacagatttttttcactatagagataattatttttctattcattattatgtttatgcagctgatatgcataaacctcacattaaatctggcagctttcttttttaaacatatttttcttagggaaatgaagcctcttatctttgtttacaggctagaaaatctgaaaaaaacacaggctcttgcacttactgcatttgacaaaatatcatttttgggacaaaaacattaacattattggtgagcttgttagaaattcaaaaaatcagactttatgccagatcttttggaaaaaaaaatcctgcataagaaggacttcagcttattgtacatgttaaaattggagagatgacttctaactcaacatgtcttttctgtctgaaaaatattcataactgattctgtatgatgtaaatatagcactcaaaaatgtacatgttcatgttcatgccctttattttatactttattatctagaaaaatatcattatatgaactaatgttgtggatcttaggctgctcttttttttcagagatagagaatacattagaaaatatttctgtattgaaaattattttattggataattttagtcaatcctataagtaagaatcagttctcttactctctcatttcaccttaaattaaaaattccaccaacggcgacttggtgaaaatgtgtgtgtgtgtgtgtttttcaggaatcattgcaatttagagatgtggctgtagaattctctctggaggagtggcattgcctggacactgcacagcagaatttatatagggatgtgatgttagagaactacagacacctggtcttccttggtgaggataacttaaatacataattcataaaaaaccccaaaagttttatttctcttttttgcagaatgattttagtaatttatcctttgcataaaagagttccagatgtcctttttccagaaaatcttcagaatttgtttatttagaaaagaatttcttcaagatgtttcatcttaatccaaactttccacattgctgagttgagctttattcttcactctaaattagtggtaatttcagaaatttagtggcataaaatagtgttgccctcagctgaaaatctcattgccaccatcagtttttgattcagtagtatcaggtagtaaatttaaaaagccttcatgcagggccaggcgcagtggctcatacctgtaattccagcactttgggaggctgagacgggcagatcacctgaagttgggagtttgagaccagcctgaccaacatggagaaaccccgcctatactaaaaatacaaaattagtcgtttatggtggcatagtcctgtaatcccagctactccggaggctgaggcaggagattcccttgaacacaggaggcagaggttttggtgagccgagactgagccattgcactctagcctgggcaagaagagcaaataccactctaattttgataggaagtttattgaatctatagatcactttggataatgtggcaatttaaaaatctatttggatcttctcttcgtagatttttattgtaaagattttttaccttcttagtaattttttaaagaaatttattatttaatggtatagtaaataagattttttctttctctattttatcagatagtttaagtgtttgagaccatacatatacttgtatgttaattttatgttttgctaatttgctgagtgtatttgtcagtttagaaaggttttaaggtattgtttatgttttttttttttttttttttttttgagatggagtctcgctctgttgcccaggctggagtgcaatggcatgatctcagctcactgcaacctctgcctcctgggttcaagcaattctcctgtctgagcctcctgagtagctggtactactacaggcacgtgccgctgcacccagctttttgtattttagtagaaatggggtttcaccatgttggccaggctggtctcaaactcctgaccttgtgatccacccatcttggcctcccagagtgctaggattagaggtgtgagccactgcaactggccctatttatggtttttaaagtactgcttaatgttttttaaatataagattgtatgatctataaacagcaactttttacttattttactccatctccaaaaaaaaaaaaaagaaaccttaaagttgaaagtattttctaaatatttagaaatttgttatgaattagtattttggtattaatttactagaatattttattacattctttctgctgagcacattactagcttgtaattgagaaatataagcaagattaatgctatttatttttaatgaaacaggtattattgtctctaagccagacctgatcacctgtctggagcaaggaataaaacctctgactatgaagagacatgagatgattgccaaacccccaggtaggtgcgaatgaaaatgaacacaacagacaatgcagataagaggtcccaaggtcaaaaagaaagccagtccttaaaatgtgatctgggaagctgtgttccaaaggaaatagttcctgggcagctgttttatttatttatttatttatttaatttttctctcacaaagggacatctgtctcatgcttttaaattctctaaggattctactattctttcggtgagcttccttcaagttcacagtgagagcgaaattcctctttatggcatataagtgattgcacaatctggctgcttttccgttgccttggggacacacaaatatctgcgtgattttgagaaactaaaacccttttttaagttgtctttttgcttcagatctgaaatgtgtgacagtattagtttttgttgcattttttgttcattttttctgcacagtccattctgtttttattactatatagtcttgaaatatagtttgaaattataagtatgatatccttctgctttgatctttttcctcaagattgctttggctatcaaagttattttagtatcacgtaacttttagaaatgtattttccattactatgaaaaaaataccactgcaattttgataggaggtttattgaatctatagatcactctggttaatacggcaattttaaaatttatttggatcttctctaatattttcataggtttttttttttttttttgagaaggagtcttgctctgttgcccaggctggagtgcagtggtgtgatcttggttcactgcaaactctgcctcctgggttcaagcaattctctgcctcagcctcctgtgtagctgagattacaggtgcatacaaccatgcctggctaattttttttgtattttttgtagagaggggtttcaccatgttggccaggctggtcttgaactcctgaccttgtgatccacccacctcagcctcccaaagtgctgggattacaggcatgagccaccccgcccggcccatagtttttttattgtaaagatttttttacctccttggtttttttctaagaagtttattacttaatgctatagtaaataagatttttttcttcctctattttatcagtttgttttaagtgtatgagaccatacatacacttgtatgttaattttatattttgctaatttactgagtgtatttatcacttcagacaggttttaatgtactatttattgatttttaaatacaagattatacgatctacaaacagcgactttttacttatttttctttaatttcaatggatttttttatttctttgactaattcttctgccacatgcttccagtgctacattaaaatagaagcattgacaatgggcacaatatagttttgtattggtgcctaaatttgatggagcaaacacctcttcaagtttttttttttttttttttttgagagagtctcactctgttgcccaggctgcagtgcagtggtgcagtctcagctcactgcaacctccacctcccgggttcacgccattctcctgcctcagcctcccgagtagctgggactacaggcgcccaccaccacacccggctaattttttaaaaatttttattagagacagggtttcaccgtgttagccaggatggtctcgatctcctgacctcgtgatccatccgcctcggcctcccaaagtgctgggattacaggtgtgagccaccacgcctggccttcaagtttttataaactgattttagaaggtaaagatcttttgttgggcccttagggtgatgagatgccctctgaatttgtagtggagagggggtgtagcttggtgacaaggctgctgggtctgcactagggtccacctttagttggcttgttacaggggcttgggtagttgtacttctcattttatttttggacagactgcatatccttcagggctttgctccgtagttaaaacactagggtatgtttttgtagtcaggtctgcatatggtgggccttatatctggatattgatgagtatggcttttattgagtatcagagagcattccctcagataactgtgggtttctatataggcagaactgaccataaactatcttgtttaagtgagtagtcatggagatagtcttttttttcaccatgtgtttaatgatgaatatatatttccttttgtgagagaaatacttgtttgatttgaaggtaattttcaaaaagatttataattctggattttttttcagtttttctttaaaaaaattgttttaaaaacacataacataaaatttaccatcttaattcaagtgtacattttcagggccaggcatggttgtggctcccatctgtaatcccaggattttgggaggccaacacaggaggatccctggagcccaaaagtttgagaccagcctgggaaagatatggagacccctctttataaaaataatttaataattgccaggcatggtggtatgcagctgtggtacctgctacttgggagatggagggggagtcaaaattgtgccactacactccagcttgaatgacagagtgagaccctgtctccaaaaaacaaaaaaaagctgttcatttcaggcatgttaagtatattctcattgttatgtaaaatacttctagacactttacatcttgtaaaactaaaactcaatacccattaaataacaactgctcattttaccctctctcaccctcgacagacaaaccttccactttctgttttatgatttgactacttaagatatccataattttgttactggattaattcaagtgacataatattctcaatgttcatcttaaaatgtgacaagattattctttttaagatggaataatattccattgtatgtatatgttacatattttgatgtgtttataaatcaagagacatctgggttgcttcaaccttttggcttttgtgaatactggtgcaataaacatggattttcaaatatgtcttccaggtcctgtgttgcttttctttttttctagagatggattctcactctgtcacccaggctgaagtgcagtggtgtgatatcagctcactgaaacctctgcctcctgggttcaagcaattctgcttcagcctcccaagtagctgtgattacaggtgcccaccaacacacccagctaattttttgtatttttagtattatggggtttattatgttggccaggctggtctcaaactcctgatctcaggtaatcacccaccttggcctcccaaagtgctaggattacaggcttgagcacctgggcctggcctgtgttacgtattttgtaaatagatataataagtgaggaacatttataacatttttaaataatggctgcatctttgttttccagcaagaagcaacatgggtttcatttttattgcaacatcaacagattgggtgtttttaaaaaaatttacagtggccattctaatggatatgaggtgattttgtttgtcattgtgtttttttaatttctctacaaatcagtaattttgtgcattctttcaaatgctttttcccatttgtgtagttttttgatgaaaaatctttttgttcatttttaaatcaagttattgaactttattgattagttttaagagtttttatttattttgaacattaacttccttcacatgaaatctgcaaatgttttcatccattttctaagggatgttgccacttttgaattttcttttgatgtacagaaattttgatgtctagtgtagttaaacttttcttgtatttgttgctcatgcatttaatgtcgtatctaagaaaatggtggcaagaccaatgtaatgtccttttcctgtattttttctaatagatttgttagtttctttatgtctaagtattttgtttaaaatatatttttgtatcgttcaaggaaataacccaattttattttatcagtgttgatattcagttttcaacatcattttttgaagatattacttttctctattttgtactcatagcaactttttgaaagaccatttgatcatatatagaagggttcatttctgagctctctattctggtctttcatctgtttatctttgtgtcagtatcacattgtttatgttactgtagcctttaactgtaggttgtattgacatctgtgaagaataaaattttttgacccctgagcaagaatatgttgaatcagagtgttttatattcacatatttttgaatttgccaatttaccttttgcttttaattcctagtgtcattcagtttttgttagaaaacacacaatgtataattttagtgtttttaaattgatttgttgttgttttaagacaagatcttaccaacaccaaggctggagtgctgtggcataattttggctcactatagcctcagcctcctgggctcaagtgatcctttcacctctgttttctgaccagcttggactacagacatgtactaccatgtctgcctaattgtttgcttgtttgcagtgttaggatctcattatgttgtccaggctggtctcaaacttttggccctaatggatcctcttacctaggtctcccaaagtgttagggttataggcaagagccactgcaccccgtcagtacttttaaatttaataaaacttggtatgtgtcctaacagattataccagatgcaaataagaatattgtgtattatcttggttttgactggagagttttgcttgtgtctgtgaagcctagttggtctataatatggtttccatgttcatgttctccagacctcatgctgcaaaataaatcttcaatgttggatgtgggacctggtgggacatgtttgtgtcatggaggcaaatttctcatgaacggcatggtacatcctcttggtaaccaaaactttacactctattaattcaaatgagagctggttcattaaaagaacctggatccttcacctcacacttgctctgtttcattaacatatagtatgtccaattactctttaccttccaccatgattgtaagtttcctgaggccctcaccagaagcagatgctagcacacacttcttatagtctgtcaaactgtgagccacataaattatttttctttaaaaattatgcacttggctgggcacggtggctcatgcctgtaatccctgcactttgggaggccgaggcgggtggatcatgaggtcaggagatcgagaccatcctggctaacatggtgaaaccccgtctctaccaaaaatacaaaaagccgggcgtgctggtgggcacctgtagtctcagctacttgggaggctgaggcaggagagtggcgtgaatctgggaggcggagcttgcagtgagctgagattgctctactgcactccagcctgggcgacagcgagattccttcaaaaaaaaaaaaaaattatgcactcggctgggggcggtggctcacacctgtaatcccagcattttgggaggcccaggtgggtggatcacgaggtcaggagatcgagactctcctggctaagacggtgaaaccccgtctctattaaaaatataaaaaaattagccgggcatggtggtgggcgcctgtagtcccagctactcgggaggctgaggcaggagaatggcgtgaacctgggaggcggagcttgtagtgagctgagattgcgccactgtactccagcctgggcaaaagagcaggactctgtctcaaaaacaaagaaaaaaagaaaaagaaattatgcagtctcaagtattcctctgtatgcaaaataatatggtctataatgttgcgtaagttgtctgtttctcattttttctctgaattttctatttattattgcaaatggggtcttgatgtctacaatttttatgttgctatgtatgccttgcttcacttttgtcaatatttgctttatatattttggagccctgatgttatatacacatatacatatagatagataaataatatagttaccgattcctggtaaattaactcactttaccataatataatatcattctttgtctaatggtagtatttgacctatagcatattatgtctaatataattgtgaccacctcactcaattgtggttactatttttatgatatacacatttttttccttctgttactttcagcctatttgactcaatgctacaatgagtctcttgtaggcagcatactgtatgcttttaaagaaaccactgaggcattctatagctttttcttcatatgtatatatttatttatgtatttattttgagacagagtttcacttttgttgcccaagctggagtgcaatggcgtgagctcactgcaacctctgcctcccaagttcaagtgattcttctttgtcagcctcccaagtagctgggattacaggcacctgtcaccatgcccagctaatttttttgtattttaggtagagatgggattccaccatgatggccaggcttgtcttaaacttctgacctcaggtgatctgcccgcctctgcctcccaaagtgctgggattacaggcatcagccaccacgcctggcctcatttaactttgagatagggtctcactctgtcaaccaggctgatttgcatgattcactgatgccagaacctccaaaactcagatgatcctctcattttagcctctcaaacagctgggttacaagtatgtgtcatcatagccatctatgttttttgtattttttgtagagacagagttttgccatgttgcccaggctggtcttgaactcatgggatcaagtgatgagcctaccttggccttccaaagtcctaagattacatttgattttattaagtagtataattaatttatatttacaatgaataaacaaatgaagttgtcattagcagttagattgttactgttttatgtgtttctagtagttatatttttctcatctcctgttttactttcttaattttcattttattttgtactggcatgctttcattactttttatcttcttttgcatactttctataaatattatctttgtaatcatcttgaaaactggagattacatacatcttaaagttaaaacaatatgtttcaatctcataacttcaactgaatacaaaaactatgcctctatattttatggtttgttactgatataaaaattattttatatggtgtatctattaacatttatgcagatttacatatttcttatattttattaaaaaactttaaagtttttatgtaccatcttttttttttttttgaaactgggtctcactctattgcccatgatggagtgcagtggtgtaatcttggctcactgtaacctccaccaggcatggtggctcatgcctgtgttctcagcactttgggaggccgaggtgggtgaatcagaaggtcaggagttcgagagcagcctggccaacatggtgaaacgctgtctctactaaaaaatacaaacattatccgggcatgctggcaggtgcctataatcccagctcctcaggaggctgaagcaggagaattgcttgaacctagaaggcggacgttgcagtgagccaaggtcacaccactgtactccagcctggacaacagagcgaaactccgtctcaaaaaataaaaaaaaatatgtcttttgattggaaagatgattatatatatatttaaatcgttttctgcaatagaaaaacttactgttatttttattaattgttttatttgattcttctatctttttcactcattttctgtcttttttgtgtttttttaattttttgtattgatatgctttcagtttcttattttcttttgtgtatctatacagctattatcttagtggtaacatgggggattacataaaacctaaaagatccaacaatatatttgaatgtggtaaaaaaattaacttcagttatatactgaaattcttcatcattacatttgccttcaactttgttactgattttgctaattatattttttatgttgtatatttattaacagatgttaacaataatttctatacttttatcttttaaatttagagagtattaaaaatgttttctgtaccattatgatgttaagaaattccatttttgtgtatgtggatatcttttccagaaagttatgtattttcatagattatctgttgttttcttgcattatgttattttcagtggaagaaactccttttagcatctttgatgtgtatggtgtatgcagtgccaatatactttctcaggatttggttattttggaagcacttgttttatttggtagtacaattttgctgatggcattattgcatttgacagctttttaaaaaaattattataactttagcaatatcacagtttttttctgacgtgtaagaatgttttaaataaattcactggtgccggttgtggtggctcacgtctataatcccagcactttgggagactgagacgggcagaccacctgaggtcagaagtttgagaccagccaggctaacatggtgaaaccctgtttgtactgaaaatacaaaaaagtagccaggcatggtggcgcacgcctgtaatcccagctactcaggacgctgaggcaggagaatcccttgaacccgggagttggaggttgcagtgagccaagattgcatcattgcactccagcttgtgcaacaagattgaaactctgtctaaaaaaaaaaaattctctggttatctcatgagactatgcttataaatggaacatcatttttatcttgtagcacccaaaattctattcttatatgtgatttttgaaattttgcttatatatgtgtttgttataaatatatttgtgtgtatctaagtttgttcattcagctttttcatgtttacatcatattttcttttaataaatttttcagttttttatattttttatatccacgattttcggttttttggtattttagtatttctttttatagttgtctgggtttctatttttttcttatacagagtctttttctgtcaccgaggctggagtgcagtggcgtgttctcagccaggctgatcttgaactgctgacctcaaatgatccacccacctcagcctcctaaagtgctgggtttacaggcatcagccactgcacccaacctttttaattttatttttgagacagtgttgctctgtttcccaggccgcagtacagtggtacaatctccactcactgcaacgtttcccgcctggattcaagcaattctcctgtgtcagccttacaagtagctgggattacaggcacatgtcaccatgcccagctaatttttgtatttttagtagatacagggtttcaccatgttggccaggctggtctcaaacttctgacctcatgtattttcccaccttgatcttccagtgtgttgggattacaggaatgagccaccaacagtgggatgttcaattcatttggaattttaaaaattactttgtatactttttatggttgcttttgaaaagtttataatttttttgatggggccatgttctaatatttggtatacattatcatctttgatagagatttggaaattaacaaaaagctacctgttacaatctttataatatagctttgtcctggcgtagcatgaaatcaattgtcttggctagagattctgggaatttttcaaacatgtttttaggatgagtcttgtctaaaattttgtgtttattgtttagttaaatcagcttattcatatctcttcttaatagtcagtaatcacctgctacacccattccctgtttgcagtttctctgcttctctataatttacctttagactcagcaaactcaaactgtcattccaatgtatatcaccatttttttttagcattttatgtcatgggacacattatctggtgtctaaaaaagcccctagaagacaaataaagatgtatgtgccaatgtttcttgttttttaaaaaggaaaccaggagttggcaatttacatttttgtgtgtatgtgtgagacagagtctcattctgttacctagtctcaagtgcagtggcatgatcttggctcactacattctctgcctccacagttgaagcaattctcctgcctcagcatcccaaataggattacaggtaactgtaaccatgcctggctaatttgtttgtattttagtagagatggggttttaccgtgttggtcaggctggtctcaaactcctgacctcaggtgatcctcatgctttgccctcacaaatttctggaattacaggcatgagctatcatgccttgttggcaatttactttaaaaaaaaatttttttttgagatgaagtcttgctctgtcgcccaggccggagtgcagtggtgcaatcttggcttactgcaacctccgtctcctgggttcaagaaattctcatgcctcagcctcctgagcagttggaattacagcggcccatgaccatgactggctaactttttgtaattttagtagagatggggtttcaccatcttggccaggatggccttgaactcctgacctcaagtgattcacccatctcagcctccgaaagtgctggtattacaggaatgagccactgcaccaggttggcaatttacttttaaaggcacaatgttatactggagagcaggaagagctgttgcatataagtaacagaattttctttatcttctatgtgactgtttgcattgtgctcacctagggactttcacacacttaaaactcacttataaattttttacaaatgtattttggtcagtatgtttttgttacctttatatgtccaggaagaaattacagcttgtggcattttgctatgtcatcttgcttatgtagtttgtataattttataggttagatttgtaaagtatatttatctgagtctagcaattgaagtaatgtgtttttattgtttctttcagttgtgtgttctcattttgcccaagacctttggccagagcagagcataaaagattcttaccaaaaagtgatactgagaaaatttgaaaaatgtggacatggcaatttacactttaaaaaaggctgtgaaagtgtggatgagtgtaagttacacaaaagaggttataatggacttaaccaatgtttgacaactacccagagcaaaatatttcaatgtggtaaatatgtgaaagtctttcatcaattttcaaattcaaagagacataaaagaagacatactgaaaaaaaacctttgaaatatatagaaggtgacaaagcttttaaccagtcctcaacccatactacacataaaaaaattgatactggagagaaaccatacaaatgtgaagaatgtggcaaagccttcaaccggtcctcacaccttactacacataagataactcatactagagagaaaccctacaaatgtgaagaatgtggcaaagtctttaagtacttctctagctttactacacataagaaaattcatagtggagagaaaccctacatttgtgaagaatgtggcaaagcctttatgtacccctatacccttactacacataagataatccatactggagagcaaccctacaaatgtaaagaatgtgacaaagcttttaaccatcctgcaactctttcttcacataagaaaattcatactggagagaaaccgtacacgtgtgataaatgtggcaaagcctttatttcatcctcgatccttagtaaacatgagaagattcatacgggagagaaaccctacaaatgtgaagaatgtggcaaagccttcacccgctcctcacaccttactatgcataagataattcatactggagagaaaccatacaaatgtgaagaatgtggcaaagcctttacatggtctgcaggcctccataaacataggagaactcatactggagagaaaccctacaaatgtgaagaatgtggcaaagcgtatactacatcctcaaatctaactgaacataagacaactcatactggagagaaaccttacaaatgtaaagaatgtggcaaagcttttaactggtcctcagaccttaataaacataagagaattcatattggacagaaaccaagaacgtgacaaaggattattttattattattatttttttgagaggtaattctgctgttgtttcccaggctggagtgcaatggcataattttggctcaccacaacctccaccttctgggttcaagtaactctccttagtagctaggattacagggctgcaccaccacacctggctaattttgtatttttagtagagatggggtttctccatgttggtcaggctggtctcaatctcctaacctcaggtggtctgcctgctttggcctcccaaagtgttggggttacaggcatgagccactgtgcctggctgacaaagctttttaaggaagttctcaacccttattacacataattcatactggacagaaaccctacaagtgtgaagaatgtggcaagcctgtaacaagttctcaattcttttatttttatttgtttatttattttttgagatgcagtttcactcttgtgacccgggctgtagtgcaatggcatgatcttggcttactgtgacctctgcctcctgggttcaagccattctcctgcctcagcctcccaagtagctgggattacaggtgccaccaccattcccagctaatttttgtatttttagtagagatgggcttttgccatatttgccaggctggtctcaaactcctgacctcaggtgatccactcgcctcggcttcctaaagtgctgggatgacaggcatgagcctcaattcccagccataagctcttaattcttaagagacatggcgataattcatggtgaagaggaactttacaaacctgaaagatgtgacagtgcttttcccaacacctccaacttttctatgcataaaaaaaattatactacaccatagaaatgtatgaaatgtgacaaagcctttatatggttgccacactttattgtaggtaattcatacttccaaaatacctacaagtatgaagaatgtggcaaaacttttaatcagtgcttacaccgtatttcacaggaaagctattatccttgagaaaaattgtacaaatataaagaatatggaaaagccattaatgtccatcacatcttactcaacagaagaaggttcataaaagagcaattactgtgacaaaaatctttcagaaaatataagcctttaaggtgaagaagagtattgattctgaagacaagcattacaaatataaagaggtttgtagtacctttgcttgtattacagatcttattgcccgcgttttgtattagaaggaaaccctaaagcggttgccaaactttgtgcaacatcagggaatgtatattgaagaagattcctgcaaatgtaatgagtttggaaacacttcttagataaattatttgtggctgggcacagtggctcatgcctgtaatcccagcactttgggaggccaaggtgggaggatcacctgatgtcgggagtttgagatcagactgaccaaaacggagaaacccagtctctactgaaaatataaaattagccatgcatggtggcacatgcctgtaatcccagctactcaggaggcttgaaccctggaggcagaggttgtggtgagtcgagatcattgcactccagcctgggcaataagagtgaaactctgtctccaggaaaaaaaaaaatttatttgtgtataactttaaaagcagatttttggaagcattgtaattacattaaaagtatacttgttccagctgcgtgtggtggctcatgcctgtaatcccaacactttgggaggccaaggcaggtggatcacgaggtcaggagttcaagaccatcttggccaagatggtgaaaccctgtctgtactaaaaatacaaaaattagccatgcatggtggccggcgcgtataatcccagctgcttgggaggctgaggcagagaattggaattgcttgaacctgggaggtggaggttgcagtgagccgaggttgcaccattgtccagcctgggcaacagagcaagactccatctcaaaaaaaaaagtgtatttgtttccttaaaaaaatttttctgaaaagtgggtaatgacataatacagctttcaaattactttatgctgttattttattcttattgtattcacatgtgaaagcatgtgatcaatttttgctgcatcagagatattagagatagttttttattaattgggcatttatgaccttttctataaaagtaaggacattaaaatgtaagatgcatgatgaaaatataagtggagaggctctttgtagttaacctatatgaagtaatgtataaggtaggtcagagtaatacttttctacattatagtgcaagaaataattattgataaaagtatattaaactaaattcgtatattttacttattgtacttttatgtaataaaatgcagtgcatttaaaaattgttagattatgtgtgaatttaattttatgttttttaccatgttaagactattgtgcatttaatgaagcattattatgccactaacctatcccaccttactcaaaggtgtaggtaaaagatggtagcaatatactatttggtacataatggaataatgtctctagtaatcactttgccagtggctttaaacagcaaatgaatttaagaatattgttcccataggttaaatttttattctcttttcttactgaaatttattattagtatttgtgagtatatagtatatgtatatatttatgctttatatggcatattttgattcaggcctataatatgtagtaactacattagggtaaataaggtatctatcacctctagcatttatcctttgtattaaaaacagtgtaattatatacttttagttattttaaaatgtacaataaattgttattgactacagggttatttttatgatcataataaaaattatacagaaatataaataaaatacagccaggcccagtggctcatgcctgtaatcccaatactttgggaggacaaggcaggtggattgcctgaggtcaggagttcaagactggcctggccaacgtggtgaaacctcgtctactaaaaatacaaaatatagttgggcattgtggtgcatgtttggaggctgaggcaggagattcacttgtaactgggagctggaggttgcactgagctgagattgcaccacttcactccagcctgggcaacagactcaatctcaagaaaaaaagaaatagaaatcatacatatactgaaaacttattaataaatgtttgttatatggttttctttgaacatgtggtctttgcctgcaaatgtagactttcagtgttaatttacatcagttaaatatacacatattactctgaagataaaccttagatgtaagaaacttatggagtgtgtttgtgtgagcatgagattgtacatattttcagaagaaaagaacaattattggaacaaaacaaattattttaataaggtggctaataaaaaactaagctccttgagaatgctgaaagcaaatctatgctttctgctttgtcttgaatttattaatataaaattttatggcttatgtttcaaatttttttcagaatctgtctattaaagtacaggcagctttgtctccagaaacaacgctcttgagtacaacaataaaagccctcttcaaacagaaaacaaataatcatagttaacacttgttttaatgaaaattcaaccaaaattaaataattagatatatttttattgtcctatgtgtgtgtgaatgtataaaatggtgcataaaggaaaaatatgccagaaaaaaagttaatatttgtaatgaataaaactggaaattagttcattatttgcaggtgatatctttgtttatgtagataacaaaagcagcagaaaactttcacggagtctctctctgttgcccagggtggggtggagtgcagtggtgcgatctcggctcactgcaagctccgcatcccgggttcacgctgttctcctgcctcagccttccgagtagctgggactacaggcgcccgccaccacgcccagctaattttttgtatttttagtagagacggggtttcgccgtgttagccaggatggtcttgatctcctgacctcatgatccacccgccttggcctcccaaagtgctgggattacaggcgtgagccactgcacccggccaaaacctttttttttttttccaaagaattataaatagaagattctaaagagaagtttttaataaataagcatttaaaagaaactagggttacttgttatgtttaaaatatatgctgttctcacacaaaatgaaactgctgaaatccaaatttagaagcaaagaatagacttaaattgttaaacatagaaaatataaatatatactttgaagaacaggattaggcaccttgatacgtgaaagaaaatattaggaaataaactattttattcttcagatacaggctgaagaaagtagatgaaaaccctgtaattcctttttgcctgcagcaaacttaaatttataagtaattattttggtaaatatggagtgcctactaattatgtaatttacttcatgcataacatgcaaattctagcatattgtcataaataaatctaaaattacagacaaatttgaaatagaaaatagtcaaaatgtagagggcgagtgacatcagtaagatgaaagattaaaagttccctaattttatatccccttacagcaaaaaacatcggccatccctgacaaaaatgcctttattggctgggcacagtggctgatgcctttaatcccagcactttgctgagatctgctgagacgggcagatcacgaggtcaggagtttgagaccagcatggcaaacatggtgaaaccctgtctctacaaaaataccaaaaaaataggcagtcatggtggcacacgtctgtaatcctagctactcaggaggctgaggcaggagaattgtttaaacccgggaggcagaggttgcagggaggtgagatggcaccactgcactccagcctgaatgagagagtgtctcagagaaataaataaatgcctttattagaaaaccaggcattatggctcacacttgtaatgacagctacatggtacattaatgatggagaacagcttcaggccaggatttcgagaccagcctgggttatgtagcaagatgtcatctccaaaataagtgcctctatgagagatgtgagatccagggagggagttgtgaaactgttaaagcttaaggttgagaagtgttctattcagaaggcaggccctcattcaggtggaaaactatatgacccctgttctaggctacagaccaggatagggttcacccaacttggtcccactaagaattctgaacttactgtgtaatcatctgaaactcctccagccacagtctggcagaggtcttgccattccagagacctggaggaaggtgcccattcacagccatctaggcaggcctgcagaccttggcctgtacaggggtccctgaagtggttcagtgactcagtttcagttacctgagccacagttcatggccagttcggcctacatagaaagctacagagttacttgaaaaaataatctctggtactcactgaaagccatactcatctacatcctgatacaaggcccaccatatgcagaaccaacttcagaaacattccttatgtctgccctatggagcaaagtcctgaaagatttgcagtctgtccaaaaataaactgggaattacaattacccaagcccctgtaacaagccaactaaagatggaccctagtgcagtcccagcagccttgtgaccaagctgcaacccctcttcactacaaattcagagggtttctcatcatcctaagggaccaacaaaagaagatctttatcttctaaaatcagtgtatgaaaacttgaagaggtgtttgctccatcaacttcagacaccaatacaaaactatactgtgcccattgtcaacacttctattttaatctagcaccggaagtatgtggcagaagaattagtcaaaaaaattttttaatccattgaaattaaagaaaaatgagtaaaaagttgctgtttgcagattatacaattttctatttaaaaaactaagcagtatattaaagcctgtctaataaatgcactcagtaaattagcaaaatataaaagtaacatagaagtatatgtatggtttctttcacttaaaacaaactatctgataaaatacagaaagaggctgggtgcggtggctcatggctgcaataccagcattttgggaggccgaggaaggtggatcatctgatgtcaggagtttgagacaagcgtggccaaaaaggtgaaaccctgtctctactaaaaatataaaaattagctggatgttgtggtgggcaccggcaatctctgctaattggtaggctgaggcaagagaattgcttgaaaccaggaggtggaggttgcagtgagcccagattgtgccactgcattccagcctgggtgacagttggagactccatctcaaaaggaaaaaaaaaaaaaaatagaggaagaaaaaaatcttatttactataacattaaataataaatttctgagaaaaatattaaccaaggaggtaaaaagtctttacaataaaaaaacaaaattagagaagatccaaataaattttaaaatattttatgtctatggattgaaagaataaatattaaagcaccatgttatccaaagtgatctatagattgaagaaacttcttatctaaattgcagttgtattttttcacagtaatggaaaatacaattctaaaatttacatgaaattaaaataaactttgaatagccaaagcaatcatgaggaaaaggaacaaggcagaaggatatcatacttataatttcaaattatatttcaagactatatagtaatgagtggactgtgcagaaaaatgaacagaaaaattcaacagaaataactactctcacacatttcaaatctgatgcgaaaaaaaccttaaaaaatagttttagtttcttaaaatcatgcatatatttgtgagtcccaaaaacaatgaaaaagaagccagattgtgcagtctcttatatgtcatgaagaggaatttggctttcaaatttggcttatatgtcatgaagaggaatttggctttcactcaccccatcgttcctaaccttacaccattcttagcaaaattccatatgatcatcaatggtttacaatgatagatttgaaggatgccttctgggcataccccttgtctgatgatagctgagatatatttgcttttgagtggtaagacccctatttggggcagagacaacaatattgatggacagtcttgccccagggtttcacagactcccccaacctctttgttcaggtcccagaacaagtactagaaaaagtcacagtccctaaacaaatatgtctgcttcagtatgtggatgatcttcttatatctggtaaagacataaaagaggtaggtgacttctctacacacattctcaatcacttgcagtgtgaggggttgctggtctcaaaagggaaaattcagtatgtagaacctgaagctaaatacttaggctacctaattagtgcaggtaaatgaaaaacaggacctgaaagagaattgtttccctacccttgcctcaaactaaacaagaactcaggaaatttttaggactaattggatattgtcatttatggatttgactcatatgcatgaaagagtaaacttctatatgagaaacttgcccagtggaaggctgataatttcttgtggacttcccaagaaatccagcaaattgaggaattgaaagggacactcatagccaccccgttctagctctaccctccctagaaaagccatttcaccttttcattaatgtaaataatggggtagccctaggaatgctaacccaagaacatggaggctgccaacagcccgtggccttcttgtcaaaggtcttagacccactcactcataggtggccccagggtatccaatccattgcagctacagcagtattagtcaaagaaagtaggaaggtaacctttggaggaaagttaacagtaagcctgccccaccaagttagaactatattaaatcagaaagcagggaggtggatcactgactcaataattttaaaatatgaggctattttactggaaaaagatgatttaatattaattgagaatatcatacctagatttagactaatagaaaatattagtctactactactgataattcacttaatccagcaagatttttaacagaggatccaaacttaaaacgagagcatgtatgtttagatctgattgactaccatacaaaagttcgaccagacttaggagaaactcccttcaagacaggttggcacttattcatagatgggtcttcccaggtgattgagaggaaaagacataacaggtattcagtgattgatggagagacgcttgaagaagtagaatcaggaaggctgcctaatgattggtctgcccaaacatgtgaactgtttgcactcagccaagctttaggacatttacaaagccaagggtatactgactgtaagtatgcctttgccaggaaggaactatctatactgactgtaagtatgcctttggggtggcacacacatttgggaaaatttggatgaagaggttcttatcaatagtagaggccaagatttagttcatagctaattgcttgtgtcctcaacaatctccaattgccagaagagatagctatcgtgcatgtcgcagggcaccaaagggactttggtgtctgtagttctctaatatcacatccctatataaattccactgtgcagtgtccaggcaatgccattcctccagagagaattctatggccacatctctaaattgcaatggttcctgaaacacacacacacacacacacacacacacacacacacacacacacacatttttaccaagttgccattggtggaatttttaatttgatttaaggtgaaatgagagagtaaagggaagtgattctgacttacaggactaaaattatccaataaaataattttcaacacagaaatattctctaatatattctctaactctaagaaaaaaagaggagcataacatccacaacatcatttcatatatttttccatataataaagtataaaattaagggcatgaacatgaacatgtacatttttgagtgctatatttacatcatacagaatgagttgtgaatatttttccgatggaaaagacatgttgagttagaaggtatctctcaaattttgttttgagatggaatttcaatctagttgcctaggctgaagtgcagtgatgtgatcttggctcaccacaacctctgcctcccgggttcaagcaaatctcctgccacagcctcccgagtagctgagattacaggcatgcaccaacatccctggataattttgtatttttagtagagatggggttttctctatgttggccaggctggtcttgatttcccgaactcacgtgatctgcccgcctcagcctcccaaagtgctgggattacaggcatgagccactgcacttggctgatttttttaatttctaagaagctcaccagtaatgccaatgtttttggcccaagaaggatattttgtcaaacatccagtaagtggaagagcctgtgtttttcccagattttttagcctgtaagcaaagataaaagccttcattttccaaagagagatatgtagaaaaaaataagaaaaaaggacagctgccagattaaatgtgatggtttatgcacatcagctgcataaacatacttaataatgaagagaaaaataattaaccctatggtgaaaaaaatctgtcagagagctaattcaccaagtgaatcattaaccattaactgcacgaggacaaatttttacgatgtgctaatgcacacaggagaacacagaatcactgttgaaatatacttccccaaaaaactaaattacagtctgaatttaaccataaagaaacatgagttttatgcaaacttcaacatccagataactcctatgttctgtaatttttactagtaattttaaatagggttcatttagcaccctagaaaacaagtatctcctgataagttttttcagaactttctgggtaataaatgccatcccattttaatgagcattttcttaatcctgttctgcatagagctaatggaacacacagatggagcctcaacattacatgttctccatctttactaaggaccacacttttccccaatagaaatcttcagtatccacatctttccatgttcaatagccacaaaaggaacatttttaatattgcagatcataaatccttgctgagaatcctgcgtgacatataagaagctatgatgtagagaatgcagagatggctctggaatataggaaagaaatatttttcagagacccttgactatcataagaattttaacaagtagttaaatcaaacttattagggaggaaaaatacaagtagaaaaataaaggtttgcaagtactaaacgcatggcagtccaggaggcagagtggacacaggtcttcatctgacacaggtttacctgaagaaaagcctttttttttctttttccccttctctggaattccttctcagatgagattttctggacaaattaaacctgcatctgaaggatatgcttttaaaggtgtttacctgctagcatgacatcaactagcagaaaaagacagaaaaagtccacccatttctgtcctttaaaacagaagaggttcaggaaaaatgagatgctccatgaagatgaaagtataagtttctcctttcctgtcctcaggtgccctcccctgccacagacactagcaatttctgctaccttaatggaaatatgcaccacactgacctgtccctactaaacccaaacagaactggccctgtgaccaccctttagtccaaaggtggagcttaactctcatgaatgtattttgagggcctcatacctgattctggcctaaccttagagtcacatgaggcccttcattaaaacgtgatagatgcttccaccgagaatgataaacagaagctgtggggagggcacaagagatttctgcaaattggccatttgatcctaatgggaagcctgggctgataaccactaagttaagcattgcctctcaagctttaatgagattataaatcacctggtaattttggccccacttaatgtaatgtgattctgcaggtttgaaaagggtccaagagtgagtgttttaaacaagtcccctgtcaatgcagttgtttctcccccttggagaattattaacattagagaaagcaggcacagcacagggtcccttacacttagcactcttgtcaccaccaaatacttctggtacaaataaggacaacccatctccctcctaaagttttatagtctttgctggctctttagagtttacagaggaaacaaaagtcagcaatgtctgaataagtctgtatttaaaaaacaacatgtaaacatgtactaatgcaatgtttattaagcaggtactatgtgctcaagggtaagatacagagcactgtgctggtcatccctcattatgtaatttaattctcataacaccctgggagctggtactaagggtttaataatttttaggatttagataaagggcccagcatttttatttcttctgtttctctgtcatcaaattttttaaaaaactgtaaatagtaaagctaaatataggcagatgaaagagatatagaaaggaagagtttaatgtagctcagagaaaattttattctgtttatattcacttttttgtgacttgtggagcaactactggatctgcaggaatagaaaacaagttgctaaagagaatgtctctgcaaccactggttttaatggaaaatttaaaaactggccgggtgcagtggctcacgcctgtaatcccagcactttgggaggccaaggcaggtggatcacctgaggtcgggagttcaagaccagcctgaccaacatggagaaaccccatctctactaaaaatacaaaattagccaggcatggtggtgcatgcctgtaatcccagctactcaagaggctgaggcaggagaatcgctggaacctgggaggtggaggatgcagtgagccgagatcgtgccactgcactccaacctgggcaacaagagcaaaacttcatctcaagaaataaataaataaataagtaaaatttaaaaactaaggctctacaatatatactttatttttcccatttatctgcttttgggtttcaggaaattgtgagtagcagctctagaactgctgcaggattcatcagccaaaattctgataacttctaatcagttctgtgaggcaagactccagggcagggtcagacctaaataaggcctccaaaaagggtgaatctgaacaggtctgggacaaggtgaggaccctatagaattctgttctctatgccactggagtactaacaattttgttttttctaagcttgcctgaaagaagcctaaaatcccagagtttctgttattttcattttttctagccactaccctgtcaactgtatactatatactaatatgcaaattaaacaaatctcttcaggttttgtagtgtaattttattagaaaataaatactgtgcacttaacaacataaaagaaatagattttatatggccgggtgctgtggctcatgcccataatcccagcactttgggtggccgaggcgggtggaacacgaggtcaggagtttgagaccagcctgataaaggtggtgaaaccacgtctccactaaaaatacaaaaattaaccaggtgcagtggcaggcccctgtaatcctagctacttgagggactgaggcaggagaatcacttgaacctgggtggcagaggttgcagtgagccaaggttgcaccactgcactccagccttggtgacagagtaagactccatctcaaaaataaaaaagaaattataataacaatttttctgttcataaatatcccttcaggtgtagacatgagaagttacaacaatataaagaaatagcctaaataaagcctaagattttgggcatatctatttattgtaccaaccatatgatgcataattcaattatttatctgggtgctagtctagactaaaagtttctagatggtaggaaccatgactgcttcatggatttttttaaatggccatatgaaatggaagcaactagtttatctatttgggtctccggattttctccttttgtatcatccaagtaccaggaaaccggagaaactctcatctgggtaccaaccaaagacacctcttgtatgaggggatgaactaacaggatgactcatttctctcacactgagacagaaggagaattaaccattcttgtcagcctgacataattccgctcaggacatcctcaaatgcctcaaaggcacctagatgattgtgagagaattctcggtgaccaggggctaatgtcccaatgataaaccaggctggagagactcaggctgattctaaatagaaaatggaactgtcctggtggagctccagaacctagatcacctattctaatttgctagctccatggtataaaatatttttttggaacttcttaaattttttcaactcttggacatctgaattttgcatactgtatgcacttgaaagaatgtttatgggtgaaaatgcagaagagggaaatatgttataaaaaatccatgaatgaacaatacctatgcaacagaatagagagcccagaaataatgccaccctcctacaacgattagatttttgccaaagctgacaagaggaatgtgggaagaattctctatttcataaatggagttggaataactacctagcactatgcagaagactgaaactggacctcttcattacaccatatacaaaactcaactcaaaataaattaaagacttaaatgtaaaatttaaaattataagacaccctgcaagataacctaagaaataccattctagacatagaaactgggaaaaccttcatgatgagtctatcaaaagcaattgccacaaaagcaaaaatggacaaaagggacctatttaaactaaagagcttcttcacagcaaaggaaactatcaacagagtaaacagacaacatacagaataaagaaaatatttgcaaacattgcctctgacagaggactaatatccagaatttattaagagctcaaacaagtttacaagaaaaaaaacaaataacctcattaaaagtagaaaagaaaaacatgaacatattcttttcaaaagaagacaaatgtgcagttaacaagcatgtgaaaaaaatgctcattgctaattattagagaaattaaaagaaaaaccacaatgagataccgcatcacacccatcagaatggctatttttaaaaagtcaaaaaataatagatgctggcaaggttgcagagaaaagggaatgcttatactctgctggtgagagtgtaaattagttcaacaactgtaaaaagcagtgtggcgattcctcacagaactagaaacagaattatcatttgacccagcaacctcataattgggtatatacccaaagaaatataaattattatattacaaagacacatctatatgcatgttcactgtagcactattcacaatagcaaagacacggacaggcactaaatgcctaccaatgatagactagataaagaaaatatggtatggtcagatgttgtggctcatgcctataatcccagcactttgggaggccatggcaggtgggttgcctgagcttagaagtttgagaccagcctgggcaacaagacaaaatcttgtctccccggaaaaaaaaaatatataaaattgcccagttatggtaatgcacgtatgtagtcccagctacaagggaagatgaggtaggagagaattgcttgagcctgggagattgtggctaaagtaagccaatatcatgccctggcactgtagcctaggcaataagcctgtctccaaaaataaaataaaataaaagatttagtaaaaacaaaatatggtatataaacattacaaaatactgggtagctatttaaaaaaaatcatgtcctttgcaataacatagatgaatctggagaccattattcttagaaaatgaatgcagaggctggacatggtggctcatgcctgtaatgctaacactttgggaggccgaggtgggcgaaccacctgaggttgggagtttgagactagcctgaccaacatggattaaccctgtctctactaaaaatacaaaattagctaggcatggtggtgcctgcctgtaaccccagctactggggaggctgaggcaggagaaccgcttgaacccaggatacgaatgttttgatgagccaagatgttaccatggctctccagcctggacaacaagagcaaaactccctttcaaaacaaacaaacaaaaaaacaacaaaaaaagaaaactaatgcggaaacacaaaaccaaatgcatgttataatttataaataagagctaagaagtaagaacacagaacacaaagagaagaacagacacaggcctagttgaggctggagggtagaaggactcagaagatcagaaaacataattgtttggtgctatgggtagtacctcagtgacaaaataatcggcacaccaaatccccatgacataattttagctgtataacaaacccacatgtgtacccggaaccaaaaataaaagctaaaagaaaaacaaatcccctctccctctccctccgcctccccctccctctccctctccgtctccgtctccctctccccagggtctccctctccctctctttccacggtctccctctgatgccgagccgaagctggactgtactgctgccatctcagctcactgcagcctccctgcctgattctcctgcctcagcctgccgagtgcctgtgattgcaggcgcgcgccgccacgcctgactggttttcgtgtttttttggtggagacggggtttcgctgtgttggccgggccggtctccagcccctaaccgcgagtgatccgccagcctcggcctcccgaggtgccgggattgcagacggagtctggttcactcagtgctcaatggtgcccaggctggagtgcagtggcgtgatcttggctcgctacaacctccacctcccagccgcctgccttggcttcccaaaatgccgagattgcagcctctgcccggtcgccaccccatctgggaagtgaggagcgtctctgcctggccgcccatcatctgggatgtgaggagcccttctgcctggctgcccagtctggaaagtgaggagcgtctctgcctggccaccatcccatctaggaagtgaggagcgcctcttcccggccgccatcacatctgggaagtgaggagcgtctctgcctggccacccatcgtctgagatgtggggagcgcctctgccccaccgccctgtctgggaagtgaggagcgtctccgcccggcagccaccccgtccgggagggaggtggggggggtcagccccccgcccggccagccgccccatccgggagggaggtgggggtcagccccccgcccggccagccgccccgtccgggagggaggtggggggggtcagcccccagcccggccagccaccccgtccgggaggtgaggggcgcctctgccaggccaccaccccgtctgggaggtgtacccaacagctcattgagaacgggccatgatgacaatggcggttttgtggaatagaaaggggggaaaggtgaggaaaagattgagaaatcggatggttgccgtgtctgtgtagaaagaagtatacatgggagacttcattttgatctgtactaagaaaaattcttctgccttgggattctgttgatctcttgaccttacccccaaccctgtgctctctgaaacatgtgctgtgtccactcagggttaaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaataaattaaaaaaaaaaagaaaaaaaatccccaggtgagagagagtgcaatgtcagtgaatggacagatttttgctacagatagttgaccaggtggggctgtactctgatttatttctgtgtgcatgcaggcagatgagattatgaaaaggagggccagaaccctaggctggtggagaaaacaggttgctgctgcagattcgatatccggggatgggaatatgcaaggaaacttgtagatacttttggctttttggctagaagtgcttggaccaaaaatgtcatggtgaagtcactgagggtggtgcctagtcctgggaggagtgtggacatgtcaatgtctagtgtgtgtgtttgggagtatgtgggaatcctgtggtggcagctgcaagaaaaggggatgtgtcatcagagctcctttcctgtaagttttcagtcctctgtcaccctgggagaagacctggaatcacaggacaatgggcagtgtgacaatctgtgtacaggagagcagaatctcccattcccaaacacccagagttttattccaggccaggcctccatgatatcttctttctggcaccaaatctgtagcatttgctgaacatcaaacaattctccaacaccaacttattgtataacatttgatttctaacactacccagagtcagcacagaccctgattcagggctcggtcccacaacattgttctcactgcagatgccagtcataaatcccatgggcccatctatggttctgagctactgtttaaaaactggggactcccataacttccctgaagctcagtaatttggtagagctactcacagaactcagcaaaacactgtagttatgcttactggtttaatatataagatgcagcccaggaaaagccaagtggaagaaatgcatagaacaaagaaaagagatgaggaaagatgaaacacatagataattatgaaaaatatttgtgattaataaaattctccttcctttgtgtgcttcaggaacagtttatggaaagaaacactcttcccgttatgattaagatgatgctcccttttcttgcctatcacacagccagacatacactctgcacattttctcctttttctcattaaaaaaaaaacaaaaaaccagctgaatttgccttcagcagtcaaaatcaattatgattttttttttttttgagatggagtgtcactctgtcacccaggctggagtgtagtggggccatctcggctcacttcagctttcacctccagggctcaagcaattttcctacctcagcctcccaagtatctgggattacaggcacctgccacaacgcccagctaatttttgtatttttagtagacagggtttcaccatgttggccaggctggtcttgaactcctgacctctggtgatccgcctgcctcagcctcccaaagtgctgggattgcagacttgagccaccacacccagcctaaaataaaatatttcttaatcaaattttacttaagtttatcttctctcaggctcctgaaattcaagctaccctcagtctgagtcaacatacaaccccattttatgtccctcctaagaacatgctgatttcagggtaagccattctctgatctaaaatctgactttttcaccctccatttgctgttcctctcccacctcctttctaatcttgtttgctcttccctagaaaagaaagcccttttctgcctatatttttgcaagccataaagatattatagttatttggtgcttccttttgttgcaatacttttttggaattggttttttacctgcctcttgagaatatgcctttaagggtgtcagtaccacatgtttacctgcaagcatgacatcaactggcagaaaagacagaaaaagtccatccatttctgtcccttaaagcagaaggtatttgggaacaatgtgctgctccataaagataaaaatatgtttcttcttccctgtcctcaggtgccctcccctgccacagacaccagcaatttctgctacagaacctgcagagaaaaagagaagaaattaaaatgctgggccctttttctaaatcctggaaattagtattaaatccttagtaccagctcccagggtgttatgaggattaaattatataatgtattatgcccagcagagttctctgtatcacaatcttgagcacatagtacctgcttcatacagtaatacaaatatacaccactctgacctgtccataccaagccaaaacagaacaggccctgtggctaccctttagtccaaaagtggaacttaattctcatgaatatattttgaaggcctcatacctgattctggcctcaccttagagtcacatgaggcccttcattaaaacaacatggatgttttcaaccagaataataaacagaagctgtggtgagggtacaagagatttctgcatattggccatgtgatcctaatgagaagcctgggctgataaccactaagctaagcattgcctctcaagctttaatgagcttataattcacttggtaattctggccacactttaagtaatgtgattctgcaggtttgaaaagggtctgtgaatcagtgttttaaacaagtcccctgtcaatgctgatgttactcctccttggctcattattaacattagttagaaaagcaggcaaaccacagggtcccttacacttagcactgttgtcacaatcagataactctggtacaaataaggacaactcatctccatcctaaagttttatattctttgctggctctttaaagtttacagaagaaacagaaggtaattaccaggatttagaaaaagagccaagcattttaatttcttgtttttctgtcatcaaaaatttttaaaaattgtatagaataaaagctaagtatagacagatgaatgagacataaaaaggaagaggttagtttagagaaaattttattctgtttgtatttacttttttttgacttacggagcaactactggatctgcgggaataagaaacaagttgctaaatagaatgtctctgcatccaatggttttcatagaaaattaaaaaacggctgggtgcggtggctcatgcttgtaatcccagcactttgggaggcagaggcgggcggatcacgaggtcaggagatcgagaccatcctggctaacgtggtgaaaccccatctctactaaaaatacaaaaaattagctgggcgtggtggcgagcgcctgtagtcccagctactcggaggttgaggcaggagaatggcatgaacccgggaggcagagcttgcagtgagccgagatcgcgccactgcactccagcctgggcaacggagtgagactccgtctcaaaaaaaaaaaaaaaaaaaaagaaaatttaaaaatgaagaccctcaaatacatactttatttttttgtatttatctgcttttggatttcaggaaattgtgagcagcagctctagaaatactgcaggattcaccagccaaaactgatctctgccaatcagttctgtgaggcaagactccagggtaggtctggacctacataaagcctccaaaaaaggtgaatctgaacaggtctggggcagagtgaggatcctttgtagaattctgttctctatgccactgggatacttccagttttgtttttctaagcctacctaaaagaaacttaaatcccagagtttctgtaattttaatattttctagccacggccctgtcaactttatactatatactaatatgcaatttaaagaaatcccttcaggtttcctagggtaattttattggaaaataaatatgtacagttagcaaggtaaaagaaatagaaactatacggctgggtgcagtggctaagtcccacaattccagcactttgaaaggctgaggtgggtggatcatgagggcaggagttcaagaccagcctgaccaagatggtgaaaccttgcctctactaaaaatacaaaaattagctgggcatcgtggctgtggccagtaatctcagctacttgggaggctgaggcaggagaatggcttgaacccgagtggcagaaattacagtaagccaagatcgtgccactgcactccagcctggggaactgagattctgtctaaaaaaaaaacaacaaaactataataattgttcggttcataaatatattcaggtgtagatatcagaagtcacaacagcataaagtggcataaataaagcccaagactttggacacatctatatattccaccaaccatatgatgcataattcaattattcatgaagttgctagtctagactaaaagtttctggattgtaggaacaatgactgcttcatgtatttttttaatggccatataaaatggaagtaatgagtttatctatttgggtctccaggtctccttatttatcatccaagtaccagaaaactggataaactctcatctgagtaccaaccaaagatacctcttgtatgagaggatgaacaaaaacacaggatgactgatttctcttacaccgagacagaagcagaattaatcactcttgtcaacctgacacaactctgctctggatattcccaaatgcctcaaagacacctaggtgattgtgagagaattcccagtgaccatgggctgatgtctcaataagccaggctggagagactcaatgataagccaggctggagagactcaatgataagccaggctggagagactcaggctgactctaagtagaaaatggaactgccttggtggagctcaagaacctggatcacccattctgatttgctagcatttgggtaagagaaagaatgaaaatattctactccagtatcacattttacaggtaaatatagttgtgcacatggctctggctattttgtggacttgatgtctcactcctaagatgtttatttacacttacagattctaccatcagattctatttcctcctggacactcttacagtctgacccttttttgtaaaccccaggcagaagccataccttatctgcagattctaggtaggacccacctggttctgcatcctttggtgttacagcaagtggagtacaatcagagaagagatcccctaatagaggctgctctagcactttctaagtattaagcctacatgaaaaaaaaaaaaaagctgacacaacatgaatgtaagtagacagtttatttgggtgaagtttaaggattataacctgggagcaaagactgaagttgcctagaatctacactttcattaacagcagttgcaagaggagttgtgaagacaaaaacaaagggacagagagtgggctgatagagttgtcagaaatttttatttaaagaagtaacattggttattgattggacatatatcattatggtttagggtatgagatacagtgtccaatgtggtattatcagtttaatatacatctacttgtggcaatagtgaacagtttcaagagatgaatacatatttcaaaggaggagaaaggcgtaactgcactttcatttcaatgtctgagtttgataaccaaaaggacttgcatttttagataaaaattttctatttcccaaatctcaagacctagatacaaaatgtagagctgcagatttagggcccgaatggctggagtagcagcaggtgttacctgcacatttgtgaacattttaccaagagaaaaaaggggaaagtgaagattctcatgtctgaatgtgtactcaatgaaaacgttactctgattaggtttgtgggccccatggtctctgaatcagtttaaggtctgaagatacaagagtcattgagataaaactattgattgttgccctgtgaagttggtagaaatttggtttagtctctctagaagtgactgtagaggactatagataccaaataggcagaaacacagttctgcttgcatatttaggggacagcatgcactttgttgcacaagtgtgagttgactggaagtctgagagggaaagtcccctctagagtaaattccagttggcaccttatgtgtttatatcatgtctggtaattatagacagtgtttggaaataacaaaagaatgttctccagccccagaaaaactccacaatagaacagaaagaaaactgttttatgtgacatgcatcatagtcaatctgcttaagagactgcagagacagaaagatggtcaccaaaattagtccacaagtagaatttccagaaccatgtcatacatagttcatcctaaattcacatggagattgaagaggccatctgtatatgctaattgtttatattcaataacaaaaaaacttttcacaccttcataacaggaggtagtttagcagcttgaagccaggtacttgctgaaggtaggttttcactctgctacaaaaatggttgaaaagcattctatccttttggctatttacattttacagcagtggctctgtgttccatggcattgggctacagcactttcttgctttttcctggttgctagtgtcctcttgacctctctcatctgccactgagggacagccttgagcacagctcagtttatgtgaaccacatttcccacagcagcactctagtgtcacatcagagaggaaagcctgagctgcaggagagcctgcaggccttgtgagtagaattgcactttcacaataatgggaatgtgaccagtgtttcagcccgtttttaattatcatggtgacatggaaaaaaaatcggatgaatttccagcatgagtccagatagagatatctacaaaagttctcactgtgacagcctacctcattcagacaccatgggatactaatagggcttctgaaacagacacccaaagtattggagagaaaaacagatctccatctgagcaagataattttgagagaaaaaagttaaaaagatcttgagaaaaaagatcttgagaaaaagctcagtttagatataagattgatcaagtcagccagaaaatagtcccctaaaagcaatttctctctaaccacccaaagtgcacaattactctcagcatgagaaacatgagcattatgaagaaagggggcagaatttcagaagaattttataaagctttttttcccatctctgctgctctctcatctcctagtcattgaatgggggttctatattgaaatatatctgacaacttccaacaacactttttgatgcagaaatagaatctgactgtgttcacattgtggagtatattagaacttccaacatagttaactgaagagctatcatggtttttgggtggccacatcaactgtctttatttcatttgtaatagcagcattccaattgagtgaaataaaagatactaaaattgtgtttacttataattatccctattgaataaagtaataaacatgtcagactagtattgactgtaacaatttggtagtaaattttttggggtattagattaaatatctaagtataaataattttaataaactagtagtaatgtatatggcagttaaaaagtttaactatacttcagttaaaatagtttatatttcaaaagtgtaaataacaatattaaaataaccatttaagtgattcattcaaagtaagtattgtggctttatattcatactattgtaaaaaatactgtttatggctcatgcctataatcccagcactttgggagactgaggtgtgtggatcacctgaggtcaagagttcacaatcaagctggccaacacggtgataccccatctctactaaaaatacaaaaacttagccaggcatggtggggtgtgcctgtaatcccagctactcaggaggctgaggcaggagaaatcacttgagcctgggtcccagtggttgcagtgagcagaacacgcccctacactccagcctgggcaagagtgagactctgtctcaaagaaaaattaaaaaaaaagaaaaagaaaactgtttaatgtatatgaatgtattgttatgtgtagtgtctgcaaacactacacataactatgctaattgttctgaagtcatcaatagaaagccaagtacaactacagactctactgttcagtttatgcactgaactctttttgtttttgctgtgtaagtacttcagcctgcaaatgttggataattaccttggataataaagttactttcaaagaaacttagtatcttttagcgtttctcattccatattgctaaatttaatcctatgtttctgctaagcttctgtgtgctcttaaaatgagcttttatctaaacacatttgtgtttactttaaaggactaaaaatgggccaggcatggtggttcatgcctgtaatcccagcactttgggaggctgaggcgggcagatcacttgagtttgggaatttgagaccagcctgaggaatatggagaaaccccgtttctactaaaaaaacaaaattagttgggtatggtggcacgtgactgtaatcccaactactcgggaggctgaggccagagaatcccttgaacctgggaggtggaggttttggtgagtcaagatcatgccattgcactccagcctgggcaacaaaactgaaactccatccaaaaaaaaaaaaagtcctaaaaaggagagaaacaaactttttaaaattagaaataaaccaataaatcagatgtactagaaaagataatctaaagtaaaaaaaaaaaaaaaaaaaaagacaaagtttatttaactgttaatatggtttacagatatttcaagaaagcagagaaaaatatctacacataatctaaatcccttaaggaaaaagagaataagaaaaatttttttggaactttttaaaaagtctttgaactcttggtaatctaagttttgcaaacaggatgcacttgaaagaatgttagcctaggtgtggtggctaacacctgtaatcccagcactttgggaggttgaggcaagcagatcacctgaggttgggagttggagaccagcctgaccagcaaggagaaaccctgtctctactaaaaatacaaaattggctgggcatgatagcatatgcctgtaatctcaactacatgggaggctgaggcaggagaattgcttcaactcaggaggtggaggttgtggtgagccaagatcatgccattgcacttcagcctggcaatagcgaaactccctctccaaaaaaaaaaaaaaaaaatgtttatggggggaaaagcagaagagagaaagatgttataaaaaattcatgtgcacaagaccaatgcaacagaacagagagcccagaaataatgccaccctcttgcaaccatcagatttttgacaaagctgacaaaagaaatgtggggaaaattctctatttaataaatggtgccggaataactaactagtaatatgtagaacacttaaactgaaccccttaattacaccacatacaaaaatcaactcaagaaaaattaaagacttaaatgtaaaacataaaattataagaaaccctgcaagataacataaaagctaccattctagacatagaaacctgcaaacacttcatgatgaagctaccaaaagcaattgcaacaaaagcaaaagctgacaaatgggacctatttaaactaaagagattcttcacagcaaaggaaactatcaacagagtaagcagacaacctacagaataaaagaaaatatttgcaaactttgcctctgacaaaggtctaatatccagaattaatgagaacttaaacaagtttacaagaaaaaaccaaacctcattaaaaagtgggcaaaaaacatgaacagatgcttttcaaaggaagacatacatgtggctaacaagcatatgaaaaacaaagctcaatggtaatcattaaagaaattaaaaagaagccaggcacggtgtctcacacctgtaatcccagcacattgggaggcttaagcaggcagatcacaaggtgaggagttcaagaccagcctgtccaatatggtgaaaccttgtctctaataaaaaaacaaaaattagcctggcatggtggtgggcacctgtagtcccagctagtcaggaggctgatagaggagaatcacttaaacctgggaggtggaggttgcaatgagctgagatcgtgccactgctctccagcctgggtgacagagccaggctccatctcaaaaaaataaacaaataaattaaaagaaaaaccacaatgagataccacttcacatcagtcagaatggctattttaaaaaagtcaaaaaataacagatgctaccaaggttgcagagaaaagagaatgcttatactctgctggtgggagtgtaaattagtttaactgtaaaaagcagtgtggcaattcctcacagaactgaaaacagaattatcatttgactcaggaacctgataattgggtatataccaaaagaaatataaattattataaagacgcatccatatgcatgctatgcatgttcattgcagcactattcacagtagcaaagacatggacaggacctaaatgcccatcaataaagaaaatatggtatggtcagaagcggtggctcatgccttcaatcctagagctttggaaggccaaggcaggtggactgcctgagcttagaagtttgaaaccagcctgaaaaaaatagcaaaatcttgtctacatggaaaatacaaaaagaaaaagtggccagccatagtaacgcacacgtgtagtcccagctacttgagaagatgaggtaagggagaattgcttgagcctgggaggctgagactaaagtaagccaaaatcacaccatggtaatctagcctgggcaataagtgagaccctgcatccaaagataaaataaaataaaagatgtagtaaaaaacaaaatatggcacataatcatggaatactccatggccattaaaaaaaatcatgtcctctgcaataacatcaatgaaacccattaaaaaaaatcagctctgatcttagttttttcttgccttctgctagcttttgaatgtgtttgctcttgcgtctctagttcttttaattgtgatgttagggtgtcaattttagatctttcctgctttctcttgtggacatttagtgctatatatttccctctacatactgctttaaatgtgtcccagagattctggttatgttctgtctttgttctcattggtttcaaagaacatctttatttctgccttcatttcattatgtacccagtagtcattcaggagcaggttgttcagtttccatgtagttgagcagttttgagtgagtttcttaatcctgagttctagtttgattgcactgtggtctgagagatagtttgttatactttctgttcttttacacttgctgaggagtgctttacttccaattatgtggtcaattttggagtaagtgcaatgtggtgctgagaatgtatattctgttgattttgggtggagagttctgtagatgtctattaggtctggctggtgcagagctgagttcaattcctggatatccttgttaactttctgtctcattgatctgtctaatgttgacagtggggtgttaaagtctcccattatcattgtgtgcgagtcttagtctctttgtaggtctctaagggctttctttattaatctgggtgctcctgtattgggtgcatatatatttagtatagttagctcttcttgttgaattgatgcctttaccattatgtcatggccttctttgtcttttatgatctttgttggtttaaagtcttgtttttctcagagactaggattgcaacccctgctttttttttttgttttccatttgcttcagagaccttcctccgtccctttattttcagcctatgtgtgtctctgcacatgagatggatctcctgaatacagcacactggtgggtcttgactctttttttttttttgagatgggtctctgttgcccaggctggagtacagaggcatgatcttggctcactgcaagctctgcctcccaggttcatgccattctcctgcctcagcctcccaagtgcctgggactacaggtgcctgccaccatgcctggctaattttttgtatttttactagagatggggtttcactgtgttagccaggatagtctcgatctcctgacctcgtgatctgcccacttcagcctcacaaagtggtgggattacaggtgtgagccactgcacctgccagggtctgggccctttatccaatttgccagtctgtgtcttttaattggagcatttagcccatttacatttaaggttaatattgttatgtgtgaatttggtcctgtcattatgttagctagttattttacttgttagttgatgcagtttcttcctaacattgatggtgtttacgatttggcatgtttttgcagtgactggtaccagttgttcctctccatgtttagtgcttccttcaggagctcttgtaaggcaggcctggtggtgacaaaatctctcaggatttgtttgtccgtaaaggattttatttctccttcactgatgaagcttaggttggctggatatgaaattctgggttgaaaattcttttctttaagaatgttgaatattggcccccactctcttctagcttgtagagtttctgccgagagatccactgttagtctgatgggcttccctttgtgggtaacccgacctttctctctggctgcccttaacattttttccttcatttcaactttggtgaatctgacaattatgtgtcttggagttgctcttctcgaagagtatctttgtggcgttctctgtatttcctgaatttgaatgtcggcctgccttgctaggttggggaagttctcctggataatatcctgcagagtgttttccaacttggttctattctccccatcactttcaggtacaccaatcagacgtagatttggtcttttcacatagtcccatatttcttggaggctttgttcatttctttttattattttatctctaaacttctcttcttgcttcatttcattcattttaacaatcactgatactttttcttcctgttgatcacattggatactcaagcttctgcattcatcacgtagtttttgggccatggttttcagctctatcaggtcatttaaggtcttctctacactgtctattatagttagccattcatctaatcttttttcaaggtttccagcttctttatgatggattcgaacatcctcctttagcttggagaagtttgtttttactgattgtctgaagaactgaaggagagagagagacacaaaagaaccttcaaaaaaaatcaatgaatccaggagctggtttcttgaaaagatcaacaaaagtaatagactgctagccaaagtaataagaaaagagagaagaatcaaatagacgcaataaaaaatgataaaggggatatcaccactgatcccacagaaatacaaactaccatcagagaatgaatactataaacatctctacacaaataaactagaaaatctagaagaaatggataaattcctggacacataccccctcccaagactaaacaaggaagaagttgaatccctgaatagaccaataacaggctctgaaactgaggatataattaatagcccaccaaccaaaaaaagtccaggaccagacagattcacagctgaattctaccagaggtacaaagaggagctggtaccattccttctgaaactatttcaatcaatagagaaagaaggaatcctcccaaactcattttatgaggccagcatcatcctgattccaaagcctggcagagacacaacaaaaaaagagaattttagaccaatatccctcatgaacattgatgcaaaaatcctcaataaaatattggcaaactgaatccagcagcgcatcaaaaagcttatccaccatgatcaagttggctttatccctgggatgcaaggctggttcaacatacgcaaatcaataaacgtaatccatcatgtaaacagaaccaaagacaaaaaccacatgattatcaatagatgcagaaaaggcctttgacaaaattcaacagcacttcatgctaaaaactctcaaactaggtattgatgggacgtatctcaaaataataagagctacaaaccactgctcaatgaaataaaagaggacacaaacaaatggaagaacattccatgcttatggataggaagaatcaatatcatgaaaatggccatactcctcaaggtaatttatagattcaatgccatccccatcaagctaccaatgactttcttcacagaattggaaaaaactactttaaagttcatatggaaccaaaacagagcccatattgccaagacaatcctaagccaaaagaacaaagctggaggcatcaccatatttgacttcaaactatactacaaggctacagtaatcaaaacagcctggtgttggtaccaaaagagatatagaccaatggaacagaacagagccctcagaaataataccacacatctacaactatctgatctttgacaaacctgacaaaaacaagaaatggggaaaggattcccgatttaataaatggtgctgggaaaactagatagccatatgtagaaagctggaactggatcccttccttacaccttatacaaaaattaattcaagatggattaaagacttaaatgttagacctaaaaccataaaaaccctagaagaaaatctaggcaataccattcaggacataggcatggacaaggacttcatgactaaaacaccaaaagcaatggcaacaaaagccaaaattgacaaatgggatctaattaaactcaagagcttctgcacagcaaaagaaactaccatcagagtgaacaggtaacctacagaatgggagaaaatttttacaatctacccatctgacaaagggctaatatccagaatctacagagaacttaaacagatttacaagaaaaaatcaaacaaccctaacaaaaagtcggcaaaggatatgaacagacacttctcaaaagaagacatttatgcagccaacagacacaagaaaaaatgctcatcatcactagccatcagagaaatgcaaatcaaaaccacaatgagataccatctcacaccagttagaatggctatcattaaaaagtcaggaaacaacaggtgctggagaggatgtggagaactaggaacacttttacactgtttgtgggactgtaaactagttcaaacattgtggaagacagtgtggtgattccccaaggatctagaactagaaataccatttgacccagccattccattactgagtatatacccaaaggattataaatcatgctgctataaagacacatgcacacgtatgtttattgtggcactattcacaatagcaaagacttggaaccaacccaagtgtccatcaatgatagacaggattaagaaaatgtggcacatatacactatgcagccataaaaaaggatgagttcgtgtcctttgtagggacatgaatgaagctagaaaccatcattctgagcaaactatcacaaggacagaaaaccacatgttctcactcataggtgggaattgaacaatgagaacacttggacacagggtggggaacatcacacaccccggcctgtcatgggtgtgtgatggagcagagagggatagaattaggatatacctcatatgaataatgagttaatgggtgcagcacaccaacatggcacatgtatacatatgtaacaaaccagcatgttgtgcacatgcacctagaacttaaagtataataataataataaaaaattaataagtaaaaaaaaaatgaggtctttgcaataacatcaaggcacggtggctcacgcctgtaatcccagcactttggaagaatgagatgggtggatcacctaaggttgggagtttcagaccatcctgaccaacatggagaaaccaaatctctactaaaaatacaaaattagccaggcgttgtggtgcgtacctgtaatcccagctactcggaaggctgaggcaggagaatcccttgaacctaagaggtggaagttgtggttagcggagatcacgctgttgcactcaagcctgggcaacaagagtgaaactctgtctcaaaaaacaaaaacaaaaacaaaaaacaaaccaaaccaaaaagaaaactaatgaagaaaaagaaaaccaaatgcttgttattatttataagaggtaaataataataacacatgaacacaaacaacagacactgaggactagtttagggtggaccctgcaaggactcagaggatcagaaaacatacctgtttggtgctatgggtagtacctcagggacaaaataatctgcacaccaaacccccgtgacacaattttagctgtataacaaacccacatgtgtaccccgaaacaaaaattaaagctaaaagaaaaaaaaaaatcccagggtgggagagtgcaatgtaggtgaaaggactgatttttgctacagatagtggtcccagtggggctgtactgatttatttctgtgtgcatgcatgcagatgagattatgaacaggtggtccagaaccctagtttggtagagaaaacaggttgctgcagcagatttacagtctgaggggatgtaccaggagacttgttttttggcaaaaaacacttggatcaaaaacgccatggtgaagttcctgaggggggtgcctagtcctgggaggagtgtggacacatcaatatctagtgtgtgtgtttgtgagtgggtgggaatcctgtggtagcagctgtgtgaaaagggggtctgtcatcagagctcctttcctctaagttttcaggcctctgtcacccttggagaagacctggaatcacaggacaatgggcagtgtgactgcctgtgtacaggagagcagtctctcattcccaaacacccagagttttattccaggcaaggactctgtcatatcttatttctggcactaaatctgtagtttgctgaacatcaaaaaattctccaacaatttattgtctaacatttgaattctgacactacccacagtcagaacagactctgattcagggctcgggtcccaacattgtcctcactgcagatgccaatcacaaaccccatgggcccatgtatgcttctgagctaatgtttaatatttggggctgccatgacctccctgaagttgaataattttgtatagccactcacagtactcagcgaaacactgtagttatgtttaccagtttcatatataagatgcagcccaggaaaagccaaatggaagaaatgcatagaacaaagaaaagtgatggggaacgatgaaatgcatagataatgctggaaaatatttgtgattaatacaattctccatcctatatgtgctccaagaacagtttatggaaagaaacactcttcccattacaacttagacggtgctcccttttcttacctgtcacagagccagacacacactctgcacattttctcctttttctcattaaaaaaatcagctgaatttgtcttcagtggtaaaaataaaatatttctgtctttttcttgagctggaatctcgctctgtcacccacgcagaagtgcagtggtgtgatcttggctcactgcaacatctgcatcccgggttcaagaaattctcctgcctcagcctcccgagtagctgggattataggcacccaccaccatgcccggctaatttttgtattttaagtagaaacagggtttcaccatgttgcctaggctggtctcaaacttgtgacctctggtgatctgcatgccttggcctcctgaaatgctgggattccaggtgagccaccatgccaggcttaaaataaaatatctccttttttttttgagttggagtattgctctgttgcctaggctggagtgcaatggcatgatctcagctcaatgcaaactctgcatcccaggttcaagctattctcctgccttagcctcctgagtagcaggcattacaggcacgtgcccccgcaggtggctaatttttgtatttttagcagagacaaggtttcaccatctcaggctggtctcgcactcctgaccttgtgatctggaattacagacataagccaccacacccagcctaaaagtaaatacttcttaaactttacttaagcttatctccctccctcaggctcctgaactttgagctaccctcagtctgagtcaacatacaaccccattttatgtccctcctaagaatatgctgatttcagggtaagacattctcttttctataatctgactttttcaccctccatttgccattcctctcccacctcctttctaatcttgtttgctcctccctagaaaagaaagctcttttctgcctacatctatgcaagccgtaaagatcttatagttagttggtacttcctcctgttgcaatacatttttgaaattcattttttttacataaatctaacatttgtattacacaaagtgtagaaggtgcctcaaaacaataacaacttcatcatcattagtaagaccgtcccccagtttcctttcattttaaccttaactgcatctgcctgtggggccccagctttccagggctctgcagtttctctgaggatgaaggctccttccatggctcgggtgagcaggctgaaacatctgcaggaaaggttccccaagaataactaactgggcctttaataacctcctgttgcaggcttaatattagccttagcttggagtcacaaggttcaagctttaatttccatgtgagagttatttacttggtttttgaaactgttcaaaaaatccagtgaaattactcaaacactgtgtttatataagggatggaaattttaaggtgcttaattttttttttgagatggagtcttgccctgtcacccaggctggagtgccatggtatgatctcagctcactgcaacctctgcttcccgagttcaagtcattctcctccctcagcctcccaagcagctgaaactacaaagtatgcgccaccataccctattaatttttgtatttttagtagagatggaatttcactatgttgggaaggctggtgtggaactcctgacctcaagtgatctacctgcctcggcctcccaaaatgctgggattacaggcatgagtcactgcacctggctaaagtgcttgcattttataccttcataagaaaagcaaatatacctacttctttcagacaatatatgtattatcttattatttctattaaaaataatgtagtaacaaattagtcatatgggaacacttgtagaaggtaccatgtttcatcacatataatttagcattacattcagaaatgaagacaacaggatatagacatgagatatttattcactgtcacaaatttacccagcaaaaggaggtactgatgttttgatgaatttatgtaactcaattatctacaacattttcctgtggaaatatattcattgtctacagccaaaatgaaagagagatttttcttattttttcccttggtagctagcattcttaaagttaaggcttggaattctgtttgaaatcactcagccataaaaaacacacctgagaaaattcctaaactcactctgggaaagaaaaagataaatgagaatgattaacaaatggaatatatgattagatattaattttttgaaactcatattttattttctttgtaaatattttcttaactttcaagccctactaataaaatgcaaattttagttaaaaaaacatgtcagctgggtgcagtggctcacgcctgtaatcccagcactttgggaggccaaggcaggtggatcacttaagactagaagtttgggaccagcctagtccatctctactaaaaatacaaaaactagctgggcctagtggtgcgcacctgtagtcctagctacttgggaggctgaggccatgagaatcaattgaacccaggaggtggaggttgcagtgagccgagattgagccattgcattccagcctgtgcaacagattgagactgtctcaaaaaagaaaaaaaaaaagggaggtcaaaataagtgaacagatcgtttcaaggtacaggtcgaatcacccaccccatcctgctcatttacgtgctcaataaccaccctcccaggagacactgcgatatgacccagtgagtcctccaggtgcattttacttcctaaatttttacgccatctcactggggtcagttttttttgtcttttggagtgttttttttttaaacaaatttttcactatttttctgccaccccccccctgcccccgccaagaaaatctaggggacagaaattatttgttttcccctcgataccagcatctggttggctgacaagcaatgtgtctccaagaattggaagctaggttgggtgaagagaatcatgtctcaaggggttagcttttctttattttttgtgagatcgagtcttgctcttgtcgcccaggctggagtgcagtggcgcaatctcggctcactgaaacctccgcctaccgggttcacgccattctcctgcctcagcctcccgagtagctgggattacaggcgcctgccaccatgcccggctgattttttgtattttttagtagagatggggtttcaccatgttggccagcctccaggctggtctccaactcctgatctcaggtgacccacccacctcggcctcccaaagtgctgggattacaggcgtgagacactgcacccagcctcaaggggttagcttttcaggaaaaaaaaaaaaaaaagaaaaaagaagaagtgcaacaggagatgcctttcagccccaaggctgtcacctgctcttttgagaggctacactgtatacttcaggtggtcctatgggagaaaatgacccaagagctaatagtcactagacactctaccagacatagccatggtgggtatcttggtttattcccagaaagtactaaaactcaggcccagaaaaaaaactgaaggatagctgaggacacatcaccctacaaagtttacaaagggtaatcttgacccaaaaacattttggtaagttctctggaaaaataaaagaaaaagaggagccgggcgcggtggctcacgcctaaccccagcactttggaaggccaaggcgagtggatcacgaggtcaagagattgagaccatcctggcccacatggtgaaaccccgtctctgcttaaaatacaaaaatttagctgggcgtggtggcgcgcgcctgtagtcccagctactggaaaggctgaggcaggaggatcgctggaacccaggagacggaggttgcagtaaatcgagatcgcgcgactgcactccagcctggcaatagagccagattccatctcaaaaaacaaaaacaacaaaagaaatgcaggcacagatattttttacaatacagtgtcaggggattattctttgctttcttctgggaaatatttacaaagagaaaacaagtcttttcaatagtgttatgcaatgctttaaaaaaaatgattaattgaggaacgtggggtacatttcaggccctgcttaggacacatgtgaaaaatgctagggaaaaatcagtcccctgtggggtgtggaaataattaagtggcaggcaattagactgaggatgctctagtcctcggattcctccttctaaaataaaaatctaaactcaagtgcagtttttgctaaattactacattcgggaaacaaaattcaggcttaaaaaaccataaactgccaattaagctctgattacataaccaggaaatttccaccttaattgtacaaagaaactacataactatacgtattgaattattgaatatggttttcttcatcatgcaccttatcaatgtttccttcaagcccctcccatggaccgcaaactacaaactatagctgggtgctcttgaatgactgattaaattatttgatatttttgcggtgactcccataatttatgtatttatttatttttttagacaaagtcttaggccgggcgcggtggttcacgcctgtaatcccagcactttgggaggccaaggcgggcggatcacgaggtcaggagatggagaccatcctggttaacacagtgaaaccccgtctctactaaaaatacaaaaaattagccaggcaaggtggcgggcgcctgtagtcccagctactcgggaagctgaggcaggagaatggcgtgaaccccagggggcggagcctgcagtgggccgagatcgcgccactgtactccagcctgggcgacagcgagactccgtctcaaaaaaaaaaaaaaaaaaaaaaaggacaaagtcttgctctgtcacccaggctggaatgcagtggtgtgatatcagctcactgcagcctccgcctcctgggttcaagcgattctctctcctctgcctcccgagtagctgggactagagacattcgccatcacactcagctaatttttctattttctttgtagagatggggtttccccattttgcccaggctggtcttcaactcctgacctcaagtgatcagcccttctcagcctcccaaagtgttgggattactggcatttcgtacctggcaccatactttttttttttctttgagacggagtctccctctgtcgcccaggctggagtggtggtgcaatctcggctcaatgcaagctccacctcccggattccacacatttttaataacagaaaagagaaactgtgaaccccacggaccaaagctcttcccattcatgaacccacatcccgagtcaggattctcccctgacgaccctcccatggtccctgcaaaatctgggagaaacgcggcgctgccgctgcagagctgcctagaaagggctccaggccatggcacagtcactgcgagaggaagagacaggaggcctggcggcccggctgtcagcgcagtcgccatcttaaggctgaagggggctgaggccaacctgggcaaggagaacttggggcgcacattgtggagctgactgcgaagaggcctgagtcccgccacagtcacttcccaccagttccaccctgcccctcttcctgtctcgggatgtcggccgggcactctcaccatttctatgcttccagggtgtcctggggttttagctgtggatctcccaatacctgcaggtcacagggccacagaggctgggcctccaggagaataggacacagaccagtgaagacgagacctgaaacgccggctgcagctagagacaaaggccgcgccaaaagcggaaagccgtcctcgtcgctccagctgcgtgcctgattggacggtttccagcccagcgtctctgattggataatgctttaggtcccgcccctcaggccctgagtgacagaagatgtgatcagatgctgggctaagtgaagagagacagcctaagctgcagcctttacaggcagggcttccttcctgagctgacccaggccccccccagagcatgagaaaattctcttttgtactcactctccttttgaatgtattcaaaaggtgaacagaagtattttgctggcatattaataatacataaaatttttgttcaagagaaaatcaacgtttactttgttagtagtgtattatcaatactaaagctaatgtttttttttttttttttgagacggagtctcgctttgtcacccaggctggagtgcagtggcggggtctcgctcacccgattttcctgcctcagcctcctgagtagctgggattacagctactattgttgaaaaacaatagacaatcacaaaaacaagctgacctttttgtgttccttaagccctgtcctgaagagccctgtgactgggctttatgccaaacaactcgttactaaagagctgtggtcccagactgcaccgaagcttcatgagacctctcctcgtctgtgcacggacgagtggccaactctggagcccaggctgttgcttccctgtctggtggtgaatcctccacagtctgatgagggtggtgtctgactctggagctcaggctgttgcttcttggtctggtggtgagtccttcatagtctggtgagtgcgggtgtcccactctggaacccatgctgttgcttcctggcctggtggagaatcttccagcctggagagtgcggtgtctgactctggagcccaaggctggaaacttggggacgtcccaaatcccggaatggaaactcccccagttctcccccttggcgtgccctatctggtgagtttcgggggaactcatgacccaagtcataataggaatttcaagcctcataaagacatcatggttgaagcagaggtgtttcgtttccagcaaagcccaatagcaagctaacaattgctcctcgaaagggttataagctttgctggcctctggcagtttctgggtccaaaaccagaaatgtacctcttcccatcttgtttctgcctaaggctccaattagcatgttgatctaggacagttacttgcagttctacgggaccatcccaaatgggtcatagatccagggccagttgcactgcttgtttatcttgttcggaagccatgatctctttctctccccaaagtcatagcgttttctggtggctgcatgcagaggttgtaacatgttacccaagtggggaatatgatgtctccagaatccaaacaagccaataaatttctgagcctcatttttagtggtaggggttgcaaattctagtattttaggcttagcctttggtaaaatgaattatttccctgcatttcataggatgcaaccagcccctatcttgacacattatcttataagcagtaaggaaacaccatccactctgggagatcccctcagcgtctcctttgctgactggaattccctgcagcacttcacgcacaaaggtctaaattgcactaatttagattcccaattcttacaaagtccggttccccttgaccattcaattgccaagggagagaactgggggagtttccatccggggatatgggaagtcctcgagcctcccgccctgcccttgttgctaaaaagtggcacacttttgtttttgaatcctgtttgtgacaccaaaagtgttctgtgcgggaaacgcacgagggggagaaggaaagacacacacacaatacctttaagggtaaacaagcttcattccacgtaaatagcaatgcagatataataagcaaattatgtaataagcaaatcaatataataagcagattgatataacaagtagattgatataataagcaaattgcaatgggaagaggagaaaggaaaaaatatatatatatttacactcaccagactatggaggattcactaccagagtgggaagcaacagcctgggctctagcatcggacattgcactcaccagacagtggaggcctcaccaccagatgggaagcaacagcttgggctccagagtcggccgctcattcctgcacagatgagaagaggtctcatgaagcttcagcccagtctggtatcctagctcttttgtaactagttgtttcgcatgaggcctagtcacgagggcctttcatgacccggcacgaggaacataaaaatgtcaacttgtttttgcgattgcctattgtttttcaataactaatgcataggaatagattgaaatagagatttctccaaaacagcactgaatgaacgcttgaaggggctcacacaacctgttctgggactcggtgaccattgtttgtgtccacgttcaattgagttcaaatttattatttaacttttcctccacaaattcgcctgtcttgatgaatcagctctgtctaggcaaagggcaaggtgaacctcttgggccttacacaacctccacctcctgggttcaagcgattcttctgtttcggtctccagagtagctggcactacaaaagtgcaccaccacaacctgctaattttttgtatttttagtagagatggagtttcaccatgttggccaggctagtcttgaactcctgacctcaagtgatccacccacctaggcctcccaaagttctgggattacaggcgtgagccactgaggttatcactaaatgatatctttttgtttcctataacaatgtgaaattacttaaaggtggtttcaaattgaaaaaataaaaagaatgcagataaaaataaaatataaaaagttcaaaaaattacaagagattacaaaatatacatgtatatcttgagaggtcaaaaatgacaaattttgtttatttacaaggttgtatttatttatttatttatatttttattttttgagacaaaatattgctctgttgcccacgatggagtgcagcggtgcgatcttggctcaccgcaacctccacctcacgggttcaagcgattctcttgcctcagcttccctagtagctgggaccacaggctcataccaggaggcccggctaattttttttatgtttagtagagacggggtttcactgtattagccaggatggtctcgatttcctgaactcctgatccgaccgcctcagccttccaaagggccaggattataggtgtgagccactgcaccagctttataaggttttattaaaattggctttagtgttgataatacactattaacaagtaaaagttgattttctcttgaacaaaaattttatgtattattaatatgacagcacaatacttccgttcatcttttgaatacattcaaaaagagagacaatgaaaagagatagaattttcccatgctctggaatgggcctggctcagctcaggtaggaagccctgtttgaaaaggctgcagctaggccaggcccagcggttcacgcctttaatcccaggagtttgggaggccgaggtgggtggatcacctgaggtcggtagttcgagtccaggctgaccaacatggagaaaccctgtctttactaaaaatacaaaaaattaaccaggcatggtgccacatgcctgtaatcccagctacttgggaggatgagatctattatatctcacagggtttacaatttctcttttctcctattataaatttatgaggccagcggctgggcatggtgactcatgcctgtaatcccagcactttgggaggctgaggtgggcagatcacttgaggtcagaagttcaagaccagcctggacaatatggtgaagccccatctctactaaaaaaatacaaaaaaattagctgggcattgtggcgtgtgcctgtaatcccagctactcaggaggctgaggcaggagaattgcttgaacctgggaggtggaggttgcagtgagccaagatcgtgccactgcactccagcctgggcaacagagaaaaactccatctcaaaaacaaacaaaaaaaatttatggggccaggtgcagtggctcacacctgtaatcccagcactttaggtggtctaggcaggtggatcacttgaggtcaggagtttaagacaaacctggccaaaatggggaaaccccatctctactaaaaatacaaaaattagttgggtgtgatggtgaatgtctctagtccaggctactcaggaggtagaagtgagagaataacttgaacccaggagtggaggttgcagtgagctgagatcatgccactgtactccagcctgggcgacagagcaagactctgtctaaaaacaaaaaaacaaacaaaaaaacaaaaaaaagtatgagtgtctctgccaaaatggaaataatttaatcaaacagtgattcaagaattgtcgagcacccagctatagtttgtagtttgtggtccatgggaggagcttgaaggaaagacatttatagggtgcatgatgaagaaaactatattcaataattgctcaggtatggttatgtaggttcttaatttgttcaattaaggtggaaatttcctggttatgtaatcagagcttaattgacagtttatagttgcttaagcctgaattttgtttcccctaatgtaaaactttttttttttttgagacggagtctcactgtatagcccaggctggagtgcaatggcatgatctcggctcactgcaacctccgcctcccaggttcaagtgattctcctgcctcagcctcccaagtagctggaactacaggtgcatgccaccatgcccggctaattttttgtgtgtatttttagtagagatggggtttcaccatgttagccaggatggtcttgatcttctgacctcgtgattcacctgcctcggcctcccaaaatgctaggattacaggcatgagccgccacacccggccctacccctaatgtagtaattaaccaaaaaatgtccttgagtttagatttttttattttagaagtaggaatttgaggactacagcctcctcagtttatttgcctgccacataattattttcataccacataggggactgattttccatggcatttttcacatatgcctcaagggtaccccatgttcttcagttaatcattttaaaaaagcattggctaacactattgaaaagatttgttttctgtttgtaaatatttccagtgagaagaaaggaaagactaatcccctgacactgtaaggaaggagaccacctttctgcttgtctcaagcctcagaaaaagaaaagaggaagcaaaagctaaagaaagtcagaaatgagatcaatagttagacagctcctggccactccccagggctggtagttaaaaatcagctcctgacctaactgcttgtattatccatagatttcaggcattgtatgaggaagcattgtgaaattttctgttctgtccggattaccgatgcatacacgctcagttatgtaccccatgcttgctcaatcaatcatgaccctttcacgtggactcctttagagttgtaagcccttaaaagggacagaaatttctgtctcagggagccggcttttgagacgcaagtctcctgatgctcctggccgaataaagcctcttccttctttaacctggtgtctgaggagtttgtctgtggctcgtcctgctacatttcttggttccctgactgggaagtgaggtgattagtggttggtcaaggcagtcttttaggtgacttaggcctgtcctgtggagcatccccgtaggggactccagccagcctgagagacacggatcctgagagtgctcccaggtaggcaattgccctggtggaatgccttgtcagtgcagtgcatgggaggcccctgtggaggatcaatgcagtggctgaacactgggaaggaactggcaacttgagtctggacatctggaacatggtaagaccggtcttagaaacttgctcactccatttgaggggaagcatggcctgatcacccatgacgtgcctttatcggcattttggttttggttttgattttgtcttggcttaaattgcttggcaccatggttttggttttgattttgatacagtgtgaattaggcaagtgtgtgaccttttaccctttccttcttgtagtgtgagttttgtcttgtctctagagaaaaatgggtcagacacaaagtaagcctaccccacttggaactatgctgaaaaatttcaagaagggatttacaggagactatggggttaccatgacaccagagaaacttagatctttatgtgaaatagattggccagcattagaagtgggttggacatcagaaggaagcctggacaggtcccttgtttcaaaggtattgcacaagatatcttgtaagccaggatacccagaccagttcccgtacatagacacttggttacagctagttttagacccccccacagtggttgagaggacaggcagcagcagtgttagtggcaaaggacaggtagccaagaagaatcccactccacccatcgagggaagtcggttcctaaagttctgtctgaccccatatcagaagactcatggcaggaaatggcaccagtgatgcctcccccttatcgagatgagagacccccacttctgagcccacagcacctgtgcctccacaggacacacacacccctagaccacccagagtaaacaagagaggatgtgaagccatgggagaaacccctcccttggtggctcatttaggacctaagactggaacacagatgcccctgagggagcagtgatatactggagtagatgaggacaggcatgtggtaaaaagtcatgcctttgtgtatcaacctttcacctctgctgatctcctcaattggaagaacaataccccatcttatactgaaaagcctcaagctttgatttgctccaaactattatccagactcataaccctacttgggctgattgccaccaactgctcatgtacctctttaacacagatggaaggtgaagggtgctccaggcagcaactaagtggctggaggaacatgctctggccaattaccaaaatgtccaagagtatgtaaggttccaattaccaggaacagactcccagtgggacccaaatgaagggccagacatgaaaagactaaaatgatatagggaggccctcctagaagggttaaaaaagggagcccagaaggccacaaatgttaacaaagtctccgaggtcattcaaggaaaagaagagagtccagcacaattttatgagagactatgtgaggcatatcgtatgtatactccctttgattcagatagccctgaaaatcagtgcatgattaatgtggctttagttagtcaaagcgccgaagatattagaagaaagcttcagaaacagactgggtttgcaggtatgaacacttcagttattagaaatagccaatcaggcgtttgtgaatagagatgcgacgggtcgtagagaaagccgtaaagaaagtgagcgccaagcccggtgaaatgctgacctgccagccacagctattaaaggggttcccccaaagggctgaggaatgggggaccccggggaaaacacacagtctgactgaccacgtctgcagcgtaaccggtgtgcttactgtaaagaaagcaggtcatttgcaacctaccagaacctaagaccaggaggcaggtgagagagttcttaggagctgtggggatctgcaggttatggatcccaaactttgcagtactggccaaacctctgtaccaagtcacaaaggggggcatccaggaaacttttgaatgggggtctcaacagcagcaagccttccatgaattaaaagagtaactcatgtcagccccagccctgggtctgcctgacctgtcaaagccatttacactatatgtgtcagagagagaaaaaatggcaattggggttttgatccaggctgtggggccctggctaaggctggtggcctacctatctaaacaactggacagggtttctaaagtttggcccccgtgtttgagagccttagcagcaactgccctgctagcacaagaaacagataaattaactcttgggcaaaacctaaacataaaacacctcatgctgtggtgactttaatgaataccaaaggatatcattggctaacgaacgctagactaaccaagtaccaaagcttgctctgtaaaagtctctgcataaccattgaagtttgtaacagcctgaaccccaccaccctgctcccggtatcagagagccctgttgagcataactatatagaggtgttgcactcagtttgctcaggttagcaaacctgacctatgggaccagccttggacatcagtagacttggagttatatgtggatgggagcagcttcatcaacccacaaggagagaggtgtgcaggatatgcacctctggatgcttttattgaagccaaataattgcctccagggttcttcagcccaggaggccgaactcattgctttaacttgggccctagagctaagtgagactgtgaacatttacactgactctcgatatgcctttttaaccctccaagtgcataaagcattatataaagaaacaggcctgttaaactctgggggaaaagatataaagtatcagcaagaaatcttgcaattattagaggcagtgtggaagccccagaagatggcagtcacgcactgcagaggacaccagtgaactcctactacagttgctttagggaactcctgagtggactcggaggctcaaaaggcagcatccaccccttaccgggcatcaatcacagccccctttctccctcaagaacctgaacttttacctacctattctaagggagaaaaaaactttttccaagtggaagggggacaggtaataaaggaaggatggatccaggtatcggatgggagaatagctgtgccacagctacttggagcagaggttgtactggctgtgcatttaactacccatctaggtcaggaatcacttgaaaagttgttaggccggtatttttacatctcccatttatcagctcttgccaaaacagtagcgcagcgatgtgttatctgccgacagcacaatgcaagacagggtccagccgttctgccaggtatacagacatatggagcagccccctttgaagatctccaagtgaacttcacagaaatgccaaagcgtggaggtaataagtatttactagttctactctgtacctggtacctactctgggtgggtagaggcttatccaacatgaactgagaaagctcatgaggcaacccgtgtgcttcttcaagatcttattcccaggtttggactgcccttatggatcagcttggacaacaggccagcatgtgtggctgacttggtacagtaaacatcaaaggtataggagatcacatggacactgcatgcagcctaccaaccgcagagttcggaaaggtggagtggatgaatcagacaatcaaaaacagtttagggaaagtatgtcagaaaacaggattaaagcggtacttttaaccctggtactgttcaagattgatgcaacccttcaaagagaacaggatattctccctatgaaatattatatcataggccccttcctatattacagggactcccaggcactccacaagagttaggtgaaattgagttacagtgacagctacagctacaggccttaggaaatttactcaaacaatttcagcctgtgtaaatgagaggtgccccatcagcttattctccccaattcaccctttctccccaggtgattgagtgtggatcaaagattggaacacatcccccttgcgaccacggtggaaaggagcccagaccatcatcttgaccacccccccacagctgtaaaggtagaaggaatcccagcctggatccaccatagctgaataaaacctgcagcctctgaaacctgggaggtgagactgagcccagacaacccctgcaaagtgattctgagaagtgtttgtgtccctgggtacttgagattagggagtggtgatgactcttaaggagcatgctgccttcaagcatttgtttaacaaagcacatcttgcacagcccttaatccatttaaccctgagttgacacagcacatgtctcagggagcacagggctggggatagggttgcagattaaaatggagtctcttatgtctactttctatatggacacattaacaatctgatctctctttcttttccccacagaaaaatattcacaactcattctgtatgatgtaaatatagcactcaaaactgtatgtgttcttgttcatgccctcaattttatactttattatctagaaaaatatatatgaaccgatgtggcggatcttatgctgctcttttttctcagagttagagaatatattagagaatatttctgtgttgaaaactattttattggataattttagtcatcctataagtcagaaccagttctctttatgctcgcatttcaccttaagtcaaattgaaaattctgctcatggccatttaagtaaaggtgtgtgtgtgtgtgtttcagggaccactgcaatttagggatgtggccacagaattctctctggaggagtggcattgcctggacactgcacagtggaatttatatagggatgtgattttagagaaccacagaaacctggtcttccttggtgaggataacctgaatacataattcataatataccctaaagattttatttctctttttttgcagaatttttttagtaatttattcttttcataaaagagtttcagatccactttttccagaaaatcttcagaatttgttcatttagaaaagaatttcttcaagatgtttcatcttaatccagactttccacattcctgagttgagctgtattcttcactctaaattagtggtaattccagaaacttagtggcataaaatattgttgccccacctgaaaatctaattgccaccaccaatttttgattcagtagtaccagatagtaaaattaagaaaccggcatattgaaagtattcttccttcctttttttttctttctttctctttttctttctttctttctttctttctttctttctttctttctttctttctttctttctttctttctttccttctttgtttctttgtttctttctttctctttctttcttctttctttctctctctctttctctctttctttctttcttctttccttctttttttttccttttttttttttttttttttgaagagtttcactcttgttgcccaggctggagtgcaatggtatgatctccgctcaccacaacatccacttcctgggttcaagcaattctcttgcctcagcctcctgagtagctgggattagaggcctgtgccaccatgcccggctaattttttgtatttttagtagagatggggtttctctatgatggtaaggctggtcttgaactcctgacctcaggttatccaccacctcagcctcccaacgtgctaggattacaggtgtgagccactgcacctggctgaaagtattttctaaatatttataaatttctgttatgaattagtattttggtattaatttactagaatattttattatatctgctctgctgagcacatttagtaatgtgcttataattggagaatatgagcaagactcatgttatttatttttaataaaacaggtattgttgtcctaagccagacctgatcacctgtctggagcaaggaaaaaaacccttgactatgaagagacatgagatgattgccaaacccccaagtaggtgtgagtgaaaatgaatacaagagacgacagagataagaggtcccaaggtcaatgagaaagcaagtttttaaaatgtgattcaggaagctgtgttccaaaggaaatagttcctgggcagctgtgttatttgtttatttatttatttaattttgctcctacaaaggggcatcttctgtcttatgattttaaattctctaaggattccacttttcttttggtgagcttccttcaagttcacagtgagagccaaagtcctcttcatggcatataagagactgcacaggctgggcacattggctcatgcctgtaatctcagaactttgggaggctaaggcagtggatcacctgaggtcagaaattcgagattagcctgaccaacatggtgaaacctcgtctttactaaaaatacaaaaattagccaggggggttgttgggcacctataatcacagctacttgggaggctgaggccaaagaatcacttgaacccagaagacggagcttgccgtgagccaagatcgtgccattgcaccccagcctgggcaacagagtgagactccatcacaaaaaaacaaaacaagacaaacgaaaaagagactgcacaatctggctgcttttccattgttttgcagatatgcaaatatctatttgcattatttagagaaactaaaattatttttcatgttatctttttgcatcaggtctgatatgtgtgagagtaatagtttctgttgcacttttttgtttatttttttcagcacagtctattctgtttttattactataaagtcttgaaatatagtttgaaattataagtatgatatttttctgctttattccttttcctcaagattgctttggctattcaaagtttattttagtttcatgtaaattttagaattgtattttccagtactgtgaaaaaaatgccactgcaattttgataggaagtctattgaatctatagatcactttggataatatggtactttattaatatttattctttcaatccatagacaaaatattttaaaatttatttggatcttctttaattttttcattttttattgtaaagatttttacctccttggtcaatttttttctcagaaatttattacttaatgctacagcaaataagatttttttccctctattttgttagatagtttgttttaagtgtatgaaactgtagccaggcacggtggccaacgcctgtaattccagcactttgggagactgaggtgggtgtatcaactgaggtggggagttcgagaccagcctgaccaacgcggagaaaccctgtcgctactaaaaatacaaaaattagctgggtgtggtggtgcatgtcagtaatcccagctactcgggaggctgaggcaggagaatcacttgaacctaggaggtggaagttgcagttagtcaagatcacaccattgcactccaggttggtcaaaagagcaagactcctcaaaaaaaaaaaaaaaaagtgtatgaaaccctatatatacttgtatgttaattttgtattttgctaatttactgagtgtacttaatagtttagacagattttaatgtactgtttatggttttttatatacacaattgtatgatctacaaacagcaactttttactttttttatttcaatagtttttttatttctttgactaattcttctgccacatacttccagtgctacattaaaatagaagcactggccaggctctgtggctcacagctgtaatcccagcactttgggaggccgaagcgggtggatcacctgaggtcaggagtttgagaccagcctgaccaatatgatgaaaccccatctctactaaaaatacaaaaattagctgggtgtgtcgacatgagtctgtaatcccagcaactccagaggctgagacaggagaatcgcttgaggcaggaggcagaggttgcagtgagccgagatcacaccaatgcacttcagcctgggcaacaagagcaaaactgcatctcacacctacacacacacacacacaaaatagaagcattgacaatgctcacaatatagttttgtattggtgtctgaattcaatgcagcaaatacctcttcaagttttcacaaactgattttagaaggtaaagatcttttgttggcccttagggtgatgagatgccctctgaatttgtagtgaagaggggttgtagcttggtcacaaggctgctgggtctgcactagggtccacctttagttggcttgttacaggggctttggtagttgtaattctcattttatttttagacagactgaatatccttcaagactttgttccatagggcagacactagggcaggtttttgcagtcaggtctgcatatgctgggccttgtatcaggatgtggatgagtgtggctttcagtgagtaccaaagagcatttcctcaggtaactgtgtgggtttctatataggcagaactgaccataaactgtggctcaggtaactgaaactgagtcattgaattgcttcagggaccacagtaaaggccaaagtctgcaggcctgcctacatggctgtaagtgtgtgccttcctccaggtcagggaatggcaggacctctgccagactgtggctgggaaaagtttgggatggttacagagtaagttctgaattttcagtaggaccaagttggatgaatcttatcctggtctgtagccaagaacaggggtcctgtagtttcgcacctgaatgagggcctgccttctgaataaaactcttctcaatcttaagctttgacagtgtttcacaactccctccctggatctcaaatctctcttagaggcacttattttggagatggcatcttgctacataacccaggctggtctcgaaatcctggcctgaagcagtgacataaccttaatgtaccatgtagctgtcattacatgtgtgagccacaatgcataaaggcatttttgtcaggtatggctgatatatatacatacacatatatatatatatatacatacacatatatatttttattgtaaggggatatgaaaatagggcacttttagtcttttcatttttttctttttctttttttttttttgatgtggagttttgctctttttgcccagactgtagtgcaatggcacgatcttggctcactgcaacctccgcctcccaggttcaagcaattctcctgcctcagcctcccaagtagctaggattacaggtacctgccaccatgcctgactaattttttgttatttttagtggagatggggtttcaccatgttggccaggatggtctcaatctcttgacctcatgatccgcacgccttggccttccaaagtgctgggattacaggcatgagccactgcacccagctagtctttttatcttactgatgtcactctccttatacatttttactttctattttctacttcaagtttgtctgtaattttagattcagatatttaaaacaatttgttaaaatttgcatattatgcctgcagtaaattagataattagtgggcactccatatttactaaaatatttacttataaatttaattttgctgctggcaaaaaggaattacagaattttcctctactttcttcagcctatatctgaataacaacatagtttattttctaattgttttacatatcagagggtctaaccctattctgcaaagtagatatatatattttctatatttaacaatgtaaggctattctttgcttcaaagttggattacagcagtttcattttgtgtaagaatagcatatatttaaaacaaatataactctagtttcttttaaatgctatttattagaagtttctcattagaatcttctatttataattatactccttattctctgaaattttactgccacacagtgcatgccaatgattcaaaatactcacatttgatgagtatacagtaatagttaaatattccagttacctagacaattttttttgtttttgtgagtctgagtcacgctctgtcacccaggctggagtacagtggtgcgggcttggcttactgcaacctccacctcccgggttcaagcaattctcgtgtctcagctttccaaggagctaagattacaggcataagccactgtgcctggcctcagtgtaggtttcttaacatcagttttttgtgtctgttggctttactttcgtattacaattttagacaatttgcaattctgtttgtacagtttaagtcaatttgaggtttaattaagagataaattatgcatgtttatcacaatcagattacatatgtctgtgtgtttatttataaatgtgaccccaattttagttatggcttatcctatattctttcttagccgattttcaatggcagttttatcttgtctaagtgagttgtcatggaggtagtcttatttttaccatgtgtttaatgatgaatacatatttcgttttgtgagagaaacactttagtgatttgaaggtaattttcaaaaagatttataattctgtatttttttcagttttttttttaaagaatttttttttgagacggagtcttgctctgtcgcccaggctggagtacagtggcgtgatcttggctcactgcaagctccacctcccaggttaacgccattctcctgcctcaggctcccgagtagctgggaccacaggcgcccaccaccaagcccagctaattttttgtatttttagtagagacggggtttcaccgtgttagcctggatggtctcgatctcctgacctcgtgatctgcccgcctcggcctcccaaaatgctgggattacaggcgtgagccaccacgcccgaacaaaagaaatattttaaaaacacataaaatgtaccatcttaaatctattgaagtgtatatttcatggccaggcatgtttgtggctctcatctgtaatcccaggattttgggaggccaagacagaaggatccctggagcctgaaagcttgagaccagcctgggcaacatatggagacctttctctattaaaaaaaaattaataattgccaggcatggtggtgtgcacctgtggtcccatctactttggagattgagggggagtcaaaattgtgcctctacattccctcttgggtgacagagtgagatcctgtctcaaaaaaaagctgttcatttcaggaatgttaattatattcgcattgttatgcaaagacttctagaaactttacatcttgtgaaacttaaactcagtacccattaagtaacaactgctaattttactctctctccagccctagactggacaaaccttccactttctctttttatgattttgacttcttaagatacctcatataaatggaatcatacagtatccattattttgttactggattaattcaggtgacataatattctcaaggttcatcttaaaatatgacatgatttttttttaaggtgggataatatttcatcatatgtatatgttacattttttgatatgtttataaatcaagagacatctgggttgcttcagccttttgtcttttgtgaatactggcacaataaacatggattttcaaatatgtcattattattatagcaagtggggtattgaaatagcctagtataattatatttctctctatgtgcttattcagttttgttagtatttgctttatatatttgaaaccctaatttgaaacacagacacacacaaatacacacaaatttgtgataagttcccagtgaatgaatctatgtattgtttaatgcccttctgtgtctttttgaagttttgacttaaagtacattttataaaatatgacagtttttgacttaagatgtagcttttgtaatattattttgacctcttctgctctcatttcattaatatttacatgaaatttctacttccatctcaccacttacagtctttgtcattagatctgaggtgactcttgtagaaaggcaagttggatcttgattttcaaattttttttttttgagatggagtctcactctgtcacccaggctggagtgcacgtggtgcgacctgggcttactgcaacctccgccttctgggttcaagtgattctcctgcctcagcctcctgagtagctgggattacaggcaggcaccaccatagttgactaacttttgtattttttgtagagacagggttttgccatgttggtcaggctggtaaaattttttaaaaaggctttttattgaaagtatgtctcttgattggaaagataattatatatatttaaatagttttctgaaagaggaaaacttaataatttgtgtgtgtgtgtgtgtgtgtgtgtgtgacagagtctcactctttcatccatgttagagtgcaatggtgcaatctcagatcactgcaacctctgcctcctaggtccaagggattctcctgtctcagccacctgagtagctgggatcacaggcacctgccaccatgcctggctaatttttggtatttttagtacagatggatttatgccatgttggccaggctgggcttgaattcctgaccttaagtgatccaacttccttggcttcctaaagtgctgggactacaggcataagccgccgcacctgaccaatgttactttattaattgttttatttgattcttgtatctttgtctctcattttttctgcctttgtgtgtgtgtttttttttaaatttttgtattgatatgctttcaattttcttcttattttcttttgtgtatctatacagatattttcttagtagtgtcttggggattacacaaaacctctaaaagatccaacaatatgtttaaatgaggtaaaaaattaacttcagttgaatgcaaaaattcttcatgattacatctgccttcaactttgttattgattttgctaattatattatttatttatttatttatttattttttgagacggagtctcgctctttctcccaggcaatactgcagtggcactatctcggctcactgcaagctccgcctcacgggttcacgccattctcctgcctcagcctcccgagtagctgggactacaggctcctgccaccgcgcccaacctccgcctcccaggttccagtgattctagtgcctcagcctcctgagtagctgagattacaggtgtgcaccaccacacttagctaatttttgtatttttagtaaaggcaggctttcaccatgttgaccaggctaccttttatttgtttgtatatttctttcttcctttccttctttatttctagaagcatgttcgttttaaaatataaattatgaatattaaaaatcttcttttctctgtctttgattactattatggctgatttaaaaataagttttggaagaagagaaaacggcagggcggcagcggctgtaggttgtgcggcggcagcggctcttccctgggtggacgatggacagccagagcaggaaggtggtggtgtgcgacaatgacactgggtttgtgaagtgtggatatgcaggctccaactttccagaacacatcttcccagctttggttggaagatctattatcatgtaatgcccaaccttgttttttcctttatttacctagccttgtttctcccttagctaagagaaccagacaaactccatcttggctctttcactggcagccccttcctcaaggacttaacttgtgcaaggtgactcccagcacatccaagaatgcaattaactgataagatactgtggcaagctgtatccgcactccccaagaattcatctgattgataacgcccaaagccccgcgtttatcaccttgtaatagtcttaaagcccctgcacctggaactgtttactttcctgtaaccatttaccttttaactttttgactacttaacttctgtaaaattgttctaactagacacccctccccttcctaaaccaaggtataaaagttaatcaagccccttcctctgggccgagagaactttgcacgttagccgtctctcggtcgccggctaataaaggactcttaattcatctcaaagtgtggcgttttcctaactcgctagggtacaacaatcagatcaaccaccaaagtgggaaacattgaaatcaaggatcttatggttggtgatgaggcaagtgaattacgatcaatgttagaagttaactaccctatggaaaatggcatagtacgaaattgggatgacacgaaacacctgtgggactacacatttggaccagagaaacctaatatagataccagaaattgtaaaatattactcacagaacctcttatgaacccaaccaaaaacagagagaagatggtagaggtaatgtttgaaacttaccagttttccggtgtatatgtagccatccaggcagttctgactttgtacgctcgaggtttattgactgctgtagtggtagactctggagatggcgtgactcacatttacccagtattagaaggcttttctctccctcatcttaccaggagactggatattgctgggagggatataactagatatcttatcaagctacttctgttgcaaggatacaccttcaaccactctgctgattttgaaacggttcgcatgattaaagaaaaactgtgttacgtgggatataatattgtgcaagagcagaaactggccttagaaaccacagtattagttgaatcttatacactcccagatggaggaatcatcaaagttgggggagagagatttgaaacaccagaagctttatttcagcctcacttgatcaatgttgaaggagttggtgttgctgaattgctttttaacacaattcaggcggctgacattgataccagatctgaattctacaaacacattgtgctttctggagggtctactatgtatcctggcctgtcatcacggttgaaacgagaacttaaacagctttacttagaaagagttttgaaggatgatgcggaaaaacttcctaaatttaagatctgcattgaagacccatcccgcagaaagcacatggtattcttgggtggtgcagttctagcggatatcatgaaagacaaagacaatttttggatgacccgacaggagtaccaagaaaagggtgtccttgtgctagagaaacttggtgtgactgttcgataaactccaaagcttgttcccatcacacccgtaatgctttcttttttcttttattgccaatctttgaactcattcaactccaggatatggaagaagcctttctctaccctttgactggaaaggtcaagttttattctggtgtcttgggggagctttgttaaatttttgttaatgtgggtaaatctgaatttaattcaactgcttccctacatagactagagggctaaggattctgtctgctgctttgtttcttctaagtaggcatttagatattcctgtaggcttcctattttcactttacctctctaatgctgctagtcactaggtggtacgcatttattagcataagaaaaaaactttaacaggagcttttacatattactgggattgggggtggtttgggatgggtgggcagctgctgaaccctttagagcatttcctctgtaatgtggtgctttcaactgtactgctgcagctttaagtaccttaaagcttctcctgtgaacatcttagtgaaatgttaggttcagaactaaagtgttttgggtagattttgttgctggggagggtaacagtgggtggtctgatttttatttttgaggtttttcacactggagtacatagaggaactttatttacagtattttgatttggcaggttttcttctacttgtgctctgcctggagctgtttccatatgataaaaaaagcaagtgtagtattccattactatgtggcttagggatttatttgttttttaaaatcaaccacgttagctgggactagactccctacaatccttcaatggaaaagtaacatttaaaaatccttggccgggcgcggtggctcacgcctgtaatcccagcaccttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaatcctttgggtaattcaaattacagatttgaaagtgcttaagatctggtgttttgttaatgcttctgtttattccggaagcattaaggtaacccattgccaagtatcattcttgcaaattattctcttatataactgaccagtgtgtaataaaacaagcaggtacttataaataattactggcagtaggttataattggtggtttaaaaataacgttggaatacaggacttgttgccaattgggtaattttcatttttctttctttttttttttttttttgagacagcgtcttgctctgtcgcccaggctggagttcagtggcatgatctcaactcactgcaagctccacctcctgggttcacaccattcttctgcctcagcctccagggtagctgggactacaggtgcccgccaacacgccccgctaattttttgtatatttaatagagacggggtttcactctgttagccaggatggtcttatctcctgaccgattgggtaattttcattagttgttttatttgttttgatttgaaacctaatttgactgtttaaaatgttggccaaaaaaatcaagatttaaattttttatttgtactgaaaaactaatcataacttaattttcagccatctttgaagcttgaaagaagagtctttggtattttgtaaacattagcagactttcctgtcagtgtcagaaaatcctatttatgaatcctgttgatattccttggtatctgaaaaaaatatcaaatagtacccatacatgaattatttctaagtttgaaaaataaaaagaaactacatcacactaattacaaaatacaagtttctctcgcatccgtgtggagaccaacaaacaggctttgtgtgagcaacaaggctgtttatttcacctgggtgcaggtgggctgagtctgaaaagagagtcagccaagggagataagggtggggtcgttttataagatttgggtagataaaggaaaattacagtcaaaggggggttgttctctggagggcaggagtgggggtcacaaggtgctcagtgggggagtttctgagccaggatgagccaggagaaggaatttcacaagataatgtcatcacttaaggcaaggactggccattttcacttcttttgtggtggaatgtcatcagttaaggcaggaaccacccatctggatttgtatgtgcaggtcacaggggatataatggcttagctttggctcagaggcctgagaacaaattctggaaaaaaatatttttcttcattttaaaacttttttttaaactaataatggctttgaaagaagaggcttaatttggggtgactaaattcaaaagaaattattgacttgagggtctctgtttggtaagaatacataattagcttaaataagcagcaaaaggttagttttaattatgtaacttctgttaatattaagtgttttttgtctgttttacctcaatttgaaaagataagtttgcctgcatgctggacatgcctcagaacacatgaatagcccatactagatcttaggaacatggatctttgagtcactttagactaagttcttatataaatatccccagctttttgagaacagagcttgttaaaggatgcacatgtagggccagtacctactggcaattgtgttcagggaaatgggattgacttggccatttgtcctttggtcataattttaaaatgtgggagtaaaaaacaacaaagaattgaatggactcttaaaacaatgaaagagcatttatcatttgtcccttgaatgtagaatttgtttttgatttcataattctgctgggaaacgtgacagttaaaatggtgtattatgtatatatattataatttagaaataccattttataattttactattccaaggtgacataatgcatttaaatttgggatttgggtggagtattatgtttaactggagttgttgtcaagtatgaatccctcaggaaaaaaaaaatctgttttaaaaagcaatctgattcttagctcttgaaactattgttacttaaatttccaataattaaaaattttaaatttttaaattagaattgccaatactttgacctttgagaagggtttcttagaaatacatttagtaatgtccccaagacattagtcttacatttaaacttttttctttaaaacatggtattggtggttaacttttacacagttctgagttctgctaatatctggaaagtatcttgagatatcagtggaaagctaaacagtctaaatttaacatgaaatacttctttttgattcagaaaataaaatcagatttttttaatgtcaaaagcattaaaaaattaaaaaaacaaaaataagtttttttgaaattatctgcataaaggtttttgcttcattattgacataacttgagacaatacagaaatgaaaatgaacatttgttagtaaaacagcaattatctagctcctggtagtgatttaatctctcacctagtctttagaacttccatcaagacaagaactctttttttccaagagtgtgtgatgtaaaatcacactcttgtttttttgtctttgtggcagaatttgggtatttatggtaatgaaaaagaattctaggtctcttttcagaagaaagatggtgatgatggaagcaaatataatggtacttggtacttagccacatttcaaagcatgccagtacaaagctaaatgaagaaagtcaaataggaaatgagaaaaaaatagctcctagaaacacataaaatgataacaatataattaacaaacaatttttttttttttttttttggttttagacagagtttccctcttgttgcccatgctggagtgcaatggcacaatcttggctcactgcaacctctgcctccgcggttcaagtaattcttttgtctcagctttcccagtagcttggactacaggcacatgccaccacgcatggctaacttttgcatttttagtagagagagggtttcatcatattgatcaggctgatctcaaactcctgacctcagatgatccacctacctcagtttcccaatgtgctgggattacaggcatgagccacagcgcctggataacaactttatttctttaagcaattattttaaatataagttaattaaactacttaataaaataaaatgaaatgtaattttaggactttggaaggccaaggtaggctgatcacttgatcccaggagttcaagacaggcctaggcaacatggcaaaactctgtctctataaaaaatacaaaaaagctagcctggtgtgacggcacatacttgtaatccaggtatttgagagactgaaatgagataatcagcagactttgagagattcaagcagcagtgaaatatgcaaatcagcctggttggcacagtgagttccattctgaaaaataaatgaggctgggcatggtggctcatgcctataatcccagccttttgggagactgaggcaggcagatcacttgatgtcaggacttaaagaccagtctggtcatcatggtgaaaccccgtctctctaaaaatacaaaaaattagcagggtgtggtggcagacacctgtaatcccagctactcaggaggctaagccaggagaattgcttgaacccaggaggtggagtttgcagtgagcagagattgcaccattgcactccagcctgggcaacaagagcaaaactccgtcgcaaaataaataaatacatatataggctgggtacagtggctctcgcctgtaatcccagcactttgggaggctgaggtgggaggatcatgaggtcaggagttcaagaccagcctggccaatatggtgaaaccccatctctactaaaaatacaaaagatagttgggtatggtggcacgcatctgtagtcccagatattcaggaggctgaggcaggagaatcacttgaacctgggaaatggaggtggcagtgagccaagattgtgccactgcacaccagcctgggcaacagagcaagactccatctctcaaaaaaataaaaaaataaataaaaataaataaataataaaaaaaaggaaatagaatgcttgtgcggttttttaaaaagcatacgctatgctgcctacaagagattcatttaagcattgagtcaaataggctgaaagtaacagaatgaaaaaaatgtacattccatgaaaatagtaaccacgattgagtgcagtggtcataattatattagacataatatgctttaagtcaggtagtaccatgagacaaagattgacgttatattatgttaaagtgagttgatttaccaggaatctataactataatatttacttatctatatatatatgtgtatataacatcagggctccaaaatatataaagcaactattgacaaaagtgaagcaagacatacatagcaacataattgtaaacatcaaaaccccatttgcaataataaatagaaagtttagataaaaaataagaaacagaaaacctagacaccattatagactatattaattattttgcatatagatgaatatttgagagtgcataatttataaagaaaaaaggtttagatggctcacagtttggcaaactgtataagtgtgtgccagcatctgcttctggtgaggatttcaggaagcttaaaatcatggtggaaggtaaagagtaactggatatattatatggtaagagacagagcaagtgtgaggtgaagaagccaggttcttttaatgaaccagctctcatttgaattaatagagtgtaaactttttggttaccaagaggatgtaccaagccattcatgaaaaatttgcccctatgacccaaatgtgtcccaccaggtcccacattcaacattgaggatttatattgcagcatgaggtttggaaaacatggacatccaaaccatattatagaccaactagcgttcgcagacacacacaaaactccccagtcaaaaccaagataatgcacaatattcttattttcatctggtgtattttgttagggcacatagcaggttttattaaattttaaaatactgactgggtacagtggctcttgcctataatcttaacactttaggagaccaaggtaagaggatccaccaggaattatgaatatttttcagatggaaaagacatgttgagttagaagacacctctcaaatttttttttttttttttttttttggagacggagtctcgctctgttgcccaggctggagtgcagtgctgtgatctcggctcactgcaagctccacctcccgggttcaggccattctcctgcctcagcctcccaagtagctgggactataggcgtctgacacctcacccggctaattttttgtacttttagtagagaacagggtttcaccatgttagccaggatggtctcgatctcctgacctcatgatcctcccacctcggcctcccaaagtgctgggattacaggcggagccaccgcacctggccaccttttttttttttttttgagatggagtttcgctctcgttgcccaggctggagtgcagtggcacgatcttggctcaccgcaacctcggcctcacaggttcaagcaattcttctgcctcagcctcccaagtagctgggattacaggcatgcaccaccacaccaggctaattttgtatttttagtagagatggggtttctccatgttgaggctgatctcaaactcctgacctcaggtgatctgcctgcctcggcctctgaaagtactgggattacaggcatgagccaccacgcccggccatacactgtgtattttctaacaaaaactgaattaaactaggaattaaaagcaaaagtcaaactggaaagttcaaaaatatgtatatataaaacacttcaatatatttttgctcaggggtcaaaaaattttatttttcaaaaatgtcaatacaacctaccattaaaagataatacaaagttgtttgtcagaaatgtttatttatttacagaaatagcattgattattgattagatatatatcgttatggtttagggtatgggatatagtgtccaatgtggcattattagtttaatttatagctacttgtggcaatagtgaacagtttcaagacatgaatacatagttcaaagaggggagaaataactgcacttttattttcatctctctgaatttgataaccaaaaggacttgcattttttagataaaagttttttatttcccaaatctcaagatctaaattcaaaatttggagctgcacatttagggcctgaatggctggagtagcagcaggtgttacctgtacatttgtgagcactttggcaagaggaggaaggggaaagtggagattctcatgtctatatgtctactcaatgcacacacgttactctgattgggtttctgggccaaatagtttctgtatcagttccagtctgaagatacaagagtcagtgaaagaggtaaaatgattgattgctgccctgtgaagtttgtagaaatgtgatctagcctctctagaagtgactgcagaggactatgaatgccaactaggcagagacacaattctgcctgcatatttaggggacagcatgcactttgctgcacaactctgagctgactggaagcctgagagggaaagtctcctctagagtaaattctggatgtcaccttatgtgtttatatcatgtctggtaattctagacagtgtttggaaacaataattaaatgaaaatttttctccaccccagagaaactccacaataatagaatagaaagaaactgttttattacacaattgaacttgaatgtgacacggatcttcatcaatctgcttaagagacggaaagatggtcactataattaggccacaagtagaagaatttccagcaccatgtcatacatagttcatcctaaattcacctggatactgaagaggccatctgtgtatgctaattacttatattcaatgacaaaaacttttcacatcttcataataggatgtagtttagcagcttgaagccaggtgcctgctgaaggtaggctttcactctgctacaaaaatggttgaatagtgttctatctttttggctacttacattttagagcagtggctctgtactccctggcactgggctacagcactcctgcttgctttctcctggttgctagtgtcctctcttggcctctaccatctgccactgaggcacaaaccacagctcacattttatgtgaatcctatttgccacagcagcactctagtgtcacatcagagagtgaggcctgagctgcaggaggagagcctgcaggcctcctgggtagaattacaccttcacaatcatgagaatgtgagcagtgtttcagcgtcaatttctacgtatagagatgacaaggaaaagataaagctgaattttcagcatgagtccagatagtgatagctgcaaaaattctcattgtgacagcccaccttaatctgacaccatgggacactaatagggcttctgaaacacacacccaaagcattggagagaaaaatgagatcttgatctgagcaagattattttcatagaaaaatattataaagatcttaagaaaaagctcagattagatatgattgatcaagtcagtcaaaaaatattcccctaaaagcaatttctctctaaacacccaaagtgcacagctactctcagcatgagaaacatgagcttcaggaagaaagaaggcagattttcagaagaattttataaagttttttttccatctttggtgctctctcatctcctagccagtgaatggagttctatattgaaatacatctgacaacttccaacaacactttttgatgaagaaatagaatctgactgttttcatagagtggaatatattagaacttgtaggctgggcgtggtggctcacgcctgtaatcccagcactttgggaggcagaggtgggtggatcacgaggtcaggagttcaagaccagcctggccaagatggtgaaaccccatctctactaaaaatacaaaaaagtagccaggcacggtggcaggcgcctgtagtcccagctactcaggaggctgaggaaggagaatcatttgaacctggagggtggaggttgcagtgagccgagatcatgccactgcactccagcctgggtgacagagtgaaactccatctcaaaaaaaaaaataaaaataaaagaacttgtaacatagttaactgaatagctattattggttttgggtggccacatcacctgtctttatttttcctgtaatagcagcattccaatttagtgcaataaaagatactaaagttgtgttaattcataattatccctattgaataaagtaataaacatgtcacactaatatctactgtaacaatttggtagtaaattttctttggatattaggtataagtatctaagtatgaataattttaatgaactagtcataatgtatgtagcattttaaaaaattgcaactatagccaggcacggtgtctcacatctataatcccagcactttgggaggcctaagcgtgcagatcatgaggtcaggagtttgagaccagcttggcctatatggtgaaaccctgtctctactaaaaatacaaaaattttagccaggcatggtggagcctgcctgtggtcccagctacccgggaggctaaggcagaagaatcgcttgaacccaggaggcagaggttgcagtgagatgagattgcagcactgtggtctagccaggacaaaaaagtgagactccgtctaaaaaaaaaaaaaaaaaaaaaattcaactatacttcagttaaaacactatatttcaaaagtataaataacaatattaaaataacaacttaagtgattcattcaaagtaagtattgtggctttatattcatattatgtagaaaatactgtttacaggtcacgcctgtaatcccagcactttggaggagtgaggcggttggaccacctgaggtcgggagttcaagatcaagctggccaacatgagaccctcatctatactaaaaatacaaaaacttagccaggcatggtggcacatgcctgtaatgccaggtacttgagaggctaaggcaggagagtcgcttgaacctgagaggcggtggtttcagtgatccaagatcatgccactgcactccaacctggacgacatggtgagactctgtctcaaaaaaaataaaatactgtttaatgtatatgaatgcaatttgtttacaaaccctacacataactatgctaatcgttctgaagtaataaatagaaagcaagatacaactacagactctactgttcagtttatgcactgaactgtttttgctttcaccgtataagtccttcagcctgcaaatattgggtaattaccttggataatcagatttctttcaaagaaacttagtatctttcagtctttatcattctgtattgcaaaatttaatcctatctttgtgctaagcatctgtgtgctcttaaaatgagcatttatctaaaccatctgtgtctactttaaaggactaaaaatgaaaaagataaacttttcagaagcaaaaagaaagcaaaaaacctgaagtactagataaagataatctggagtctgaaaaaatgactaaaggtttatttaactgttaatataatttacatatatttcaaaaaagcagagaaaaatatctacatataatcaaaatgccttaagaaaagagagaatagtaaaatagctttttgatactttttaaagagtttttgaactcttggacacctgaattttgcacactatatgcacttaaggtgatgcttatgggagaaaaacacaagagagaatgatgttataaaaaaatccatgcatgcaaaagacctttgcaacagaatagagagaccagaaataatgccaccctcctacaaccatcagatttttgtcaaacctgacaagagaaaagtgggaagaattctctctttaataaatgatgctggaataactacctagcactatgtagaagacagaaactggaccccttcattacaccatatacaaaaatcagctcaagataaattaaagacttaaatgtaaaacttaaaattataagaaaccctgcaatataacctaaaaaatactgttctagacatagaaactggcaaagacttcatgatgaagcttccaaaagctattgccacaaaagcaaaaattgacaaatgggacctatttaaactaaagagcttcttcacagcaaaggaaactatcaacagagtaaagagacaacctacagaataaaagaaaatatttgcaaactttgcctctgacaaaggattaatatccagaatttattaagagctcaaacaagtttacaagaaaaaaaacaaacaacctcattaaaaagtagaaaaaaaatgaacatattcttttcaaaagaagacaaatgtgcagttaacaagcatgtgaaaaaaatgctcattgctaattattagagaaattaaaagaaaaaccacaatgagatactgcatcatacccatcagaatggctattttttaaatgtcaaaaaataacagatgctggcaaggttgcagagaaaagggaatgcttatactctgctggtgggagtgtaaattagttcaacagctgtaaaaagcagtgtggtgattcctcacagaattaaaaacagaattatcatttgactcaggaacctcataattgggtatatacccaaagaaatataaattattataaagacatatccacatgcatgtttattgcagcactattcacaatagcaaaggcatggacgggtcctgaatggctatctatgatagactggataaggaaaatgtggtatggtcagatgcggtggctcacgcctgtaattgcagcactttgggaggctgaggcaggtggatcacacggtcaggcgtttgagagcagcctggccaacataatgaaaccctgtatctactaaaaatacaaaaaattagccaggtgtcgtggcaggcacctgtaatcccagctactcacgaggctgaggcaagagagtcacttgaacccaggaggcagaggttgcagtgagccgagatcacgccagtgtactccaaccgaggtgacagtgtgagactttgtcaaaaaaaaaaaaacaaagaagaagaaattaaaaaaaaagaaaaacgaactggacctttaataacttcctctttctggcttaatattagccttagcttggagtctcttggttaaaactttaatttccatgtcagaggtattcacttggtgttgaaactaactgaaaaatccggtgaaactactcaaagtgtttacataagggaaggaaatttaaagtgctcacttttttttaatggtttttttttttgagatggagtctctctctgtcacccaggctggagtgcaatggcacaatctcagctcactgcagcctccacctcccgtgttcaagccattctcctgcctcagtcttccaagtagctgggactacagtcatgcgccaccacactcggctaatttttgtaattttagtagagacggggtttcgccatgttgggcaggctggtctcaaactcctgaccttaagtgatcaaaccgcctaggcttcccaaagtgttgggattacagttatgagccagtgtacctggctaagatgcttacattttattcctccataagaaaagcaaatatatctacttctttcagacaatatatgtattattttattatttctattaaaaataatgtagtaaaaaattagtcatatgagaaaacttgtagaagataccatgtttcatcacatataatttagcatttaattcagaaatcaagacaacatgatatagaactgagatattcactgtcacaaatttaccctgcaaaaagaggaactgatgttttgacaagtctatgtaactcatcaattatctaccacattttcctgtggaaatatgtttattgtctacagtcaaaacagaagagagattttctttctttcttttttttttttttttatggagtctatctctgttgcccaggctggagtgcagtggtgtgatcttggctcacggcaacctccacctcccaggttcaagcaattctctgcctcagcctcccaagtagctgagattacaggtgcctgccatcgcgcctggataatttttgtatttttagtagagacagggtttcactgtcttggacaggctggtgttgaaatcttgaccttgtgatgcatccgcctcgtcctcccaaagtgctaggattaccggcatgagccactgcgcttggctgatagctagcattcttaaagctaaggcttggaattctgtttgaaatcactcagccatagaaaacacctggccaggcatgggggctcatgcctgtaatctcagcactttgggaggctgaggcaggcagatcacgaggtcaggagttcgagaccagcatgaccaacatggtgaaacctgtctctactaaaaattaaaaaattagccgggcatggtggcatggtacctgtaatttcagctactcaaaaggctgaggcaggagattcccttgaacccgggtggcaaagctgagatcatgccacttgttggggtgatcagacccaataccagaccattgtggctatgaagtccagtggagtcaaaggaatgagaaaagacaggttaagagtacataaggtgggtccagagggccaaagctagtatggaaactgtgagggccccaagctttggaagcccacactatttattggtgatcaaacaaagaagcaggtggtgaggatgtgtggatgtgggggtaaacaggtgaggacataaggacgtgagggtagaaaggtaacagtgcatcaagtgtagctgtgacggtttagcattttctttgacacataaagagtatgctctgctgcttgagataatggagaacatatttatgagcctgggagagcaaccaacaagtctgtgcacattctagaggccacgaggggttttatgccctgagccttggattccatccaagccgtgaggggttttatgccctgggctcagatttgtgttttgtcagggcagccttccaccatttggcacagagtttgatgttccaaaggccatgagggattttagaccctggacccaggacatcttccaagactcttttatattatgacagacaagccagtcctgcctcagctcttctaccaacaccactgcacttcagcctggttgacagagctagactccatctcaaacaaaaacaaacaatcaaacagaaaaacacctgaaaatattcctaaggttactctgggaaagaaaaaggtaaataagaattattaactaatagaatatatgattaaatactaatttttgaaactcatctctattatgtcttttgtaaatattttcttatttttcagcccctactaataaaatgcaaatcacagtaaaaaatactgatacagctcagtgcagtggctcatgcctgtaatcacaacactttgggggccaaggcagggagatcacttcacaccagaagttttggagcagcctggtccctctctactaaaaacacaaaaactagccaggcaaagtgttgtgcacctagctacttgggaggccaaggaatgagaatcacttgaacccaggagggggaggttgcagtgagccgagatcaagccactgcattgcagcctgtgtaacagagtgaaaccgtcaaaaaaaaaaaaaaaaaaaaaaaaaacccgaaaaaacgaaaaaacctgaggtcaaaataagtaaagaaatcttttcaatgtacagacccaatcatccaacccatcctgttcacttacatgctcaataaccaccctcccaggagacactgctctatgccccagtgagtgccccaggtgcattttactttgtttttatgccatctcactggggtcagtttttttgtcttttggaattttttatttttattacaaaattttcactgtttttatttcactgtttttctgcccccactcaagaaaatccagggggcagaaattatttgttttgccctcaataccagcatttgattggctgaccagcaatgtgtatccaaaaaatggaagctaggttgggtgaagaaaatcttcatgtctcaaggggttagctttaaaaaaagaaaaagaaaaataaaaacaaacatgcaccaggagatgcctttcacctccaaggctgccacctgctcccttgagaggctacactccatacttcaggtggttctatgggagaaaatgacccaagagacaatagtcactagacacatagccatagccatagtgggtatcttggtttatccccagaaagtactaaaacccaggcccagaaaaaaaaaactgaaggatagctgaggacacatcaccctatgaagtttccaaagggtaatcttaacctaaaaacattctggtaagttctctggaaaaaaaaaagcaaaagagggacagatatttttacaatacagtgtcaggggattattctttgctttcttctcagggaaaatatttacaaacagaaaaaaatctcttcaatactgttatgccatgctttgtataaaatgattaattgaggaacatggggtacacttgaggcgctgcttggggcacatgtgaaaaatgccaggaaaaatcagtcccctgtgggatgtgaaaataattaagtggcaggcaattagactgaggatgctctagtacccagattcctacttctaaaaaaaaaaaaatctaaactcaagtgcattttttggtaaattactacattaggggaacaaaattcaagcttaaacaactataaactaccacttaaactctgattaaataaccagggaatttccaccttgattgtaccaattaagaaactacgtaactgcatctaaccaattattgaatttggttttcttcttcatgcaccttataaatgtcttttcttcaagaccctcccacggagaacaaactacaaactatagctagctggtctacaattcttgaatctctctttttgaggctgggcacggtggctcaagcctgtaatcccagccctttgggaggctgaggcgggcagatcacaaggtcaggagatcgagaccatcctggctaacacggtgaaactgcctctctactaaaaatacaaaaaattagccaggcacggtggcaggagcctgtagtcccagctattcaggaggctgaggcaggagaatggtgtgaacccaggagatggagcttgcagtgagccgagattgcgccactgcactccagcctgggtgacagagcgagactccgtctcaaaaaaaaaaaattatttgatatttttacagtgactcccaaaattttttttttaagacagactcttgctctgtcgcccaggctggagtgcagtggcatgatctcagctgacaacaacctcggcctcccaggttcaagccattctcttttctctgcctcccgagtacctaggactacagacattcgccatcacacccagctaatttttgtatttttaggagagatggggtttccccattttgtccaagctggtcttcaactcctgacctcaagtgatctgcccccctcagcctcccctagtccccacacaatctgggagagatgccacactgcgggtgcagagtcacctggagagggctccaggccagggcacagtcactgagcagggaagagaaaggacggccgggagcccagctgtcagcatagcggccatcttatggctgaagggtactgaggctgagctgggcaaggagaactcggaaagcagattgtggagctgactatggggaggcctgggtcctgccacagccattttcctgccaagggaggctgtgactgagcgggctacccagcctgggaaactgctttttccatggaactgtgcaacccacagttcagaagattccacttgtgaacccttgccactggagcctgagatctgaaccctggaggtgagcaattctcaacagcctctctcctagaatctgcttaagcctgccaagatcccgggggaggggtgtggggaaaagagagatcagactgctactgtgtctatgtagaaagaagtagacatgagactccattttgttctgtactaagagaaattcttctgccttgagatgctgttaatctgtaaccctagccccaaccctatgcttcctgagacatgtgctgtgttgactcaaggtttaatggatttagggctatgcaggatgagctttgttaaaaaagtgcttaaaggcagtatgcttgttaaaagtcatcaccattctctaatctcgagtacccagggacacaatacactatggaagttggcagggatctctgcctaggaaagtcaggtattgtccaaggtttctcctcatataatagcctgagttattgcctcatgggaagggaaagacctgaccatcccccagcctgacccccataaagggtctgtgctgaggaggattagtaaaagaggaaggcctctttgcagttgagacaagaggaaggcatctgtctcctgcttgtccctgggaatggaatgtcttggtgtaaaacctgatcacacattctatttactgagataggagaaaactgccttatggctggaggtgagatgtgctggcggcagtactgctccttaatgcactgagatgtttgtgtaaagtcaaacataaatctggcctacgtgcacatcaacgcacagtgtctttccttaacttatttatgacacagagatcttttctcacgtgttttcctgctgaccctcttcccaccattaccctatagtcctgccacatccccctctctgagatggtagagatagtgatcaataaatactgagggaactcagagaccagtgccagcgcgggtcctctgtatgttgagtgccggtcccctgggcccactgttctttctctatactttgtctctgtgtcttatttcttttctcagtctctcatcccacttgatgagaaacacccacaggtttggaggggcaggacaccccttcatctggtgcccaatgtgggtgcttttctttaggttgaaggtatgccagagcgtggtcattgaggacaagttgatgagagattcccgagtacatctatggtcagccttgcggtaagcttgtgcgctcagaagaacctagggtaacaatgggataaactgaaagtaaatatgcctcttagctttattaaaattcttttaagaagagggggagttagagtctctacagaaaatctaatcacgctacttcaaacaatagaacaattctgcccatggtttccagaacagggaactttagatctaaaagattgggaaaaaattggcaaagaattaaacaagcaagtagggagggtaaaatcatcccacttacagtatggaatgattgggcccttattaaagcagctttagaactgtttcaaacaggagaagatagtttcagtttctgatgcccctgaaagctgtgtaatagattgtgaagaagaggcagggatagaatcctagaaaggaacggaaagttcacattgtaaatatgtagcagagtctgtaatgactcagtcaatgcaaaatgttgactacagtcaattacaggaggtaatatatcctgaaacattagaattagaagaaaaaggtccagaattagtggggccatcagagtctaaaccatgatggccaactcctcttccagcagttcagatgcctgtaacattacaacctcaaatgcaggttagacaagtacaaacctgaagagaataacaaatagagaaagatagagtatctgtcacagcaatgccaatccaaatacagtatccacaatatcagctggtagaaaataagacccaactgccagtagcctatcaatactggccgccagccgaacttcagtattggccgcccctagaaaatcagcatggacagccaggaatgtttccagcaccacagggcagggcactatatccgcagcctcccactatgagacttaatcctacatcaccacctagtagacagggtggtgcattacataaaattattaaagcaagaaaacaaggagatatcgaggcgtggcagttcccagtaatattagagccgataccacctgaagaaggggcccaagagggagagcctcccctagctgaggccagatatgagtccttttctataaaaatgctaaaagatgtgaaagagggagtaaaaagtatggactcaactccccttatttgaggacattattaaattccattgctcatggacatagactcattccttttgattgggagattttggccaaatcatcactctcaccctctatcttttacaatttaagactttgtggattgatggggtacaagaacaggtccaaaaaaatagggctgccaatcctccagttaacataaatgcagatcaactattaggaacaggtcaaaattggagcactactaatcaacaagcaataatgcaaaatgaggccattgagcaagttagagctatctgccttagggcctgggaaaaaaatccaagacccaggaaccacttgcccctcattcagtactataagacaaggctctaaagagccctaccctgattttgtggcaaggctccaagatgctgctcaaaagtcaattaccggtgaaaatgcccataaggtcatagtggagttgatggcatatgaaaacaccaatcctgagtgtcaatcagccattaagccattaaaaggaaaagtcccagcaggatcagatgtaatctcagagtatgtaaaatcctgtgatggaattggaggagctatgcataaagctatgcttatggctcaagcagtaatgggagttgctttaggaggacaatatttgggggaaatattataattgtggtcaaattggtcatgtaagaaagaattgcccagtctcaaataaacaaaatataacaactcaagctactacaacaacagataaagagccacctggcctatgtccaagatgtaaaaaaggaaaacattgggctaatcaatgtcattctaaagttgataaaaatgggcaaccattgtcgggaaatgagaagaggggccagcctcaggccccgcaaaaaacggggcgttcccagttcagccctttgttcctcagggttttcagggtcaacaatgcccactgtcacaagtgcctcagggaatgagccagttaccacaatacaacaattgttccccaccacaagtggcagtgcagcagtagatttatgtaccatacaagcagtctctctgcttccaggggagcccccacaaaaaaatccccacaggggtatatggcccactgcctgaggggactgtaggactaatcttaggaagatcaagtctaaatctaaagggagttcaaattcatactggtgtggttgattcagactaccaaggcgaaattcaattggttattagcccttcaattccttggagtgccagtccaggagacagaattgctcaattattactcctgccttatattaaggttggaaatagtgagataaaaagaacaagagggttgggaagcactgatccaacaggaaaggctgcatattgggcaagtcaggtctcagagagcggaccggtgtgtaaggccattattcaaagaaaatagtttgaagggttagtagacactggagcagatgtctctatcattgctttaaatcagtggccaaaaaattggcctaaacaaaagactgttacaggactcatcggcgtaggcacagcctcagaagtgtatcaaagtactatgattttacattgtttagggtcagataatcaagaacgtactgttcagccaatgattacttcggttcctgttaatctgtggggttgagatttattacaacactgggatgcagaaatcactatgcccactccattatacagccccatgaatcaaaaaatcatgactaagatgggatatgtaccaggagagggactaggaaaaaatgaaaatggcatgaaagtcccaattgagactgagagaaatcaagaaagaaaaggaatagggtatccttcttaggggtggccactgtagaacctcctaaacccattccattaacttggaaaacagaaaaactggtatgagtaaatcagtggccactaccaaaacaaaaactggaggctttgcatttattagcaaaggaacaattagaaaagggacatactgagccttcattctctccttggaattctcctgtgtttgtaattcagaaaaaatctggcagatggcatatgttaactgacttaagagccataaatgccataattcaacccatggggcctctccaacctgcattgccctctccggccatgatcccaaaagactggcctttaattataattgatctgaaagatcgcttttttaccattcctctggcagagcaggattgtgaaaaatttgcctttactataccagccataaatagtaaagaactagccaccaggttgcagtggaaagtgttacctcagggaatgcttaatagtccaactatttgtcagaatttcataggtcaaactcttcaaccagttagagacaagttttcagactgttatatcattcattatgttgatgatattttatgtgctgtagaaacgagagacagattaatttattgttatacatttctgcaagcagaggttgccaacacaggactgacaataacatctgataagattcaaacctctactccttttcattatttagggatgcagatagaaaatagaaaaattaagccacaagaaatagaaataagaaaagacacattaaaaacattaaatgactttcaaaaattgctaggagatattaattggatttggccaactctaggcattcctacttatggcatgtcaaatttgttttctatcttaagaggagacccagacttaaacagtaaaagaatattaaccccagaggcaacaaaagaaattaaattagtgaaagaaaaagttcagttgcacaaataaatagaatagatcccttagccccactccagcttttgatttttgctactgcacattctccaacaggcatcattgttcaaaatactgatcttgtggaggggtcattccttccccacagtacaattaagacttttacattgtacttggatcaaatagctacattaattggtcaggcaagattacaaataataaaattgtgtggaaatacccagacaaaatggttgtccctttaaacaaggaacaagttagacaagcctttatcaattctggtgcatggcagattggtcttgctgattttgttggaattattgatcatcattacacaaaaacaaaaatcttccagtttttaaaactgactacttggattttacctaaaattaccagacataaacctttagaaaatgctctgacagtgtttgctgatggttccagcaatggaaaggcagcttacacagggccaaaagagtgagtaatcaaaactcagtatcaatcggctcaaagagctgagttggttgtagtcattatagtgttacaagattttaatcaacctattaatattgtatcagattctgcatatgtagtacaggctacaaggggtgttgagatagctctaattaaatatagcctggatgatcagttaaaccagctgttcaatttattacaacaaactgtaagaaaaagaaatttcccatttatattactcatatttgagcacacactaatttaccagggcctttaactaaagcaaatgaacaagctgacttcctagtatcatctgcattcataaaagcacaagcactttgtgctttgactcatgtaaatacagcaggattaaaaaacaaatttgatgtcacatggaaacaggcaaaaaatactgtatgacattgcacccagtgtcaagtcctacacctgcccactcaagaggcaggagttaatcccagaggtctctgtcctaatgcgttatggcaaatggatgtcacacatgtaccttcatttggaagattatcatgtgttcatgtaacggttgatacttattcacatttcataagggcaacctgccagacaggaaacagtacttcccatgttaaaaaacatttattgccaggcgcggtggctcatgcctgtaatcccagtactttcgaaggccaaggcgggtgaatcacctgaggtcaggagttcgagaccagcctcaacatggagaaactctgtctgtactaaaaatacaaaattagccaggtgtggtggtacatgcctgtaatcccagctacttgggaggctgaggcaggagaattgcttgaacctgggaggcagaggttgcggtgagccgagatcgtgccattgcactccagcctgggcaacaagagtgaaactccgtctcaaaaaaaaaaaaaaaaaaattattatcttgttttgctgtaatgggaattccaaaaaaaaaaaaaaaaaaaaaaattaaaactgacagtgggccagaatactgtttttaagctttccaaaaattcttaaatcagtggaaaattatacatacaacaggaattccctataattcccaaggataggccatagttgaaagaagaaatagaacactcaaaactcaattggttaaacaaaaagaagggggagacagtaaggagtgtaccactcctcagatgcaacttaatctagcattctatacttcaaattttttaaacatttatagaaatcagactactacttctgcagaacaacatcttactggtaaaaagaatagcccacatgaaggaaaactgatttgatggaaagacaacaaaaataagacatgggaaatagggaaggtggtaacgtgggggagaggttttgcttgtgtttcaccaggagaaaatcagcttcctgtttggatacccactagacatttgattctacaatgaacccatcggagatgcaaaggaaagcacctccacggagacggaaacaccgcaattgaacaccattgactcataagatgaagaaaaaggtcatgtcagaagaacagatgaagttgccatccaccaagaagacagagccgccgacttgggcacaattaaagaaggtgacaccgttagctaaaaaaaagcctggagaacacaaaggtgacacaaactccaaagggtatgctgcttgcagctttgatgattgtatcaatggtggtaagtctccccattcctgcaggagcagctgtggctaattatacctactgggcctgtgtgcttttcccgcccttaattcaggcagtcacctggatggataatcctattgaagtatatgttaataatggtgtatgggtacatggccctacagatgatcgttgccctgccaaacccaaggaagaaggaatgatgataaatatctccactggatatcgttatcctcctatttgcctagggagagcactaggatgtttaatgcctgcaatccaaaattggttggtacaagtacctactgtcagtaccatcagtagattcacttatcacatggtaaggggaatgtcactcaggccatgggtaaattatttacaggacttttcttatcaaaggtcattaaaatttaggcctaaagggaaacattgccccaaggaaattcccaaaggatcaaaagacatagaagttttagtttgggaagaatgtgtggccaagagtgcagtgatattacaaaatgatgaattcagaactattatagattgggcaactcaaggtcaattctaacacaattgcacaggacaaactcaatcatgtcccagtgcacaagtgagtccagctgttgatagtgacttaacaggaagtttagacgaacataagcataaaaaattacagtctttctacacttgggaatggggagaaaaaggaatctctactttgattggacttcagcgaagactccaagatggcaatcgccacctcggataccctaactcagcatttccgggttcacctttcctgttcccaccaccccgactaacgcacatgcccactagggcgtgtcacactcagaagtgtgaaactcaaccgatcccgcccctaccccgaccactcctcacccagcatccataaaagcgcgctgcacctttcgcacagcgtgacttcccctggcggaccagtgaacctcaccggagagctcaataaagaagatttttgccctctttgtcttgcctcttggccttattgatccacggtgcctttccattgcctttcatactccaagaccaaaaataataagtcctgtttctggtcctgaacatccagaattacagaggcttactgtagcctcataccacattagaatttggtctggaaatcaaactgtagaaacaagagatcgtaagccattttatactatcgacctaaattccagtctaacagctcctttacaaagttgtgtaaagcccccttatatgctagttgtaggaaatatagttattaaaccagacccccaaactataacctgtgaaaattgcagattgtttactagcattgattcaacttttaattggcagcaccgtattctgctagtgagagcaagagaaggtgtgtggatccctgtgtccatggaccgactgcgggtggcctcgccatccgtctgtattttgactgaggtattaaaagacattttaaatagatccaaaagattcatttttactttaattgcagtgattatggggtggcaaaagaattctacaagattgtggaattcacaatctggtattgatcaaaaattagcaaatcaaattaatgattttagacaaactgtcatttggatgggagataggcttatgagcttagaacatcatttccagttacagtgtgaatggaatacttcagatttttgtattacaccccgagtttataatgagtctgagcatcactgggacatggttagacgccatctacaaggaaaagaagataatctcactttagacatttccaaattaaaagaacaaatttttgaagcatcaaaagcccatttaaatttggtaccgggaactgaggcaatcatgggagttgctgactgcctctcaaatcttaaccctgtcacttgggttaagaccatcagaagtactactattataaatttcatattaatccttgtgtgcctgttctgtctgttgttagtctgcaggtgtacccagcagctccaaagagacagggaccatcaagaacgggccatgataacgatggtggttttgtcaaaaataaaagggggaagtgtggggaaaagaaagagagatgagactgttactatgtctatgtagaaagaagtagacataagagactccattttgttctgtactaagagaaattcttctgccttgagatgctgttaatctgtaaccctagcctcaaccctgtccttgcagagacaagtgctgtgttgattcaaggtttaatggatttagggctgtgcaggattactttgttaaacaagtgcttgaaggcagcatgcttgttgaaagtcatcaccattctctaatctgaagtacccagggacacaatacactgcggaagcccgcagggatccctgcctaggaaagccaggtattgtccaagggttctccccatgtgatagtctgaaatatggccttgtgggaagggaaagacttgaccatcccccagcccgacacccataaagggtctgtgccgaggaggattagtaaaagaggaaggcctctttgcagttgagataagaggaaggcatctgtccctgggcaatggaatgtcttggtgtaaaacccaatggtatattgtatttactgagataggagaaaaccgccttagggctggaggtgagacgtgctagcggcaatactcctcttcaatgcaccaagatgtttatatacgtgcacatcaaggcacagcatctttccttaaaattatttatgacacagagacctttgttcacatgttttcctgctgaccctctccccaccattaccctattgtcctgccacatcccctctccaagatgatagagataatgatcaataaatactgagggaagtcagagaccagtgctggcgcaggtcctccatatgttgagtgccagtcccctgggcccacttttctttctctatactttgtctctgtgtctctttcttttctcagtctcttgtcccacctaacgagaaacacccacaggtgtggaggggctggccacccctttagctgtgtgatagataagtaaaaacagcaccatctaattcataatgggaagggtgtttctttccataagctgttcctagagtacacaaaggatggagaattttaccaatcacaaatattttcctggattatctatccattttatatttccccatgtattttctttgttctatgcatttcttccatttggcttttcctggggtgcatcctatatattaaaccagtaaacataactacagtgtttttctgagttctgtgagtagctctaccaaattactgaacttcagggaggttttgggagtctccagttttcaaacagtgtgtcagaagtataaatgggcccatggggtttgtgactggcatctgcagtgaggacaaggttgtgggactgagccctgaatcagggtctgtgctgactctgggtggtgtcagaattcaaatgtaagacaatgagctggtgttgaagaattgtttgatgttcagcaaactacagattttgtgccagaaaaagcatatcatggaggcctggcctggaacaaaactctgagtgtctgggaatgggaggctctgctctcctgcacacaggctgtcacgctgcccgttgtcctgtgattccagctcttctcccagggtgacagaggactgaaacttacaggaaaggagctctgatgacagaccccttttctttcaactgcatccacaggattcccactcactcacaaacatacatactagacattgatgtgtccgcactcctcccaggactaggcaccaccctcaggaacttcaccatggcatttttgatccaaatgtttcttgccaagaactcacaagtgtctacaagtctcctgtcatatcctcactcccagacattgagccttgagcagcaacctgttttctccaccaacctaaggttctggacctcctgtttataatctcatctgcctgcattcacacagaaataaatcagagtacagccccacctgggccactagctgcagtgaaaatcagtccattcacctacattgcactctatcccatgcagggattttgtttttttcttttagcttttatttttggttctgtgtacacatgtgggatatacagctaaaattatgtcatgggggtttggtgtgcagattattttgtcactgaggtactacccgtagcaccaaacaggtctgttttctcatcctcttagtcctcccaccgtctaccctcatctaggcctcagtgtctgttgttctcctctttgtgtttttgtgttcttattacttaactcttacttataaataataacatgcatttggttttcactttctgcattagttttcttttatgtttttgttttgttttgatttttgagacagagttttgctcttgttacccgggctagagtgcgatagtgcaatcttgacttactgcaaccttagcctcccaggttcaagcaattctcgtgcctcagcctcttaagttgctgggattacaggtgcatgccactacccctggctaattttgtatttttagtaaagacagggtttttccatgttagtcaggctggtcttaaactcccaacctcaggtgattaccccgcctcggcctcccaaagtgctgggattacaggtgtgagccaccgctcccagcctctgaattagttttctgagaataatggtctctagcttcattgatgttattggaaaggacatgatcgttttgttttttaatagacacagagttttccatgatgtttatgtaccatattttgtttttactaaatcttttattttattttacttttttgaggtagggtctcgcttattgcccaggctacagtgtcatggcatgatattggcttacttcagggtcaagcaattctctcctatctcatcctcacaagtagctgtgagttcacatgtgcgttaccacgtctggccaatttttctttttttttttttgaggtggagtttcactctgttgcactccgttggagtgcagtgatgcgatctcggctcactgcaagccccgcctcccgggttcatgacattctcctgcttcagcctccagagtagctgggactacaggctcccgccaccacgcccagctaattttttgtatttttagtagaaacggggtttcaccgtgttagcgaggatggtcttgatcgcctgacctcgtgatctgcctgccttggcctcccaaagtgctgggatgacaggcatgagccactgcgcctgatcaatttttctttttgtattttccgtggacacaggattttgccatgttgcccaggctggtctcaaacttctaagctctggcaatccacctgccttggcctcccaaagtactgggattacaggcatgagccaccagatctgaccataccatattttctttatccaatctactactcataggcatttagggcctgtccttatctttgctattgtgaatagtgctgcagtgaacatgcatgtggatgtgtctttataatataataatttatatttctttggttatatacccaattataagattcctgggtcaaatgataattctgtttttagttctgtgaggaatcaccacactgctttttacagttgttgaactaatttacactccctccagcagagtataagcattcccttttctctgcaaccttgccagcatctgttatttattgactttttaaaaatagccattctgactggtgtgaggtggtgtctcattgtggtttttttaaaaaaaattttctctaatgattagcaatgagcatttttttccatatgcttgttagccacatatgtatcttcttttgaaaagcatctgttcatgtattttgcctactttttaatgaggttgtttaggtttttcttttaaacttatttaagtttctaataaattctggagattagacctttgtcagaggcaaaacttgcaaatattttcttttattctgtaggttgtctttttcctctgttgatggtttcctttgctgtgaagaagggttttagtttaaataggtcccatttgtcaatttttgcttttgttgcaattgcttttagtagcttcatcatgaagtctttgccggtttctgtgtctagaatagtgtttcttaggttatcatgcagggtttcttataattttaagtttacatttaagtgtttaatttatcttgagttgatttttgtatatggtgtaatgaaggaatctagtttcagtcttctacatagtgctaggtagttattccagcaccatttattaaatagagaattcttgctacattcctcttgtcagctttgtcaaaaatctgatggttgtaggaaggtggcattatttctgtgctctctattctgttgcattggtcttgtgcactcatggatttttttataacatctttgtctcttcttttttttttttttttgagacagagtttcgctctgtcgcttaggcagagtgcagtggcgcgatctcggctcactgcaagctccgcttcccgggttcacgccattctcctgcctcagcctcccgagtagctgggactacaggccacagcgcccggctaattttttgtatttttagtagaggcggggtttcaccgtgtcagccaagatagtctcgatctcctgacctcttgatccacccacctcggcctcccaaagtgctgggattacaggcgtgatccaccgcgcccggcctcttctcctttttctccataaccattctttgaagtgcatacagtgttcaaaattcagatgcccaagagttcaaaaactctttaaaaagtttgaaaacaaattttgctattctctctgcttttaagggattcagattatatgcagatatttttctctgcttttttgaaatatatgcaagcgatattaacagctaaataaatcttttgttattttttatgactccagattttctttttctggtacttcagatttattgctttgttttagcttctgaaaagtttatttttttcatttttagtcctttaaagtagacacagatttgtttagataaaagctaatttaagagcacacagaagcttagcacaaagataaaattaaatttagcaatacagaatgataaacactaaaagatactaaatttttttgacagaaacctgattatccaaggaaattatccaatatttgcagactgaagtacttatactggaaaaacaagaacagttcagtgcataaactgaacagtggagtctgtagttgtaccttgctttcaatttattacttcagaacaattagcatcattatgtgtagtgtttgtagacaacctgcattcatataaataaaacagtattttctttttttcagacagagtctcactctgttgcccaggctggagtgtagtggcataatataaagccctaccatcttggtcaggctggtctcaaactcctgatgtcatgatctaccaacgttattcttccaaagtgctaggattacaagtgtgagccaccacatctggccatataatttctacttcttttactttactaagtgtacatatttattttctaataaaattacctaagaaaggctgggcattgttgctcatgtctgtaatcctcgcactttgtgggactgaggcaggtggatcacaaggtcaagagttcgagaccagcctggccaatatagtgaaatgctgtctctactaataatacaaaaatttgccgtgtgtgttggtgcacacctgtagttccagctacttgggaggctgaggcagaagaatcacttgaaccctggaggcagaggttgtagtgagccgagatggcaccactgcactccagcctgtgcaacagagtgagactccatctcaaaataaaataaaaagccataaaaaaccctagcaaagcttaaaggatttgtttaaactgtgtattagtatgtagtataaatttgacagggcagtggctagaaaatattaaaattacagaaactctgggatttaagtttttttttttttttttggtaagcttagaaaaaacaaaactactagtactgcagtggcatagacaccagaattctatgtagggttgccaccttgccgcagatctgttcagattcaccctttttggaggacttatttagttctgatcctaccttggagtcctgcctcagataactgattagaagagatcagagttttggctggtgaatcctgttgcctttctagagctggtgcttacaatttcctgaaagccaaaagctgataaatgggataaataaggtatatattttagggtgctactatttaaatgttctattaaaaccagtgcttgcagagacattgtatttagaaacttgttttctatttctgcagatacagtacttgctccataagtcacaaaaaagtaaatataaacagaataaaatcgtgtctaaactacattaacctctttttatatctgtttcatctgcctatatttagcttttattctttataattttttaaaaaatttgatgacagagaaacacaagaagaaataaaaatgctgggccctttatctaaatcctggaaattattaaacccttagtaccagctcccatggtgttatgagaattaaatcacataatgtgttatgcccagcacagtgctctgtatcacactcttgagcacatagtacctgcttaataaacattgcattagtacatgtgtacatgttgttttttaaatccagacttattcagacattgctgcattctgtttcctctgtaaactttaaagagccagcaaagaatataaaactttaacatggagatggattgttcttgtttgtaccagaagtatttggttgcaacaagagtgctgagtgtaagggaccctgtgctgtgcctgcttctgtaactaatggtaataatgaaccaatggggagcaacaccagcatttataggggattgtttaaaacacccattcatggacgcttttcaaacctgcagaatcacattacataaagtggggccaaaattaccaagtgatttataggctctttaaagcttgagaggcaataattagcttagggattatcagcccaggcttctcattaggatcaaatggccaatttgcagaaatctcttgtgccctccccacagcttctgtttattgttctgggtggaagcatccatgttgttttaatgaagggcctcatgtgaatctgaggtgagaccagaatctggtatgaggatttcaaaatacattcatgagagttaagttccacctttggactaaagggtggtcacagggcctgttctctttgggtttagtagggacaggtcagtgtggtgcatatttccattactgtagcagaaattgctggtgtctgtggcaggggagggcacctcaggacaggaaaggagaaacttatattttcatcttcatggagcagctcattgtttctgaatctcttctgttttaaaggacagaaatgggtggatttttctgtctttttctgctggttgatgttacgctagctggtaaacatgtggcactgacacctttaaaggcatattctcaagatgcaggggtaatttttttagagaatctcatctgagaaggaattccagagaagtaggagatagaaaaaacaaaaaaggcttttcttcaggtaaacatgcctcagctgaaatgctgtgtccactctgcctcctggaatgccatgcatttagtacttgcaaacttttatttctctacttgtgtttttccttcctaagtagtttggtttaagtacttcttaaaattcttatgatagtcaagggtctctgaaaaatgtttctttcctgtatcccagagccttctcttctttctctacacaataacttcttatatgccatgcagatttttcaacaagtattcatgatttgcaatattaaaaatgttccctttctggctgttgaacatggaaagatgtggatactcaagatttctattggggaaaactgtggtccttagtaaagatggagaacatgtaaagttgaggctctattcctgtgttccattagctgtatgcagaacaggattaagaaattgcttatatatgtcaggtgtggtggctcatgcctgtaatcccagcactttgggaagtcgaggtgggaaggccacctgagatcaggagtttgagaccagtctggccaccatggtggaaccctgtctctactaaaaatacaaaaattagccaggcttgttggcaggtgcctgtaatcccagctactcatgaggctgaggcaggagaaccacctgaacccaggaggtggaagttgcagtcagccaagattgcaccattgcactccagcctgggggacaagagtgagacttcatctcaaaaaaaaaaaaaaaaaaaattgctcatttaaatgtgatggcatttattactcagaaatttctgaaaaaaattattaggagatacctgctctctagggtgctaaatgaagccgacttaaaattactactaaaaattacagagcataggatttatctgtattttgtggtttccataaaacaaatgattctttatgattaaattcagattttacttacttttttaaaagaggaatatttcaacagtgatgctgtgttctgtgtgcattagcacatcataaaaattagtcctaatgcagttaatgattcacttgcttaaatagccctctggcagattttttcactatgtagctagttatttttctcttcattattaagtatgtttatgcagctgatgtgcataaaccatcacatttaatctggcagctgtccttttttcttatttttatctatatatttttctttggaaaatgaaggttcttatctttgtttacaggtcagaaaaactgggaaaaacacaggctcttccacttactggctgtttgacaaaatatcctccttctttggccaaaaacattgacattattgatgagcttgttagaaattcaaaaaatcagactttattccagatcttctggaaaaaaaaaccctgtataacaaggtattcagcttattgcacatattaaaatttgagaagtgtcttctaactcaacatgtcattttcatctgaaaaatattcacaactctttccatatgatgtaaatatagcactcaaaaatgtacctgttcatgttcatgcccttaaatttatactttattatctagaaaaatatatgaactgatgttgtggatcttatgcttctcttttttctcagagttagagaatattttggagagtatttctgtgttgaaaattattttattggataattttcatcagtactataagtcagaaccaggtgtctttactctctcatttcaccttaagtcaaattaaaaatttcattcatggtcacttggtgaaaatgtgtgtgtgtatttttcagaggacattacaattcagagatgtggccatagaattctctctggaggagtggcattgcctggacacagcacagcggaatttatatagggatgtgatgttagagaactacagaaacttggtcttccttggtgaggacaacttgaatatataattcataatatacacaaaaggtttatttctcttttttgtagaatgtgttttagtaatttgttctttttataaatgagtttcagatccagtttttcaagaaaatcttcagaatttgtgcatttagaaaagaattacttccgtgcctcatgcctgtaatcccagcactttgggaggctgaggcgggggattacctgaggccaggagcttgagaccagcctggccaactaacgaaagtacaaaaaattagctgggggctgtggcacacacctgtaaccccagctacttaggagggtgaggcaggagaatcgcttgaacccaagaggcagaggttgcagtgagttgagatcatgccattacactccagcctgggtgacagagcaagtttccatctcaaggaaaaaaaaaaaagaaaaaaatttcttcaacatgtttcatctaaatataaactttccacatttctgagttgagttgtatttttcactctaaattagtggtaattccagaaatttattgacataaaatattgcaacctccctctcccctctcccctctgcctctctttccacggtctccctctgatgccgagccgaagctggactgtactgctgccatatcggctcactgcaacctccctgcctgattctcctgcctcagcctgcctagtgcctgcgagcgccgccacgcctgactggttttcgtacttttttggtggagacggggtttcactgtgttggccgggctcgtctccagcttctaaccgcgagtgatccaccagcctcggcctcccgaggtgccaggattgcaggcggagtctcgttcactcagtgctcaatggtgcccaggctggggtgcagtggcgtgatctcagctggctacaacctccacctcccagccgcctgccttggcctcccaaagtaccgagattgcagcctctgcccggccgccacccagtctgggaagtgaggagcgtctctgcctggccacccatcatctgggatgtgaggagcccctctgcctggctgcccagtcggaaagtgaggagcgtctctgcccagccgccatcctgtctaggaagtgaggagcgtctctgcctggctgcccatcgtctgggatgaagtgaggagcatctctgcccggctgcccatcgtctgagatgtggggagtgcctctgccccgccgccccgtctgggatgtgaggagcgcctctgccccgccgccccgtctgggatgtgaggagtgcctctgcccggccgcgaccccgtctgggaggtgaggagcatctctgcccggccgccccatctgagaagtgaggagaccctccgcccggcaggggccccgtccgggagggaggtggggggggtcagccccccgcccggccagccgccccgtcctggaggtgaggggcgcctctgcccggcggtccctactgggaagtgaggagcccctctgcccggccaccaccccgtctgggaagtgtacccaccagctcattgagaacgggccatgatgacaatggcagttttgtggaatagaaaagggggaaaggtggggaaaagattgagaaatcggatggttgctgtgtctgtgtagaaagaggtagacatgggacacttttcattttgttctgtactaagaaaaattcttctgccttgggatcctgttgacctatgaccttacccccacccctgtgctctctgaaacaggtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaatacaaaaaaaaataaataaaaaataaaaataaataaaagattaaaacacacacacacacaaaaatattgcagcttccacctgaaaatctaattgccaccaccaatttttgattcagtagtaccaggcagtaaaattaagaaacctacaaattgaaagtattttcttttttttttttttgagatggagtcttgctctgttgcccaggctggagtgcagtggtgcaatcttgggttactgcaacatccacttcccaggttcaagcaattctcctgcctcagcctcccgagtatctgggactacagatgcacatcaccatgctgggctaatttttgtatttttagtagagatggggtttctccatgctggccaggctggtctcaaactcctgaccttgtgatctacctgtcttggcctcccagaatgctgggattacaggcatgagccactgcaccaggcaaattgaaaatattttctaaatatttagaaattgctgttataaatttgtattttggtattaatttaccagaatattttgtcacatcgtctttgctgagcacattactagcttgtaattggagaatatgagcaagattcatgttatttatttttgataaaacaggtattgttgtcttaaagccagacctcatcacccatctggagcaaggaaaaaaacctttgactatgaagagacatgagatggtagccaacccctcaggtaggtgtgagtgaaaatgaatacaacagatgacacaggtaagaggtcccaaggtgaaagagaaagccagtccttaaagtgtgattcaggaagctgtgttccaaagaaatacttcctgggcagctgttttatttatttatttatttattttttaaattttgctctcacaaaggggcatcttctgtcttatgcttttaaattctctaaaaattctacttttctttcagtgagcttccttcaagttcacagtgagagccaaagtcctcttcatggcatataagagactgcacaatctggctgctttttcattgttttggggacacacaaatatctgcatgattttgagaaactaaaactattttttagttctctttttgcatcaggtctgaaatatgtgagagtagtagtttctgttgcatttttttgttcatttttgttcacagtccattctatttttattatgacacagtcttgaaatatagtttgaaattttaagtatgatatccttctgctttgttctttttcctcaagattgctttggctattcaaagtttgttttagtttcatgtaaattttagaattgtcttttccattactgtaaaaaaaaccactgcaattttgatgggaagtttattgaatctatagatcactttggataatatgaaactttaatgatattctttcaatccgtagacataaatattttaaaattaattttgatcttctaatttttttatttttttactgtaaacattttttacctccttggttaatgtttttctcagaaatttgttatttaatgctacattaaataagattttttcttccttatcagatagtttgttttaagtatatgaaaccatacatatacttgtgtgttaattttatattttgctaatttactgagtttatttattagtttagacaggttttaatgtactgtttatggttttttaaatataggattctatgatctacaaacagcaactgttgacctatgtttcttcatctgaagaaatccataattttagattcagatatttaggacaatatgctagaatgttcatggtatgcctgaagtaaattagataatttgtagggacccatatttactaaactagttacttatgcatttaagtttgctgcaggcaaaaaggaattataggatttttatttatttatttatttatttatttgtttgtttattttcttttgagtggggctttcactctttttgcccaggctaaagggcaatggcgtgattttggttcactgcaaccttcacctcttgggttcaagcggctctcctgcctcagcctcccgagtagctgggattagaggtgctcaccaaaacacccagctaattttttgtatttttttggtagagatggggtttcaacatgttggcaaggcttgtctcaaactcctgacctcagatgatctgcccacctctgcctcccaaagtgttgggattacagccatgagccaatgtgcccggctggattttttcatttctgtgaatactggtacaatacgcatggattttcagttatgtcttccaggtcctgtgttgcatattttgtttttttgttattgttgttttcttttcttttcttttctttttgagctggagtctcactctgttgtccaggctaaagtgcagtggtgtgatcttggctcactgcaacctctgccttctgggctaaagtgattctcttacctcagccttccaagcagctgggattacaggtgcatgtcacatcaccaagctaatttttatatttttagtgaaatggtatttcaccattttggccaggctggtctcaaacctctgacctcaagttatctgcccatatcaggctcccaaagtgctagaattacaggcttaagccactgcacctggcctgtgttacatagtttagatatagatttataaatgaggaacatttataacattttaaaataatggctgcgtctttgttttccaccagcaatcaacattggttttatttttattgcacctaatgggtgtgaggtgattttgttggcattgtgcttttttttgatttctctacaaattagtaattttgtatgttctttcaaatgtttttttcccttttgtgcattttatgtcttgtatttagtttaaaatatattattgtatcattcaaggaaataatccaactttattttatcagtgttgacattcagttttcaacatcattttttgaagagattatttctatttcatatgcatggcaactttctggaagattatgtgatcatatacagaagggtttatttctgggctctctattctgttctttcatctgtttgtctttgtgtcagtatcacttttttatgttactgtaggttttaactgtaggttgtattgacatctttgaaaaataaaatattttgcccctgagcaagaatatgttgaagagtgtgtttcatattcacatatttgtgaatttgccagtttgacttttgcttttaattcttaatttcattcagtttttgttagaaaacacacagtgtataattttagtgtttctaaagtgattggttgttgttttgagacaagatcttactgtcacagtggcataattgtggctcactgtagcctcagactcctgggctcaagtgattctttcttttttttaaattttttaaatttttttattacactttaagttttagggtacatgtgcacaatgtgcaggttagttatatatgtatacatgtgccatgctggtgtgctgcacccattaactcatcatttagcattaggtatatctcctaatactaaagtgattctttcacctcagttttttgagtaggtaggactgtagacatgcactaccatgtctggctaattgtttacttgtttgtagtgttaggatctcactatgatgcccaggctgttctcaaacttttggcctcaatggatctccaaagtgttaggattataggcaagagccatggcacccagtagatatttttaaatttaataaaacttggtatatgtcctaacagaatacaccagaagcaaataagaatattgtatattatcttggttttgactggagagttttgtatgtgtctttgaaccctagttggtctataatatggtttggatgtccatgttgtccaaacctcatgctgggatataaatcttcaatgttggatgtgggacctggtgggacttgtttgggtcatgagggtgaatttctcacgaatggcttggtacatactcttcataaccaaaaagtttacactctatcaattcaaataagagctggttcattaagagaacttggctccttcacctcacacttgctctgtctcttaccatgtaatatacccagttacactttaccttccaccatgattttaagcttcctgaaatcctcatcagaagcagatgctgacacacacttcttgtacagtctggtgagctgtgagtcaaataaacattttttctttataaattatgcactctcaactattcttctatatgtaaaataattaatatggtctataatgttatctcagctttctttttcttattttttatctgagttttctatttattattgcaaatggggtcttgatgtctacaatgattatgttgctatgtatgtcttgcttcacttttgtcaatatttgctttatatattttgaagccctgatgttatatacacatatacatagagatagataagtagtatagatccctgctaaatcaactcacttttgccataatataatatcaatcttttctcatggtagtacttgacttaaagcatattctgtctaatataattatgaccacctcactcaattgtggttactatcttcatggaatataactttttttcattctgttaatttcagcctatttgactcaatgttaaaatgatctctcataggcagcatagtgtatactttttgaaaaaccattcaggcattctatatctttttctttatataattttatttatatgttcatttatttattcattttatttaattttattttttgagatagagttttgttcttgttacccaggctggaatgcaatggtgcaatctcagctcactgcaacctttatttcccgggttcaagcaattctcctgcctcagcctcccaagtagctgggattacaggtgcatgccaccacacctggctaagtttttgtatttttagtagagatgtggtttaccatgatggccaggatcatcttgaactcctgacctcaggtaatctgcccacctcggcctcccaaagtgttgggattacaggtgtgagccacagcacccggcctcagaggcatgatcttggtcactacaactctgccattacagagtctcactctgtcacccaggctggagtgcagtggcatgatctcagctcactgcaacctctgcctcctgggtttaagcaattctctgtctcagcctcctgagtaactgagattacaggtgcctgccaccacacctgtctaattttttctgtttttagtggagatggagtttcaccatcttggccaggctgcttttgaacttctgacctcatgatcaacccatgtcagcctcccaaagtgctgggattactggcgtgagccattgcgcccaaccagcaatttacttttaaagacacaatattatactggagagcaggaagagctctgttgggtataagtaacagacttttctttttcttctatgtggctctttgcattgtgctcacctggggcccttcatccatttaacccatttataaattttttacaaatgtattttggtcagtatgtttttgttacctttatatgtccaggaagaaattacagcttgtggtattttgctatgtcatcttgcttatgtagtttgtataattttataggttagatttgtaaagtatatttatctgagtctagcaattgaagtaatgtgtttttattgtttctttcagttttgtgttctcattttacccaaaatctttggccagagcagagcataaaagattatttccaaaaactgatactgagaagatatgaaaaatgtggacatgagaatttacagttaaaagaaggctgtgaaagtgtagatgagtgtaaggcgcacaaaagaggttataatggacttaaccaatgtttgacaactacccagagcaaaatatttcaatgtgataaatatgggaaagtctttcatcaattttcaaattcaaacagacataagataagacatactggaaaaaacttttcaaatgtatagaatgtggcaaagctttcaaccagtcctcaaaccttactacacataagaaaattcatactggagagaaaccctacaaatgtgaagactgtggcaaagcctttaacttctcctctaaccttactacacataagaaaattcatactgaagagaaaccctacaaatgtgaagaatgtggcaaaaccttcagttggtcctctattcttattacacataaaatgattcatactggagagaaaccatacaagtgtgaacgatgtggcaaagcttttaaccattctgcaactttttttcgcataagaaaattcatattggagggaaaccatacaagtgcgataaatgtggcaaggcctttatttcatcctcaaaccttagtagacatgagataattcatatgggagagaaaccatacaaatgtgaaaatgtgcaaagcctttaagcactcctctacacttaccagacataagatagttcatactggagagaaaccctatgagtttgatgaatgtgggaaagcctttaaccagctatcaacttttactaaatatgagaatttatatggaacataaaccctacaaatataaagaatgtgacaaaacttttaggaagttctcaacccttattatacagaattcatactggacagaaatcctacaagtgtgaagaatggggcaaaacctataacaggttttcaattctttttggttttttttttgagatgaagtttcactcttgtcacccaagctggagtacaatgccacgatcttggctcactgcaacctccgcctcctgggttcaagccattctcctccctcagcttccctagtagctgagattacagctgcctaacactatgcccagctaatttatatatttttagtagagacacgattttgccatgtttgccaggctggccttgaactcctgacctctggtgatccacctgctttggcctcctatagtgctgggattataggcatgagccacgatgcccagccacaagttctcaattcttaggagacttggtgataattcatgctgaagaggaactctacaaacctaagaaatgtgactgacagagtttttaccaacacctccaacttctctatacataaaaataattatactagtgtgaaaacctagagatatataaaatgtgacaaagcctttatatggttgccacactcgattgtagttaagataattcatattggcaaaactcctacaagtgtgaaaaatgtggcaaaacttttcatccgttcttatactttatttcacaggaaagctagtatccttgagaaaaattgtacaactataaggaatatggaaaacccattaattcctactcacatcttactcaacataaaaaggttccttttaataaaagcattaaaagtgcaattacagtcaagaaatctttcagaaagtataagcatttaatgtgaagaagagtattgtgaagacaactattacaaatataaagggggttatagtacatttacttgtatcactgatcctattgcacacactttgcactagaggaaaaccttgaagcagttgctcaagctttgttcaacaacagggaatttatattggagatgagtcctgcaaatgtaataagcttagaaacacttattttttttttcagaaactacagcttagaaaacaccagagagtttataccaaaatataattttgcaaatgtggtaaatataaaaaactaattcaaaatagaatgtatttaaatatcagagaatttacagtagaataactaaggcactgacacttcagacattacactaaatcagagtgttgagtataaaaactaatccacaactacagtttttagataaatgatttgcatgtaactgtaaaaggagtagatttttggaagcattgtaattacattgaaagtatacttgtttccttgaataaaattttttgaaaactgcataatgatgtcatacagcttttaaattactttacgctgttattttactcttattcacatgtgaaaggacgtgataaattgcttctgcatcagagatattagagatttttgaaaattatttggacattatgactttttctataaaagagtaaggacattaaaatgtaagatgcataatgaaaatataagcggagaggctttttgtagtaaacctctattaagtaatgtataaggtaaatgttcagagcaatacttttctacattatagtgacataaataattatagttaaaagtatattaaaataaattagtatattattttactaattgtagttttatgtaataaaatgcagtacatctaacaattgttagggctgggctcaatggctcaaacctgtaatcccaccaatttggggggccaaggtgggcagatcacctgaggtcgggtgttcgagaccagcctgaccaacgtggagaaatcccgtctctagtaaaaatacaaaaaaattagccagccatggtggtgcatgtctgtaatcccagctactcaagaggttgaggcaggagaatcgcttgaaccagggaggcagaggttgtggtgagccgagatcatgccattgcacaccagcctgggcaacaagaacaaaactctgtctcaaaaaaaaaaaaatagttagattatgtgtgaactcaattttattattattttttaccatgttaatactattgtgcatttaatgaagcattattatgccactaactttaacctatcccaccttactcaagggtgtagctacaagatggtagcaacatactatttggtacatagtggaataacatctctagttatcactttgccagtggcattaaactgcaaaagagttaaagaatattgttcccatagattaaatttttactcttttttcttatcaaaatttgttattgtatttgtgggtatatagtatgtgtatgtatttatgccttatatggcatattttgattgaggcctacaatatgtagtaattacattagggtaaataaggtatccatcacctctagcgtttatcctttgtattaccaacagtataattatatgctttcattattttaaaatgtacaattaaattgttattgactacaggatttttttatggtcataataattatacaaaaatataaataaaatacagccaggtgcagtggctcatgcctgtaattccaacactttgggagaccgaggcaggtggagtacttgaggttaggagttcaagaccaggctggccaacatggcaaaaccccacctctactaaaaataaaaaattagccgggcatggtggcacatgcctggaggctgaggcaggagaatcgtttgaacgcgggagatggaggttgcagtgagccgagatcacgccactgcactccagcatgggtgacagagtgagactccatctcaaaaaaaaaaaaaaagaagaaatacaaataaagtccatacatttctgagtcctgaaaaataattaataaatatttgtcatatagttttctttgaacatgtggtctctctgcctgcaagcatatagacttttagttttaatttacatagagttaaatatactcatattactctgaagataaaccttaggtgtaagaaaaatataaagtgagtgtttttgtctgagtatgagtttgtacacattttcagaagcaaagagcaattattgcaacaaaggaaattattttaattaggtgactaactaaacaccttgaaaatgctgaaagcaaatctatactttctgctttgtattcagtttattaatgtaaactgttaaggcttatgattcagattctccccggaatctgcctattaaagcacagacaactttgtctccagaaacaacactcttgagtacaacaataaaacccctcttcaaacagaaaaaaaaataatttttaacaattacctttataaacattcaacaaaattaaataattggatatatttttattgttctgtgtgtgtgtgaatgtataaaatggtgcatacaggaaaaataagccagaagaaagatgttagttaatattcacagtgaataaaactggaaagtagttaattattaaatccagatgatagctttgtttatgtagataacaaaagcagcagaaagacttttttttttcccagatgaagtcttgctcagtcgcccaggctggagtgcagtggcatgatctcggctcactgcaacctccacctcttgggttcaagcaattctcatgcctcagccttttcagtagctgggattacagtccgtgccatcattcctgactaatttttgtagtttcagtagagacagggtttcatcatgttggccaggctggtctcaaactcctgacctcttgatatgcccacatcagcctcccacagtgctggtattacaggcatgaaccaccgtgaccggcaaaatactattttaaaagtttatttaggtggatagacaacattctaagataataccctggattctcagtctgttgcacacctgctgtgtaatactctcctcttgagtttaaaaacatgtgtgactgtggtgggaaatcattcatgatattaggttactcatgtgttaactttgtgtttatcaaaatggagattatccttattgtgctaaacttaatcagaggtgcttttaagagaaagagacacatcacagaaaaacacccctgctggcctgaaagtcagtgacttcttcgtggaacatgtaagctgcttatggtggccatatggcgggaaacatgtttgtttattgtcatcattcctgcctcctgtatgttgattccagtaaggagaataagaggatcgtatggcagaggggaaaaaaaggactctcattcatgcaagaaataaacacctctcacctgggatagcttaagagaaacaggagaccacaacaggtccacattaatgggaggaaaagggtaacctgggtaaaagtgctcactggcattatggaacagtatttagtaagctgtagtgaatgatcagcctctgggataccaatagtctaccaacaaggctgaactcattctatttcaatcagcatgtctgcaccattctggcgacccaggtttacactattcattgaagaaataccatgaagaccagtgggtaatgtcctagaattgaacttacttcaaaaagcatacctaattgtttgtttttacatttgaaaaacttttaaaacaatgaacttataattaacttctaattacagaagattctactgtactgttacatgattaaattgtaaacaccttaatatgaagattttttgaatgcatgattagttatgtagatagtttcttttagagtcacatgaccaaagtaacaattagagaaaacatttgaaatgagacaaaattaaccaaaaccacatcttttcaaaggcttggcataattgccatatttatggaaatggccagatgactaacaagaaacaaaaagattttggctttgctcaatgattgtttttgaccttttgaaatctaaaatcctggctaaagtattcaaagggaatattttgtaggtggcttcccagggtttccaagtaaatgaaggagggattctctctctgtcacccaggctgcaatgcaatggtgcattctcatctcactgcaacctccacctccctgattcaagcaaatcttccacctcagcctcccaagtagctgggataacaggcacctgcccttatgcccagataatttttgtatttttggtagagatgaggtttcaccatgttaaccaggcttgtcttgaactcctgacctcaggtcattcacccaccttggtctcccagagtgctgggattacaggcatgagccaccatgcccagccggaagaattttgataggcagaaaaatgcagattatatacactcattgctctactctgatttgcttcaacgctgaaaaattgaagattgtaaatgtagtctcaatttagagaaaattatcaaaatatttatttttcaaaaaagcaaatgtataaaattaatgggtatcaggtgtcattagctgctaaaaaaatagtatgactaaatttagtaagtatctagctatgcaaataacagcctaattaaattaacaccctaataggtgcatgtggaaagcattgctgtgcactgtggtgcacccagactcagcattttcttctgcctcttcacagagataccaattccccctgagttactcagtgtccatactgttgttagaaatgcttgttctctggtgccataaagaaatagtacttgaaaataaatttaattttcttagcaaggccattctttttgcaaaaagggcacactcaccagcagttttgctaccagagtacactgaacaaaagagacagggtcatttataacctgatgtgtccaccctacttttatgtttggtttttattggctgaaaagagacttcacattctgtatttttcccgattgtttagcaacttagaactttttttttttttttttttttttttaagacggagtctcgctctgtcgcccaggctggagtgcagtggcgggatctcggctcactgcaagctccgcctcccgggttcacgccattctcctgcctcagcctcccaagtagctgggactacaggcgcccgcaactacgcccggctaattttttgtatttttagtagagacggggtttcaccgttttagccgggatggtctcgatctcctgacctcgtgatccgcccgcctcggcctcccaaagtgctgggattacaggcgtgagccaccgtgcccggccaacttagaactttttaaaggaggcaaatgcagaggagaacaaagaaaggaggaagtaacttgtggaatgctgagacaggtaaaaacaccttcaaataaggaagagtaacaggctgtgacctaatgcttgcttggaccagtataagcatgccaaggcaaatatttaggctaaattatggaagctaagaacataaagtccattgatttttttgttatggctagcagatatttaagaatgttagcacaggtctttgaataaactttgcttctaagagaagttactatttattcctaattagacggggaggaaagtctttgaagaggaacctctacttcactttttatactgggaactgagaatgctgtgttcagagtgattaccgaaaacatggttaatacacttcttccatatgataataaaatgttataaatcttactctgcctcagaaaagcttttactaaaacattatctatagtactcaattagagttcatggaaaatttcaatattccaaataattcagacagttaaatgtcaatgaaatcccataaaacatttgaataagataagtcttcttagcaaataattttatattactggtaaatttagaaaaaaaaaatagaaaaccaggccaaatgtggtggctcacacctgtaatctcagcactttgggaggctgaggtgggtggaaatcccatctctactaaaaatataaaaatttgttgggcgtggtggcacatgcctgtaatcgcgggtattgagaaggctgaggcaggagaatcgcctaaacctgggaggtggaggttacagtgcgtggagatggtgccactgcactccagcctggatgacaagagcaaaactccatctcaaaaaaaaaaaaaaaaggatttttttttgtttttttttttctgtgttgacttactttacttagcataatatctttcaggttcatgaatgttgcaaataacaagattgtcttactttaggggctgaatagcatttcattgtttacatacaccatattttctctcttcattcacttcttgatggacacttagattaataccttagctattgcgagtaatccacttctttccttctcttttgtttttgtttcgttttgtgtgagacggcgtctctttctgtcgcccaagctggagtgtagtggcatgatgtctgctcactgtaaactctgcctcccaggttcaagtgattctcatgcctaagcttcctgagtagctgagattacaggtgtgtgccaccacaccaggctaatttttgtatttttaatagaggcaggctttctttatgttgaccaggctgcctttcatttgtttgtatatttctttctccctttccttctttatttctagaagtattttacttttaaaatataaattatgactgttataaaccttcatttctctgtctttgcttactattatggctgattaaaaataagttttttgaaatttcctggataaagttattatttcattattaacataacgagaaaatatagaaaggaaaaccaacatttgttagtaaaacagaaattatctagctactggtagtgatttagtctctcacccaacatgaatgctacatcttggtgtcatctctcccagtcgtatgaaagaggctactgatcaaattggtcagcataaaattttgtgaagtttaacacctttgttctaaaaattaagctgatctattaccaaaaaagtagattttttgatatgtataatttgactctatttaaattccgcagaaaaattaaactgacaacatatatttaaaagttttttgagggctgggtgcggtggctcatgcctgtaatcccagcactttgggaggccaaggcgggtggatctcgaggtcaggagattgagaccatcctggctaacacggtgaaaccccgtctctactgaaaatacaaaaaattagacgggagtggtggtgggcgcctgtagtgccaggtactcgggaggctgaggcaggagaatggcgtgaacctgggaggcggagcttgcagtgagcttgtgccactgcactccagcctgggtgacagagcgagactccatctcaaaaaaaaaaattttttttggaaattaaaaatgcttaagaaacatatttatagaaactaaaagtaaaaataattttagattcttagagaacatctctaaaatacttcaagttatcctctgagagtatatatatatatatatgtatatatatgtgtgtatatatataaacacacacatatatatacatatatatatatatatacatatgcatgcatatttttttttgtttttttctttttttgagacagagtttcactcttacccaggctgaagtgcaatggcagaatctctgctcactgcaacctccacctcccgggttcaagtgattcttttgcctcagcctcctcaatacctgggattacaggcactcaccatgcctggttaatttttgtattttcagtagagatggggtttcactatgttggccacagtggtctcgaactcctgaaatcaagtgatctgcttgcctcagcctccccaaagtgctgggattacaggcgtgagccactgcccagccaagtgttcaacttttctgcatcaattatctcagctcagaaaatttaaatcagccaattagcttacctcaggggattccaagcagctcattagcactccccaggagaatccaatcaacaaattagcttagcccagctgattagcccaggtgatttcttttctttacttttctttttcttttttttttacaggaacacagatttgatgttttaataaaaaaaaaaatacgatttctgcaaaaggtgcttaacacggcccaggacgggctgtccggtggagtcagccctaggacccctgaaggatgcataaagacagagccggctcgccagcacgctcctgccagcaccgggacccactgcgagccactgcggggtgtccttcattaaaaaaaagtctggattgtgacattgcaaaaggagtctgaaagccatatgcccaattcctgaatccctacgttagaactgagagtttaggctgggcacggtggctcacgcctgtaatgccagtattttgggaagctgaggcgggtggctcacctgaggtcaggagttcaagaccagcctgaccaacatgatgaaaccccgtctctaataaaaacttgcccgtaatcccagcactttgggaggcctaggtgagcggatcacgcggtcaggagatcgagaccatcctggctaacacggtgaaacaccgtctctaataaaaatacaaaaaaaattagctatgtgtggtcatgggcgcctgtagtcccggctacttgggaggctgaggcaggagaatggtgtgaacccaggaggcggagcttgcagtaagccgagattgcgccattgcactctagcctgggcgacagagtgagactctgtctcaaaaaaaaaaaaaaaaaaaaaaaaaaaaaaaaaaaaattagctgggcatggtggcgcatgcctgtaatcccaattacttaggaggctgaggcagaagaatcgcttgaacccgggaggtggaggttgcagtgagccgagatcgcaccactgcactccagcctgggtgacagagcaagattccataccaaaaaaaaaaaagtgagtgcttagctggagtgaggaggaaatactgaattcctaggtcaggaattcatttcattttcaccaagcgcagatatcccagctcctgaacaaggccaagaccgagggtctggcaccgggcacgtgtaagaaaggactgttttaagaaccttattacacaaagctcttatttctggatccaccactgcttacatttgcacccagacaccacttctaggtgcaagaagaaagatcaggacatagagaaaaatgcacacagaacgatgagggaggatgacgagggagaaagcctgcatcagagcactagcccagatgatttctaacagccaactagctttttctaggggacaccaatcagccagttagctcagctgatgtgaatcttataacccgattagtttagcacaggtgattttaaaccaccgattaactcagctcaggtgatttcaatcagcgaattagctcagcccaggtgatttcaatcagctactttatcaacccaggtgaattcaattagccaattagctcagtctaggtgatcccaatcacctaattatctagtggctacagattcattaaggtatgcccaaaattgtaaatgtaaatagcccatgaacaccaagaagaaatgcagggccctatatgctaacctggacagtatgtataacacagctttactgtcactttatttacaaggcctgaaacctgaagctgaagctttacgtttatataaacaacactgtatggctatgtttcattctgacatgctattgagcaaaagagaaggcaattaattctgcatctgcatccttagtatatgctctatattttaaaaagtgggaaaatattgtatgtatacattaatatttacatagatacattcatataagtttgtgagtgtttatgtagctaccatatgtgtacatatattcatacacatacctaagtgtatataaatatatatatgaagctgtaacaatttttgtatttatattcatacaaaataaagatgttgaatgtggaagtattgatagctattgctacaaacagtaatacagaaccttccatacctgtataaaaatattttctctatagactactatatctagaatagtacagaaatagaggaatgctctaatatacatcctgctgcagttaatatattcaaagggagcattgggctttgttttgcacttctggaagatgaaaatttactaagaccattggagttatttactgccatgtcagggttgacttttcttttattgttgtacatagggtcagagatgaaccagccccagtccaaaggtctaacctaaatatgagaatacttattctttctctttagaacttccatcgaacaagaactgtatttatttccaaaagtgtgtgatgtaaaatcacactattgtctttcggtctttgtggcagaagttgggtatttatggtaatgaaaaagaagtctatgtctctttttagaagacagatggtgatggaagcaaatataatggtacatggtacttggccacatttcaaatgggtgatattgaatagtcgctgaagtgccacaggtggcttttatttcccaggtcaaatcttctttgtgaggaaggctcagcccactgttgtcaagcatttctggtaatttctagatagatgaacaaaatttcactgggctggattaatgagaccaggtttaaaaacacccaggttccaggttattaaagacattgttaaatttgtattaaaaaaagtggcatggtgtgcggcttggtttgaataaatcttcactgagctcagtagctgattacctaacctgtaggtaaaggaattggaaaaacctctgaccaagtttattttataggcttctttctgtacatgtagatataaaataggtggctagataaacatatacacatgaaatgagtcacacgtgtatgtctacgtaatgtttatttctgcatatgactctcaaaaaaaaagcctcaggaataaagtcagatgacatctcggtaagctaccctgaagctgaggtaaatcaaataagcaaattagcagaagtcgggtgattgcaatcagtcaatttgcacagctcagatgattccaaccagcgaagtagctcagcccaggtggatacaatcatccaattatctaaatgatgactggctttgtcaaggcaggacccaaatggtggatgtgtacagaacatgcacacattgaggagaaatgcagggcgctgaaatactaacatggacagatgtgttgtacatggctttattttcagcttctgtggtcttgcccttgaagataaagctttgttgatatttacataaaaaacattgtatgaatatgttccattctgacatgttatttagcaaaagaaaaaagaagtaattctacatcagcatctttagtacatgctaaaagattaaaaatgttttttgggaaatttgttttgtataaatatttatatagaaatatttatttaattctctatgtgagtgtttgtcttcctatgtacatttatatctagatgtgtcaatctttgtatcgatatgcattgctatgaatagtaagataaaaagtaacttctggctgggcactggggctcacacctgtaagcccagcactttgagaggctgagatgagtagatcgcctgaggtcaggagttcaagaccagcctggccaacatggtgaaaagccatctcttctaaaaaataaaaaaattagccaggcttggtggcaggtatctatatttccagctacttgggagtctgaggcaggagaattgcttgaacccaggaggcagaggttacagtgagccaagattgaacaactacactccaacataagcaatagagcaagattcaatctcaaaaagcaaacaaaaaaaaaccccaaaatgatgatatgtaaaacctttaaagttcttttatagaatataaaaaatatgtaaattcacatacatctgagagatacaccacataaaataattttaatatcaataacaaactggaaaatatagaggcatggtttatgtattcaactgaagttgttatgaaatttaaaaatattgttttaactttaagatgtatgtcatttccagctgtcaaaatgattacaaagataatatttatagaaagtatgcaaaagaaaacaaaaaataatcaaatcatgccagtacaaaattaaatgaaagttaagaaagtaaataaggaaaagagaaaaatataactactagaaacacacaaaacaatatcagtataactagtaataacaacatcatttccctaagcaatcattttaaatataaattaattaaactacttaataaaatgaaatgtaatcttaggattttggaaggccaaggtaggctgatcacttgatcccaggagttcaagaccagaattctcaataaagaatacaaaaaaggtagctgggtgtgatggcacatacttgtaacccagctacttgagaggctgaatgagaggatcatctatctgagtttgggaggttcaggcagcagtgaactgagcaaatcagcctggctgacagagtgagaccctatctccatgataaatgaggccaggtgcagtggtgcacacctgtaatcccagcactttgggaggccgagacaggcaaccacctgaggtcaggagttcaagagcagcctggccatcatggtgaaaccccatctctactaaaaatagaaaaaattagctggacatcgtggtgggaacctgtaatcctagctactcaggaggctgcagcaggacaattgcttgaaaccaagaggcagaggttgcagtgagctgagatagcaccattacattccagcctgggaaacaagagtgaaactcagtctgaaaatgtatatatatatatatgaataagtaaaattatataaagaaaaagaaatagaatgcctgagtagttttttataaagcatacagtatgctgcctacaaaagattcattttagcaatgagtcaaataggctgataaagtaacagaatgaaaaagatgtatatcccatgagaatagcaaccacaactgagtgaggtggtcataattataatagacataatatgctttaagtcaatactgtcatgaaacaatgattgatattgtattatgataaagtgagttaatatagcagaaatctgtaactataatatttatctatatatatatgtgtatacaacatcagggctttaaaacgtacaaagcaaatattaacaaaagtgaagcaagacacacatagcaacataattcctgtaggtgaatgtttagtaggaaaaactaaaaactgtaatggctgcatagggtcaattcatttcacttgtgcttgttgaattttttcttcaattaattgaagttcctctaatgcctctttagaaagggagcatttactgttaaggtcagaattagcttgtaaagtagaaaaaaggtgagacatagcataggtaggaatgcctaaagatggacaaatccaattaatgtctcctaataaatttgaaaatcatttagagtttttaaattatctctttcaatttgaactttttgaggattattagtactttgttctactttcattcctaaatattgaaagggagtagaggtttggattttgtcaggggctatgattaatcctgctgcagtcacagacttttctaactgttgttagcatagcattacttcctctctagtttcagctgcacataaaatgtcatccatgtaatggataatataactttttaaaattgttctctaactggcttaatagtttttccgacataagtttgacaaatagttgggctatttaacattccttgtggtaatactttccaatggtatctgtccgctggttctttgttatttatagtgggaacagtaaaagcaaatttttcataatcttgggtcactaaaggaatggtaaagaaagaatctgttaaatctatcactattagaggccagtatttaggaataatagttggagagggcagccctggttgcagtgcgctcatgggttgaaatatagcattaacagccctcaagtctgttaacattctccgtttacctgattttttcttagtaacaaacacaggagaattccaaagagagaaggtaggctctatgtgtccctttcgcaattgttcctgtgccaattctataaaagcctccagtttttcctgtttcagtggcattgatccacccaaacaagtttggcagttaaccaaacaaggggaatgggagctggaggctcagcaatggccactcctaaaaatgataccctaatccagttctatctatttgcccttttagttctaaaggttctggttggctattttcattttttcctaatcccttccccaggagatgtccaatttttctcataatttgtttactgttattactatactgttccataggaatagatatttcagcaccccattgttgtaataagtctctaccccatacatagattgagaggaatatgtgtaataataggttgaattgtcccttcttggccatctggcccttggcatggcaaaattaaagaactctgaaaaacttctgaggcagtccctatgccaacaatacccatggaagccttttctttgggcattgtcagggccattgatttaaagcagtaatagagacatcagctccagtatctactaatcctttaaagtctttaccttgaatggttactgtacaaataggtcttttgtcagaaacttgattaacctaatggacagcctttcctgctggattcgtactaccaaagcctcctgttcttttcactgtactacttcctagctttgtgtaaggtagtagtaataattgagcaattctttctcctggagaagcagaccatggagttgaggaagtaataactatttgaatttctctgctataatcagaatcaattattcccgtgtgaacagtgacaccccttaaatttaaactagaccttccaagcaatagaccaactcttcctgagggtaaagggcccctaactcccatggggaccttctttggtggctccccaggaagtaagaaaatgggaactgtactgcaaaaatctatggcagcagtgcctgctgtggtgggggacaattgttgtacatttgtaagggcagtggctgtgccagatatgcctcggtttgttgaggggcccaagttgggcaccccttcctgtttcccgaaagaggttgtccacattttttttattttttatttttttaaatgttattatttttatactttaagttttagggtacatgtgcacaacgtgcaggtttgttacatatgtatacatgtgctatgttggtgtgctgcacccattaactcatcatttagcattaggtatatctcctaatgctatccctccctcctccccccaccctgcccatctttactaaatttagaatgacactgatttgaccagtgaatcccttttttatatcgggggcagatactgggacttttttgttgcttaccggtagtagtctttgcctgctgatttccttttttacattccttttttgtgtatccaaattgcccacaattaaaagagactgagaaatggggcatgttttttcccctttagtccagccatagcttgagctaaatgaggagccttatgtaaattacccctaatgccatcacaagccttaatatattcagccaaatgagccttccctctcataggtctcatagcagcttgacattctgcattggcattatcatatgcaagaagctgtattgtaacatcttgagctgttttgtcagttatagctttatgcacagcctcttggagctgaggaataaaatcagcatatgattctttaggtccttgtaggacagaactgaaagaaggatatttttctcttgtaacatttattctctcccacgcccataagcacacagcatgcagctgagaaatggcaacattctctatcactgcctgattttctaatcacccccaattagggccaactcccattaactgttcaaaacaaacaggcacaggtggctgtgcttgtatgttttctcttgcctgagtttgagcttcatcagcccaccaagttttaaactgcaagtactgagatggagtgagaacagattttgttaaagtatcccagtcatatggtataaagtatcccagtcatacggtattaacctattgtcaagagccatattttttaataaagtttttacaaaaggagaatttggcccatattgactaatggcttgtttgaattcctttaacaacttaaaagaaaaagtggcccaattagctatatttcatccttcttgttgggttatagtaactggaaattgccatgcttcaaagtcaccttcagctctagctttttgaatcgaatttcgtataggaccaccaatcgctccaggttttaatgttgcaactacaggagtggtaagtttctcagctgtttcattttcttgcccattatggggagagggaggatatggccattcacttaattcagcaggtggaatcaatgggctagtaaaacatacctttttcagtttccctttgttttctttaatttcctccagttgctgttcctcacattcagaatctgaagttagttttttacactagtctgcctcttcctcttctgaatctgccttgtcatctgtttgaagtgccccaagagctgcctttatcaatgcctgcactgaccaaacagaaactggaattttggctccgtctttatatgcctttttaaattctctgccaattcttttccattcatccaactccatagtctcatgttctgggaaccatgggcaaaactgctctacagtactaaagagtgtcaataaattctgtgtactaactttcacatctcctctccataataaatgccttagaagtttaaacaagcagaatgtttgctttcattctgtcccattgttaccctggttcttctgagtgcccagcttagcactgagcttcttttagtcatcctcgggtgtcctctgacaatatgtcctctgcttccacaagctctagcgttccttcactggggtcttcatagtcccacattgggcaccagaaatgttggggtgatcaggcccaacaccaggccatgtgggctatgaagtctggcggagtcaaaggattgagacaagacaagttaagagtacttaaattgggtccagggggccaatgctagtatggaggctgtgaaggccccgagctctggaagcccacactatttatcagtgatcagacaaataagcaggtggtaaggacgtgcggatgtggggtaaacaggtgaggacgtgaggacttcgggctagaaaggtagcagtgcatcaagtgtagctgtgatggtttcacattttctttgatgcatacgtaatatgctgtgctacctgacataatggagaacatgtttatgagcctgggagagcaagaaacaaggaatcaacaagtctgtgccattccagaggccaggaggggttttatgccctgagccttggattccatccgagccacgaggggttttatgccctgggcttagattatggtgtggcaaggcagccttccaccctttggcacagagctttgtgttccagaggccacgagggggtttagaccctggacacaggacttgttccaagacccttttacattaggacaaacaagctagtcctgcctcagctcttctaccaacagtgatccacccacctcagctgctcaaagtgctgggatcacaggcatgaaccaccgtgcccagtccatttttagtcctttaaagtaaacacagatttgtttagataaaagctcattttaagagcacacaaaagcttagcacaaagataggattaaatttagctatacagaatgataaagactaaaagatactaagattctttgaaagaaacctgattatccaaggtaattatccaatatttgcagactgaagtacttatattgcaaaagcaagaacagttcagtgcataaactgaacagtggagtctgtagttgtaccttgctttctatttattacttcagagcaattagcatagttatgtgtagtgtttgtagacaacctgcattcatatacactaaatagtattttttttttttttgagactgtgtctcactctgctgcccaggctggagtgcactggtatgatcttggctgactgcaaccactgggtcccgggttcaagcaattctcctgcctcagcctcctgaattgctgggattacaggcacccaccaccatgcctggctaaatttttctatttttagttgagatggggtatcaccatattggccagcttgattgtgaactcttgacctcaggtgatccacacacctcagtgactcaaagtgctgggattacaggcatgagccataaagtttctttttttttgagatgaagtcttgcttttgtcccccaggctggagtgcaatggcatgatctcagctcactgcaacctctgcccctcaggttcaagcgattctcctgcctcagcctcccaagtagctgcgattacaggtgactgccaccacacctggctaataataaacagtattttcttttatttattattattattttattttttgagacagagtttcactcttgttgctgaggctggagtgcaatggcatgatcttggctcaccctcagccacacaggttcaagcaattctcctgcctcagcctccctagtagctgggactataggcatgagccaccacacccagctgattttgtatttttagtagagacggggtttctccatgttgatcaagctggtcttgaactcccgacctctggtgatgtgcccgcctcagccacccaaagtgctgggattacagacgtgagctgccacgcccagccaaataaacagtattttctacaatagtatgaataaaaatccacaatacttactttgaatgaatcacttgaatgtttattttaatattgttatttacacttttgaaatataaattgttttaactgaagtatagttgcaatttttaagaatgctacatacattactactagtttactaaaattattcatactcagatatttatatctaatatccaaaaaaaattgctaccaaattgctacagtagatattagtctgacatgtttattactttattcaatagggataattataagtaaacataatttaacatcttttatttcactaaattggaatgctgctattacaaaagaaataaagacaggtaatctggccacccaaaaaccataatagttctcctgttaactatgttgtaagttctaatgtattccaccataagaacatggtcagattctatttcttcatcagaaagtgttgttggaagttttcaggtatatttcaatgtagaacccccattcagtggctagaaaatgagacagcagcagagatggaaaaaaaaaaactataaaattcttgtgaaaatctgccccctttcttcgtaatgctcatgtttctcatgctgagagtagctgtgcactttgggtggttagagagaaattgcttttaggggactattttctggctgacttgatcaatcttatatctaatctgagctttttcataagatctttttaacttctctcaaaataatcttgctcagatagagatctggttttctctccagtgctttgggtgtctgtttcagaagtgctgttagtttcccatggtgtctgaatgagctgggctgtcacagtgagaatttctggagctatctctatctggactcatgctggaaattcagcagtattttttttatgtcaccattataaataaaaattggggctgaaactccactcacattcccattgttgtgaaggtgcaattctacccacgaggcctgcaggctctcctcctgcagctcaggctttactatctaatgtgactctagagtgctgctgtagcaaatggggttcacataaactgtgagctgtgctctcggctgtgcctcagtggcagatggtagaggccaagagaggacactagcaaccaggagaaagcaagcaggagtgctataacccagtgtcagggagtgcagagccactgctccaaaatgtaaatagccaaaatgatagaaccctattcaaccacttttgtagctagtgaaaacctaccttcagcaggcacctggcttcaagctgctaaactaccttctgttatgaagatggaaaaagtttgtccttgaatataagcaattagcatacacagatggcctcttcaacctgcctgtgaatttaggatgaactgtgtatgacgtggtgctgtaaattttacttgtggactaattatggtgatcatctttctttgcagtctcttaagcagattgactatgatgcatgtcacattcaagtttaatggtgtaataaaactgttttctttctgttttactattgtggagtttttttggggctggagaaaattgttcttttaattattgtttccaaacactgcctagaattaccaggcatgatataaacacataaggtgccaaccagaatttactttagaggaaactttccctctcagacttccagtcaactcacacttgtgcaacaaagtgcatgctgtcccctaaatatgcaggcagaactgtgtctctgcccatttggtatctatagtcctctatagttacttctagagagactagaccacatttctactaacttcacagggcaacaattaatcattttatctcaatgactcttgtatcttcagacctgaaactgattcagagaccatggggcccacaatcctaatctgagtaacatgtgtgcattgagtacatatgcagacatgagaatctccactttcctcttttttctcttggtaaattgctcacaaatgtataggtaacacctgctcctactccagccattcaggctctaaatctgcagctccacattttgtatccaggtcttgagatttgggggatagaacatttttgtctaaaaattgcaagtccttttggttatcaaactcagacgttgaaatgaaagtgcagttgtctttcttcccctttaaaatatgtattcatctcttgaaactgtttgctattgccacaagtagatatatattaaactaataatgccacattggatgctatatctcataccctaaaccataataatatatatctaatcaataatcaatgctatttctgtaaataaataaatatttctgacaaacaactttgccattaaaaaaatacatgaaagcagtcatggttcctacaattcagaaacatttagtctagactagcaactgcataaataattgaattatgcatcatatggttggtacaatatatagacgcatccaaaatcttgggctttatttaggccactttctttatgctgttgtgacttctgatgtctaccactgaagagatatttattaacagaagaattgttattataatttctttctttctttctttttttttttttttagacagagtctctgttgcccaggctggagtacagaggcactatctcagctcactgcaatttgtgccactagagttcaagtgattctcctgcctcagtctcccaagtagctgggattactaggccctgccactgtgcccagctaatttttgtatttttaatagaggctgggtttcaccatttttgtcaggctgttcttgaactcctgaccttgtgatccacctgcctcagccttttaaaatgctggaattatgggcctgagcgactgcacactgctgtatagtttctattttttttttaacattgctaactgtacatatttattttccaataaaattaccctaggaaaccttaagggatttgtttaaattgcatattaatgcatagtatacatttaacaggacagtggctagaaaagataaaaattacagaaactctgggatttaagtttcttttaggtaagcttagaaaaagcaaaactggaagtaccccagtggcatagagaacagaattctacatagggtcctcaccctgccccagacctgttcagattcaccctttttggaggccttattttggtctggccctaccatggagtcttgccttgcagaattgattagaaaagatcagagttttagctggtgaatcctgctgcctttctagacctgctgctcacaatttcctgaaatcctaaagcagataaatgggaaaaataaagtatgtatttgagggtcttagtttttaaattttcaatgaaaaccagtggttgcagagacattctatttagcaactttttttttattcctgcagatccagtagtttctgcacaagtcacaaaaaagtaaatacaaacagaataaaattttctctaaataactgaagaaatgaaaatgctgggccctttttctaaatagtggaaattattaaatccttagtaccagctcctaggatgttatgagaattaaatcacataatgtgttatgcccaacacagtgctctgtatcatacccttgagcatatagtacctgcttaataacattgcattagtacatgtgtacatgttgttttttaaatccagacctattcagacattgctgccttctgtttcttctgtaaactttacagagtcggcaaagaatatataactttaggatacagatggattgtccttgtttgtatcagaagtatttggttgtgacaagagtgctgagtgtaagggaccctgtgctgtgtctgcttctgtaactaatggtaataatgagccaatggggagcaacatcagcattgacaggggacttgtttaaaacccccattcatggacccttttcaaatctgcaatcacattacataaagtgggtaaaattaccaagtgatttataagctcgttaaagcttgagaggcaatgcttagcttagtgattatcagctcaggcttcttattagggtcacatggccaatttgcagaatctattgtgccctccccgcagcttctgtttattgttgtgtgtggaagcatccacgttgttttaatgaagtgcctcatgtgactctaaggtaaggacagaatcaggtttgaaggcttcaaaatacattcatgagagttaagttccacctttgcactaaagcatggtcactgggcctactctattttgacttggtagggacaggtcagtgtggtggatatttgtattactgtagcagaaattgctggtgtctgtggcaggggagggcacctgagtacaggaaagaagaaacttatatctttatcttcatggaggagtgtattgttcccaaatctcttctgctttaatggacagaaatgggtgggctttttctgtcttttctgtcagttgatgtcatgctagcaggtaaacatgtagtagtgccacctttaagggcatgttctccagatgcaggtgtaatttgtccagagaatctcagaagaaatccggaggagaaaaaaaaaaaaggtttttcttcagttaaacatgtcccaaatgaaaagctgtgtccactctgcctccttgaatgccatgcgtttagtacttgcaaatctttacttctctacttgtgttttttcttcctaaggggtttgatttaactacttctctaaattcttacaatagtcaaggatctctgaaaaatatttcttttctttatcccagagccttctctttattctctacatcatagcttcttatatgccacacagaattctcagcaagaatttatgatccacaatattaaaaatgtttcctttgtggctgttgaacatggaaagatgtggatactcaagatttctattgaggaaaactgtggtccttagtacagatagagaacatgtaatgttgaggcttcaatcatgtgttccatttgctctaagcagaacaggattaagagaatgcgtatttaaatgggatggcatttattacccagaaagttctgaaaaaaattattaggagattcctgctctctagggtgcttaatgaagcctacttaaaattcctactaaaaattacagaacataggagttacctgtgttttgaagtttgcataaaactgattttctttatggttaaattcagattttaatttactttgtttgggaggaatatttcaacactgatgctgtgttcttgtgtattagtatatcataaaaatttttttcatgtggttaatgggtaatgattcatttggtgaaatagctctctgacagatgttttcactatataattattttttcttcattattaagtatctttctgcagctgatatgcataaaccatcacatttaatctggaagctgttcttttttcttatttatttatttattttattttttattttttttttgaggagtctcactctgttgcccaggctggagtgcagtggtgtggtctcggctcactgcaacctccgcctccggggttcacaccattctcctgcctcagcctcccttagtagctggaactacaggcgcccaccaccacgcctggctaattttttgtatttttagtagaaacggggtttcaccatgttagccaggatggtctcgatctcatgacctcatgatccatccgcctcagcctcccaaagtgctgggattacaggcatgagccacctcacccggcccttttcttatattttactacatttttttctggaaaattaaggctcttatctttgtttacaggccagaaaaagtgggaaaaacaaaggctcttccatttattgaatgacaaaatatccttcttaggccaaaaacattggcattactagtgagcttgttagaaattcaaaaaatcagtcaggtacagtggctcatgcctataatctcatctctttcggaggccaaggtgggctgatcacctgaggtcttgagttccagaccagcctgaccaacatggagaaaaacctcatctctacaaaaaaaaaaattagtcaggtgtggtggtgtatgcctgtaatcccagctatttgggagactgacccaagagaatcgcttgaacctgggatacggaggttgctgtgagctgagattgggccactgcactccagcttgggcaacaagagcgaaaatctgtttcaataaataaataaataaaaattgagagatgtcttccaactcaacatgtcttttccatttggaaaatattcacaactacttccgtatgatgtaaatatagcacacaaaagtgtacatgttcatgtttatgcttttaattttatactttattatctagaaaagtatatgaacggatgttgtggatcttacgctactcttttttcttagagttagagaatacattagagaatatttctgtgttgaaaattattttattggataattttagtcagtcctataagtcagaaccagttctgtttactctctaatttcaccttaagtcaaattaaaaatgtcgctcatggttacttagtaaatatgtgtgtgtgtgtgtgtgtgtgtgtgtgtgtgtgtgtgtgtgtttcaggtaccatagcaatttagagacgtggccatagaattctctctggaggagtggcattgcctggacactgcatggcagaatttatatacacacgtgatgttagagaactacagaaacctggtcttctttggtgaggataactttaatacataattcataatatacgctaaagattttatttcttttttttttttttttttttttttgagacggagtctcgctctgtcgcccaggccggactgcggactgcagtggcgcaatctcggctcactgcaagctccgcttcccgggttcacaccattctcctgcctcagcctcccgagtagctgggactacaggcgcccgccaccgcgcccggctaattttttgtatttttttttagtagagacggggtttcaccttgttagccaggatggtctcgatctcctgacctcatgatccacccgcctcggcctcccaaagtgctgggattacaggcgtgagccaccgtgcccggccttatttctttattttatggaatgttttttagtaatttattcttggcataaaagagtttcagatcccctttttccagaaaactttcaaaatttgttcatttagaaaagaatttcttcaaaatgtttcatcttaatccaaactttccacattcctgagttgagctgtatttttcactctaaattagtggtaattccagcaatttagtagcataaaatatgttgcccctacctgaaaatctaatgtttgattcagtagtaccaggtagtcaggtagtaaaattaaaaaacctacaaattgaaagtattttctaaatatttagaaatttcctttagaaattaatattttggtattaatttactagaatattttattatatcctctctgctgagcacattactaacctgtacttggagaatatgagcatgattcatgttattttttttttttttaataaaacaggtactgttgccgggcgcagtggctcacgcctgtaatcccagcactttgggaggccaaggccggcggatcacgagggcaggagatcgagaccatcctggctaatacagtgaaaccccatctccatcctgaccgagaccatgctggctaacacggtgaaaccccgtctttactaaaaatacaaaaaaaattagccgagcggggtggcgggcgcctgtagtcccagctactcgggaggctgaggcaggagaatggagtgaacccgggaggcggagctggcagtgagctgagatcacaccactgcactccagcctgggccaaagagcgagactccgtctacaaaacaaaacaaaacaaaacaaaacaaaacaaaacaaaacaaaacaaaaaaacaggtatcgttgtctggaagtcagacctgatcacctgtctggagcaagaaaaagaaaaaaacctttgactatgaagagacatgagatgactgccaaacccccagctaggtgcgagtgaaaatcaatacaatagacaacacagataagaggtcccaaggtcaaagagaaagccggtccttaaaatgtgatttgggaagctgtgttccaaagaaaatagttcctgggcagctcgtgttttttttttgttattgttgttgtttattttttaattttgctttcacagagaggcatcttctgttttatgattttaaattctctaagaattctgcttttcttttggtgagcttccttcaagtccacagtgagagccaaagtcctcatcatggcatataagagactgcacaatctggctgctttttcattgttttgggggcacataaatatctgcatgctttttagagactaaaactattttttaagttttttttttcatcaagtctgaaatgtgtgagagtagtagtttctgttgcatttttttgttcatttttccttacagtccattctgttttcattactatatcatcttgaaatatagtttgaaattagtatgatatccttctgctttgttcttttttttcaagatggctttggctattcaaagtttattttaattttatgtaaattttggaattgtattttccattactgtaaaaaaataccattgcaattttgataggaagtttattgaatctatagatcacattagataatatggtgcttcagtaatatttattctttcaatccatagacataaaatagtttaaaatttatttggatcttctccaatttttttcatttttttattgtgaagattttttacccagttggttaattttttctcagaaatttattatttaatgccttagtaattgagtttttgtcttcctctactttattatttttttgagatggagtcttgtactgttggttgcccaggctggagtgcaatggctcagtctcggctccctgaaatgtccgccacccagattcaagctattctcctgcctcagcatcccaactagctgggattacaggcagccaccaccacacccagctaatttttgaatttttagtggaaacgggattgtatcatgttggcacactggtctcgaactcctgacctcaaatgatttaaccgcctctgcctcccaaaatgctgggattagaggtgtcagccactgtgcccagcctcattctctattttatcagatagtttgttttaagtgtatgaaaccatacgtattcttaaatgctaattttatattttgctaatttactgagtgtatttaatagtttagacaggttttaatgtactgtttatggtttttaaacataagattgtatgatctacaaacagcagcattttgtttttcttcaggttcaaaagatttttttattttcttgtctaattctttggccaatacttccagtgctacattaaaatagaagcattgacaatgggcaaaatatagttttgtattggtgtctgaatttgatggagcaaacacatcttcatgttttttgtttttgttttgttttttgtttttttttgagatggagttttgctctcattgcccaggctgaagtgcaatggcatgatctcggctcaccgcaaactccgcctcccaggttcaagcaattctcttgcctcagcctcccgagtagctgggattacaggcatgcaccaccacacctggctaattttgtactttttagtagagacagggtttctccacgttgaggctggtctcaaactcctgatctcaggtgatctgcctgccttggcctcccaaagtgctgggattacaggtgtgagccaccatgcctggccatcttcatgtttttataaactgattttagaaggtaaagatcttttgttgggtccttaggatgataagatgccctctgaatttgtagtgaagaggggctgtagcttggtcacaaggctgctgggtctgcattagggcccacctttagttggcttgttacaggggcttgggttgttgtaattcccattttatttttgaacaaactgcatatccttcaggactttgctctacagggcagacactagggcacatttttgcagttggtttttcacatggtgggccttgtatcaggatgtggatgagtgtggctttcactaagtaccagagagcatttcctcaggtaactgtgtgagtttctatataggcagcactggccatgaactgtggctcaggtaactgaaactgcgtcactgaaccacttcagggaccacagtaaaggccaacttctgcagttatatttttctcatttcctgttttactttcttaattttcatttaattttgtactggtatgctttgattattttttattttcttttgcataaattttataaatattatatttataatcatcttgaaaactggagattacatctgaaagttaaaacaatatgttttaatcttataacaacttcaattgaatacaaagattatgcctctatattttagtttgttattcatattgaaattattttatatggtgtatctattaacagatttatgcagatttacatattgctttttatattctattaaaaaactttaaaggctttatgtgccatcattttttaaaaattattattgagattgaatcttgctgtcttgcttaggacggagtgcagtggtggaaccttggctcactgcaacctctgcctcctgggttcaagcaattctcctgcctcaggcctcccaagtagctgggattgcagacgcctgcacctagccttggtaattttttgtatttcttagtagtgctgggctttcaccatgttggccaggctggtcttgcactcctgacatcaggtgattcacctgcctcagcttctcatagtgctgggcttacagttgtgagccaccgcccccagccagaagatactttttatctcactattcctagctttgtatatcaatacaaagattgacacagctagatataaatatacataggaagacaaatgttcatatagagaattatataactatttctatataatgtttttgtatacaaaatatgttccccaaaagacatctttaatcttttagcatacatctcagatgctgatgtagaattatttgttttcttttgctaaataacatgtcagaatggaacgtagccatacaactttttatgtaaataccaacaaagctttatcttcaagggcaagtctacagaaataagctgaaaataaagccatgtaacccatctgtccaggttagtatttcagtgccctgcatttctcctcagtgtctgcatgttctgttcacatctaccatttggggcctgccttgataaagccacagtgactatttatataattgaatgattggatccatgcgtgctgagcaaattggctggtgggagtcacctgggctgttcaaattggctgattggaatctcctgggttctgctaatttgcttatttaatttacctcggcttcaggggtagaatatggagatatcacctgacctactttatttctgatgcttttatttttgtggggcctatgcataaataaacattacgtagacatacacatgtaactcattttgtgcatatatgtttatctagccatctattttatatgtatatgtacagaaagaagactataagataaacttggtcagaggctatttccatttctttacctataggttaggtaaattctatcagctacttagctcagtgaagatttattcaaaccaagccacacatcacatcacatttttttttccataaatgtaaaaatgtttttaataacctggcacctgggtgtttttaattctggtcacactaaaccagcccagtgaggttttgttcatctgtctaggaactgccagaaatgctcaacaccagtgggctgagccttcctcacaaggaagatttgacctggcaaataagagccacctgtggcacttcagtgaatgttctctatcacccctttgaaatgtggccaagtaccacgtaccattatatttgcttccatcatcaccatctgtcttccgaaaagaggcctaaacttcattttcattaccataaatatccaacttctgccataaagacgaaaagactagagggtgactttacatcacacactcttggaaaaaattagagttcttgtcttgatggaagttctaaagagtgggtgagacattaagtgactaccaggagctagataattgctgttttactaacagatgttcattttcatttccatattgtctcaagttatggtaataataaagtaataatggtatccaggaaatttcaaaaaaacttatttttttcatcagccataatagtaatcaaagacagagaaataaaggtttttaagtcataatttatattttaaaattaacatgcttctagaaataaaaaaggaaaggaagaaagaaatatacaaacaaatgaaaggcagcctggtcaacatggtgaaagcctgcctctactaaaaatacaaaaattagccgtgtttggtggtgcacacctgtaatctcagctactcaggaggctgaggcactagaatcgcttttacctgggaggccgaggttgcagtgagcagagatcgtggcaatgcactccagattgggtgacaaaatgatactctgtctcaagcaaaataaaaacaaaaacaaaacaaaaagaagggaagtggaatactcacaatacctaaagtatggaatcaacttaggtgtacatcaataggtgaatggagaaagaaaatgtggaattatgtacacaatgcaatgctattcagcccttaagaaagtcttgttatttgcagcatcatttatgaacctgaatgatattatgctaagtaaaataagccagcacagaaaaacacacaagcaaaaaaattattttatttttgagatagagtttcactcttctcacccaggcaggcgatggtgcagtggcaccatctcagctcactgcaatctctgcctcctgggttcaagcaattttcctgcctcagcctccctagtacctgggattacaggtgccagccaccatgcccagctgatttttgtatttttagtagagacaaggtttgtctatgttggccatgttgaccaggcttgtcttgaactcctgacctcaagcggttcacccacctcagcctcccaaagtgctgggaggtgagaggtgattacttcttgcatgaatgagattccctttttttccctctgccataggatcctcttattgtccctactggaagcaacatgcagaaggcaggaatgatgacaatatacaaatacgtttcctgccatgtgaccaccataagcagcttgcaacatggctcacctagaagttacttactttcaggccagcaagcgtgtttttctatgatgtgtctctttctcttgaaagcacctctgattaagtttagcacaatcagtgtaatctccatttggataaacacaaagtcaacgcaagaggaacctaatttcatgagtgatttcacaccacagttacacatttttttacgttggagaggaaagcaggtgtgcaacggactgggaatccagggtattatcttagaatgttgcctacccatctcaataaacttttacaatagtctttctgctgcttttgttatctgcataaacaaagatatcatgtgcaaataataattaactactttccagctttattcactacaaatattaacatcttttttctggcttaaattatttttcctttatgtaccattttatacattcacccacacatggaacaataaaaatgtatccacttatttaattttggttaaattttcattaaaatgagtgttaaaaataactttttttctgtttgaagagggcttttattgttttactcaagagtgttattttgcccagtgcggtggctcacacctgtaatcccagcactttgggaggccgaggcaggtggatcatgaggtctggagatcgagaccatcctggctaacaccccatctctaacatcgatgactaacattgagatcatcctggctaaaccccatctctactaaaaatacaaaaaattagccgggcgtggtggtgggtgcctgtagtcccagctactcgggaggctgaggtaggagaatggtgtgaacccaggaagtggagcttgcagtgagctgagattgggcggctgcactccagcctgggcgacagagtgagactccgtctcaaaaaaaaaaaaaaaaggtgttatttctggagacaaagttgcctgtgctttaataggtagattatggaaataatttgaaacataaaccataaaattttacattaataaattcagtgcaaagcagaaagtataaatttgctttcagcattttcaaggtgtttagttttctattactcacctaattaaatttgttttgttccaataattgttcttttcttctgaaaatatgtacaaatgcatactgacacaaacacacttactcacttcataattttcttacacctaaggttcatcttcagagtaatatgtgtatatttcactctatgaaaattaaaactaaaactatgttttcaggcagagagaccacatgttcaaagactatatacacattcaactatataacaaatatttattaataatttttcaggactcagaaataaaaggattttatttctatttctttctttttttttgagacagagtctcgtgggagtacagtggtgctatctcaactcagtgcaacctcggcctcctgcgttcaagccattctcctgcctcagcctctggagtagctgggattacaggcacgccaacatgcccagctaatttttgtatttttagtatagatggggtttcaccatcttgctcaggctgctctccaactcctgacctcatgatctgtctggctcagcctcccaaagtgctgggatcacaggtgtcagccactgtgccaaacccatattctatttatatctctgtataatttgtattatgaccataaaaataaccctgcagtcaaaaagaatttaattgtgcattttaaaataactaaaagtgtataattacagtttgtaatacaaaggataaatgctagaggtgatggataccttatttaccctaatgtaattactacacattgtatgcattaatgaaaatatgccatataaggcgtaaatatatacacatactatatacccacaaatactaacaataaatttcaataggaacaaagaataaaaatttaacctatgggaaaaatattcttcaactcatttgcagtttaaagccactgacaaagtgattactagagatgttattccactatgtaccaaatagtatactgctgccatcttttacctacacccttgagtaagttgggataggttaaagttagtcacatttaaaggcttatatttaaagtcaacttaaaggcttatactttctggaagattttttcacagtaattgcacttttaatgcctttattaactatgaaccttcttatattgagtaagatgtgagtgggcattattcctgtaattccaacacactgggagatcaaggtgggaaaaatcacatgaggtcaggagtttgagaccagcctggccaacatggtgaaaccctgtatctaccaaaaatacaaaactagctgggcgtggtggtatgtgcctataatcccagctacttgggaggctgacacacaagaattgcttgaacctgggagtggatggttgcagtgagtggagattataccactgcactgcagcctgggcaacagagcaagagtgtctcaaaaataaaataaaattggccaggcatggtggctcatgtctgtaatcccagcaatttagggggctgaggtgggttgatcatttgaggtcaggagttcaagatcagcctggccaacatggtgaaaccccgtctctactaaaaatacaaaaaattagccaggcatggtggcaggcgcctgtaaccccagctactcaggagactgaggcaaaagaatcagttaaacccaggaggtggacattgcagtgagctgagattaagccactgcactctagcctgggcgacagaaaaaaactccgtctcagattaaataaataaataaataaataaataaataaataaataaataaaattgaataatattcagtaagtgaactagaaacacagacaactaccaaagatcagaaaaatgaaaataacaagaaatattaaaatagcaaaaaaacagaaattgtggatataaaaaatacaaaaaatccctgaaaaatttctttaaaaaatgatgtaaacatggaaaagttgaacaaacaaactaggatacacataaagatatttataacaagcatacatataagcaaaatttcaaaattcacagataagagaattttgggagctcaatgtaggcagatgtatgatgaagaattgttgtatgcaactgaagttaattttttaccacattcagatatgttgttggatcctttagaggttttgtgcagtcctccaaggtaccactaagaaaatatctgtatagatacacaaaagaaaatttaaaaaacctgaaagcatgtcaatacaaaaatcaaaaaaacacaaaaaagacagaaagagaaaatgagagacaaagatacaaaatctaataaaacaattaataaaataccattagtaagtttttctcttttagaaaactatttaaatatatataattatatttccaatcaagagacatactttcaataaaaaggtttattaaaaattctgtgaaatcaagattcaacttgactttctacaagagtcagttgagatctaatgacaaaaaaagactgaaagtggtgagatggaagtagaaatttaatgtaaatattaaccaaattagagcagaagagctcaaaataatattacacaagctacatcttaagtaaaaaactgtcatattttataaaatgtactttaagtcaaaacttcaaacagacaaaaaaggacatttaacaatacatagattcattccctgtgaatgtatgacaaatttgtttatacatgcatgtatttgtgtgtgtgtctcaaattaggctttcagatatataaagtaaatactaacaaaactgaataaacacagagagagcaatataattatagtaggatatttcaataccccactttctgtaataataataaaacaagatgatattagtaagggaacagaggactaaaaggcagtcaaaaacaataatttctaatgaaggtatagagaacactcctcaacaacatcgggatacacagccttctcaatagctcattcaacattcttctttataaaccacctgataggccaaaaacaaagacttaacacattttttaaaaccgaaatttcatagattaccttctacgacaaaaaatggaattagagtataaaacaataatataaataattgataaatttacagctatatagaaatgatacaacacactcttgagcatgcacttgttgaaataactgggctgggtgcggtggctcatgcctgttatcccagcattttggaaggccgagacaggtgaatttaattccatctaaaaaacaaacaattcaaaaaagaaataattaatattgtgaagatttctgtaccgctcaatttaatctacagatttaatgcaatatttttcaaatttctcattgcatttttgaagaaataaaaacagcaaatccaaaagtatatggaatctaaaaaggcaataaagtacccgacaatcatcaaaaaaaggaacaatgttggaggcattaccatttctgatttcaaaacacatcaaaaagatacagaattaaaacaatttggtatgagcataaaggtgaaaaagcagactaataaaatagaatgcagcacacatattaactttcacataattattgcagcattgttactgaaagccaataggtaaaagcaatgcaaatttctgtcaccaaatgattctgtagatataaaaatagtggaatctcgttcagttttcaaaaagcagaaaatattccaacaactattaagataaatattgatgacattgtgcaaaataaaatgagccagccacaaacagagattttataagcatttatacccttagaaagagaaaacagagtagtgtttgaaaagtgccacaaaatgggaagaattggtagttgtttaaggtgtatagagctttagctttgcaagataaaaacattctaatgatatgttacataataatgtcaatataattaatatgaacaaactgaatatttagaaatatatacttctcactctgtctcccaggctaaactgcagtggcacaatatcagttctctgcaacctccacctcccaggtttaacaaattcccctgcttcagcctcctcagatgctgggatgacaggaggatgccaccattcctggctaatttttttatgacactgcgccctgcctagaaatattttaatgtaaattttgttatgtgtttctgacacataacacataagtaaaaatcaacaataccagcctggccaacatggtgaaaccttgtctactaaaaatacaaaattagccaggcgtggtggcgcaggcctgtaatcccagctattcgggaggctgaggcaggagaatggcttgaacgcaggaggcggaagttgcagtgagctgagatcccgccgttgtgctccagcctggtcaagaagagcaaaactccctctcaaaaaaaaaaaaaacaaaaaacacctgttacaacaaacctacacaacaaatatacaagtgacacaaaactacgggaataatatttatactgaacaaactgcatatttagaaatatatactttttgctctatctcccaggcgaaactgcagtggtacgatctcggatcactgcaacttccacctcccgggtttatgcaattcccttgcctcagcctcctcagtagctgggattacaggcgcgcgccactatgcctggctagttttttgtattttagtacagacagggtttcaccgtgttggccagtatggtctccatcttctgaccttgtgatccacccgcctcggcctctgaaagtgatgggattacaggcgtaagacattgtgtccggcctggaaatattttattgtaaattttgttaggtgtttttgacacataacacataaataaaagtaaacaaaatgcctaaaagagatacggagttattattgtttttaaattatctttaaatccaaaagtgtttcttggacacaaaaataatatagattcacaaataaagagatgttgaaatcaggagaatttttatgactactcacctagacaggattaaaaaactgttacaggtcgggcatggtggctcacgcctgtaatcctagcagtttgggaggccaaggcaggcggatcacctgaggtcaggagttcaacaccagcctgacaaacatggtgaaaccctgtttctactaaaaatacaaaattagctgggtttgggggtgcatgcctgtaaccccagctactcaggagggtgaggcgagagagcgacttgagcccagaaggtgaaggctgcagtgagctgaggtcctaccattgtactccagcctgggcaacaagagcaaaactccctctcaaaaaaaaaaaaaaaaccctgttacaacaaacctacacaacaaatatacaagtgacaccgaactacagggataatatttatacaggcaaagaaacagaaataattgtattggcaatagacatggtttattcatatttaattttgctccacactgtcttaaattgtacagagttaaatattgtcatatacaattataatataaactaaaaaatcaaaacacaattaactggtgtgatgtgatgtacccaagaatacacaacacaaaaatattaaattgcaaaaaaaaattaaaacatggaatgtaaaacttattgaataccataaagtagatcaatgttttcatgaaaggaatcttagcatatagggaaaaagtaatacataggttacttgaagattaaaaaaaaaagaaaaaaaagctgagaacttcccaaattttgatgtaacaaaaaaattttctaacctgtaatactagattcaaaattatcttaatttaaaaagaagataaaaatgaagactttgctaaataaaagttgagtgttcatcaccattagcacagtcctagaagatatactacacgggcttgtgtgctctggctcacgcctgtaatcccaccactttgggaggccaaggagggtggattgcctgaggtcaggagttcaagaccagctgaacaacatggtgaaactccatctgaactaaaaatgcaaaacttagcccagcatggtggcacacacctgtattcccagctactcaggaggctgaggcaggagaattcttgaacccaggatgcagaggttgcagtaaaccaaaatcatgacatgcccctttagcctgggcgatagagaaagactccatctcaaaaaaaaaaaaaaaaaaaaaaaaataggccaggtgcaatggtgcccactgcactccaccactgcactccaacttgggcaatagagtgagactcagcctaaaaaaaaaaaaaaaaaaaaatcaaaatgattgtacataaaacctttaaagttattttatagaatataaaaaacaatatgtaaatctgcataaatcggccaggcacagtggttcatgcctataatcccagcactttgggaggccaaggtgggcggatcacaaggtcaggagttcgagaacagtctggccaacatgcagaaaccccatctttactaaaaatacaaaacttagccaggcacggtggtgcatgcctgtaatcccagctactcaggaggctgaggcaggagaatcacttaaacctgggagttggaggttgcagtaagccgagattgcatcactggactccagccttgacaatagagtgaaactccgtctcaaaaatttaaaaaactgcataaatctgttaatagatacaccatgtaaaataattttaggccaggcgcagtggctcatgcctgtaatcccagcactttgagctgccaaggtgggtggatcacctgaggtgaggagttcgagaccagcctgtccaacatggtgaaactcctctctctactaaaaaaacaaaaattaggcaggtgtggtggcaggtgcctttaatcccagctacttgggaggctgaggcaggagaatcgcttgaactcaggaggtgaaggtttcagtgagccaagattgtgccattgcacttcagcctgggggacaagagcgagaagacttcgtctcaaaaaatcaataaattaaataataattttaatatcaataacaaactggaaaatatagaggcatcatttttgtatttaactgaagttgttatgagattaaaacatatgttttaactttaagatgtatgtaatctccagatttcaagatgatgacaaagataatatttatagaaagtattcaaaataaaatacaaaataatcaaaacaagccagtatgaaattaaatgaaaatttaaaaagaaggctgggtgcagtggctcatgcctgtaattctagcaatttcggaggccgaggtggcagattacctgaggtcaggtgttcgagaccagcctggccaacatggtgaaacactgtctctactaacaatacaaaaattagccaggagtggtggcaggcatctgtaatctcagctacttgggaggctgaggcaggagaatcatttgaacctggcatgtagaagttgcagtgagtggagattgtgccattgcactccagcctggggggcaagcatgagactttgtctcaaaaaaaaaaaaggaaaacaggaaatgacaaaaatataactactacaaacacacaaaacaataacaatataactggtaattacaacttcatttttttttttttgaactggagttttgcccttgttacccaggctggagtgcaatggcatgatcttggctcacagcaacctctgcctcccgggttcaagagattcttctgccttagcctcccaaggagctgggattacaggcatgaaccaccacgaccatctaatttggtatttttagtagagactgtgtttctccatgttggtagggctggttttggactcctgacctcatgtgatctgcccatcttggcctcccaaagtgctgggattacacgcctgagccacctctcctggcccctacaacttcatttctttaagcaatcattttaaacataaattaattaaactacttaataaagtaaaatgcaatcttaggactttggaaggcaaaagtaggctggtcacttgatcccaggagtttaagaccatcgtgggcaacgtgacaaaactctatctcttcaaaaaatacaaaaaagctagctgggtgtgacgcacatacttgtaagccagctacttgagaggctgaaatgagtggatcatctgagtttggtaggttcaggcagcagtgactcatgcaaatcagcctggttgagagagttaaaccctatctcaaaaataaaggaggccaggtgcagtggctcatgcctgtaatcccagcattttgagaggctgaggtaggaatatcacacgaagtcagtagttgaagaccagcctggccatgagggtgaaaccctgtttctaccaaaaatacaaaaaattggccaggcatgctggcaggcacctgtaatcccagctacttgggaggctgaggcaggagaatcacttgaacccaggagccacaggttacagtgaactgagattgcaccattgtactccagcctggtcaacaagagtgaaactccatctcaaaataaataaacatatatataaataaataaaattatgtaaaggaaaagacatagaatgccttagtggttttttaaaaagctttctgtatggtgcctacaagagagtcattttagcattcattcaaataggatgaaagtaacggaagaaaaaaagtatattcaatgaaaatagtaaccccaattgagtgaggcggtcataattatattagatataatacgcattaagccaagtactaccatgagacaaaggttgatattatattattgtaaagtgagttgatttaccaggaatctgtaactataatatttatctatctatatgtatgtgtctatataacatcagggctccaaaatatataaagtaaatattgacaaaactgaagcaagacatacatagcaacacaataattgtagacatcaataccccattttcaataccagaaaatacagataaagaaacagaaaatgtagacaacattacagactatattaattattttgcatatagaggaataattgagaatacataatttaaaaaggaaaaaggcttatttggctcacactttggcagactgtataagaagtgtgtgccagcatctgcttctggtgaggttctcaaaaaacttacaatcatggtagaaggtaaagagtaactggacttattatatggtatgagacaaagcaattgtaaggtgaaggagccagcttcctttaatgaaccagctctcatttgaattaatagagtgcaaactttttggttaccaagaggatgtaccaagccattcatgagaaatttgccctcgtgacacaaacatgtcccaccaggtcccacattcaacattgaggatttatattgcagcatgaggtttggacaacatggacatccaaactgtattatagaccatctaggcttcacagacacacacaaaacgctccagtcaaaaccaagatgatacacaatattcttatttgcatctggtgtattctgttatgacatataccaagttttattaaatttaaaaatactgactgggtgcagtggctcttgcctataatcctaacactttgggagaccgaggttagaggatgcattggggccaaaagtttgagactagtctgggcaatatagtcagatccaaacactacaaacaagcaaataattagccagatgtggtagtgcatgtctgtagtcctagctactcagaaaactgaggtaaaaagatcacttgagcccaggaggctgaggctacagtgggccaaacttatgctactacactccatcctgtgtgatggtaaaaatcttatcttaaaacaacaacagccattattttaaaaagattaaaattttgtataagttgctggctctttaaagtttacagaggaaacagagggcagcaatgtctgaataagtctgtatttagaaaacaacttgtacacatttactcatgcaatgttcattaagcaggtactgtgtgctcaagagtatgatacagagcacagcactgggaataacattatgtaattctcataacaccctgggagcttgtactaaggttttaataaatttcagtatttatataaaaggcccagcatttttatttcttcttgcatttccctatcatcaaaattttaaaaaactatcaagaataaaagctaaatagagacagatataagagatataaaaaggtagagtttaatgtagtttagagaaaatttcattctgtctatatttacttttttgtgacttgtggagcaactactggatatgcaggaatagaaaacaagttcctaaatagaatgtttctgcaaatagtggttttcatagaaaatttaaaaactaagaccctacaatacatactttatttttctcatttatctgcttttgggtttcaggaaattgttagcaccagctctagaaaggcagcaggattcaccagctgaaactctgatctcttctaatcagttctgtgaggcaagactccagggtagggtcagaactaaataaggcctccagaaaaggtcaatctgaaagaactgggccaggaagtaaaccctatgtagaattctgttctctatgtcattgggagatttccgttttcttttttctaatcttacctaaaagaaacttaaatcccagagtctgtaattttaatcttttctagccaatgccctgtcaactttatactacatgataatatgcaatttaaacaaatcccttcagtttttctagggtaattttattagaaaataaatacatacacttaacaaggtgaaagaataaaaattatatggcccagtgcggtggctcatgcctgtaatcccagcactttgggaggctttggcaggtggatcatgaggtcaggagttcaagaccagcctgactgagatggtgaaacctcgtctctactaaaaatacaaaaattagccgggtgcggtggcaggcacctgtaatcccagttacttgagtggctgaggaaggagaattgcttgaacccgagtggcagaggttgcagtgagctgagatcacaccactaaactccagcctgtatgacaaattgagattccatctccaaaaaaaaaaaagaaagaaaagaaattaaaattataataacaattcttctgttcataaatatcccttcagctgtggacttcagaagtcacaacaatataaagaaagtggcaaataaagcccaagattttggacacatctatttgttgtaccaaccatatgatgcataattcaattatttatccagttgctagtctagactgaaagtttctggattgttggaaccatgactgcttcatgtatttttttaatggccatataaattggaagctactagtttatctgtttgggtctccagatcttctccttgtttatcatcccagtaccaggaaactagagaaactcatctgggtaccaaccaaagacatcttttatatgaggggatgaacaaacacaggatgactcatttctcttacactgagacagaagcagaagtaatcactcttgtctgctctggacatcctcaaatgcttcaaagacacctaggtgactgagagaattcccattgacctggggctgatggcccagtgataagccaggttggagagactcaggccgattctaaataaaaaatggaactgccttggtggagctcaaaaacctggatcacccgtcctgatttgctagctcttgggtaaaagaaagaacaaaaatgctctactccagtatcacattttacaggtaaatttagttgtgatcatggttctggatactttgtggcctcgatctctcatgcctaagatgcttatttacacttacagattctgccatcacattctatttcctcctggatcctctcacatcactgtagcagggcaatgaacaaaatgtgaaaaatctcaaaatgccacactcccaaatgggagcttaagatgtcaagactgacatctcacagtgcagaaaatgccttttgttagttttctgtacatctccgtccaaagtccagaccttttttgtaaattccaggcagagggcagaccttatctgcagattctaggtaggatcaacctggctctgcatcctatggtgttacagtaagtggagtacaaaggagggatcccctcatagaggctgctctagcacattctaaataagtctaaatggaaaaaaaaaaagctgatgtaacatgaatgtaagtagacagtttatttgggtcaactttagattataaactgggagcaaatattcaagttgccttaaatctacactttgattagcagcagttacaagaagatttgtaaagacaacaagagaaagagagagagtgggctgacacaaagttgtttttcagaaaattttatttatttacagaaatgactttgattattgattagaaatatatggttatggtttagggtatgggatatagggtccaaggcagcattattagtttattttatggctacttgtggcaatagtgaacagtttcaagagataaatacatagttcaaaggggggagaaagacataactgcactttcattttaatgtctgagtttgataaccaaaagaacttgcatttttcagataaacgttttttatttcccaatctcaagactgggattcaaaatttggagctgcagatttagggcctgaatgtctgaagtagcagcacgtgttacctgcaaatttgtgagcattttagcaagaggaggaagaagaaagtagagatcctcttgtctacatgtctactcaatgcacacgttactttaattggatttgtgggtcccatgatctctgaatcagtttcagatctgaagatacaagagtcagtgaaagaggtaaaatgactgattactgtattgtgaaatttatagaaatctgatctagcctctctagaagtgactgtagaggactatagataccaaataggcagagacacaattcttcctgcatatttatgggacagcatgcactgtgctgcacaactgtgagttcactagaagcctgagagggagtctcctctggagtaaattctggttggcaccttatgtgtttatattatgtctggtaattctagacagtgttttgaaacaataattaaaagaaaagttttctccatccccagaagaatgccacaatagaacagaaagaaaatggttttattacacaattaaacttgaatgtgacatgcatcatagtcaatctgcttaacagactgcaataataaaaagacggacatcataattagtccacaagtagaatttacagcaccatgtcatacatagttcattctaaattcacctggagattgaagaggtcatctgtgtatgctaattgcttatattcaatgataaataatcttttcacatcttcataacaggaggtagtttagcaccttgaagccaggtacctgatgaagctaggctttcactctgctacaaaaatggttgaatagggttctatgtttttggctatttatattttagagcagtggttctgtactccctggcactgggctacagcactcctgcttgatttcacctggttgctagtgtcctcttgacttctaccatctgtcactgaggaacagcccagagcacagctcacattttatgtgaagtctatttgccacagcagcactctagtgtcacatcagagagggaagcctgagctgcaggaggagagcctgcaggcctcctgggtagaatgacacattcacaataatggaaatgagagcagtgtttcagcccatttctacttataatggtgaccagggaaaaatactgctgattttccagcatgaatccagatagagatagctccagaagttctcactgtgacagcccagcttattccaaaatcaagggttatgaataaggcttctgaaacagagacccaaagcactggagagaaaaacagatctccgtcggagcaagatggttctgagagaaaaaagttaaaatgatcttaagaaaaatctcagactacatataacattgattatgtcagatagaaaatattcccctaaaagaaatttctctctaaacacctaaagtgtacagctactctcaacatgagaaacatgagcattatgaagaaagggggcagattttcagaagaattttataaagtttcttttctatctctgctgttctctcatctcctagccattgaatgggggttctacgttgaaatatatttgacaacttccaacaacactttctgatgaagaaatagaatctgactgtgttcatatagtggaatatgttagaacttgcaacacagctaactgaagagctattatggtttttgcatggccacatcacctaaccttatttgtcctgcaatagcagcataccaatttagtgaaataaaatatactaaaatagtgtttactcaaaattatctctattgaataaagtaacaaacatgtcacactaatatctacttactgtaacaatttggtagtaaagttcctttggatattaaatataaatatcaaagtataaataattttaatgaactagtgttaatgtagatagcatttaaaaaattaaaacttcagttaaaacattttatatttcaaaagtataaataacaatattaaaataaccatttaagtgattcattcaaagtaagtagtgcagctttgtattggtactattgtagaaaatactgtttctggcttatgcctgtaatcccagcacttaagaggctgaggagggtggatcacctgaggtcaagagttcaagatcaaggtggtgaacatggtaacaccccatttctactataaatacaaaaacttagtcatgcagggtgaggcatgcgtataattccagctacttgggaggctgaggcaggagaatcacttcaacctgggaggcagtggttgcagtgagctgagatcacaccactgcactccagcctgggcaacagagtgagactctgtctcaaaataaaagagaaaatacagtttaatgtacatgaatgcagattgtccacaaacattacacataattatgctaattgttatgaagtaataaatagaaagcaagatacaactacagactccactgtttagtttataccctgaactgtttttgcttttgcagtataagcacttcagcctgcaaatattggataattaccttggattttcaggtttctgtcaaagaaatatagtatcttttagtctttatcattctgtattgctaaatttaatcttatctttgtgctaagcttctgtgtgctcttttttttaattattattatactttaagttttaggatacatgtgcacaatgtgcaggttagttacatgtgtatacacgtgccatgctggtgtgctgcacccattaactcgtcatttagcatttggtatatctcctaatgctatccctcccccctcccccctctgtgtgctcttaaaatgagctcttatctaaacaaatctgtctactttaaaggactaaaaatgaaaaaaataaacttttcagaaccgaaaacaaagcaataaatctgaattatcagataatctgaagacagaaaaaatgacaaaagtcttatttagttgttaatatgatttacatatatttccaaaagcagagaaaaatatctatatataatctagatccctcaacaaaagagggaatagcaaaactttttttggaacttttttttttttgtttgtttgtttcgagacggagtctcgctctgtcgcccaggctggagtgcagtggcgcgatctcagctcactgccggctccgcctcccgggttcacgccattctcctgcctcagcctcccgagtagctgggactacaggcggccgccaccatgcctggctaatttttttgtacttttagtagagacggggtttcatcgtgttagccaggatggtctcgacctcctgacctcgtgatccaccctcctcggcctcccaaagtgctgggattacaggcttgagccaccgcgcccggccttttttcagaactttttaatgagtttttgaacccttggacatctgaaatttgcacactgtatgcacttgaaagaaggtttatggggaagctgggtggggtggctcatgcctgtaatcccaacactttgggagaccaaggcagtcagatcacgaggtttggtggtcgagaccatcctggctaacacggtgaaaccgcatctctactaaaaatacaaaaaattagccaggcgtggtggtgggcacctgtagtcccagatactcgggaggctgaggaaggagaatggcctgaacccgggaggcagggcttgcagtgagccgagatcgcgccactgcactccagcctggtcaaccgagcgagacactgtctcgaaaaataaaaaataaaaaataaattaaaaaaagaaggtttatggggaaaaaaaacccagaagataaaaagatattacataaaatccataaatactcaagaccaattaaacagaatagagagcccagaaataatgccaccttcctacaaccatcagattttttacaaagttgacaagaagaatgtgggaagatttttctctgtaataaatggtgctggaataatagctaacactatgtagaagacagaaacttgaccccttcgttgcaccacatacaaaaatcaactcaagataaaataaagacttaaatgaaaaacttaaaattataaagaaaccctgcaagataacctaggaaataccattcttgacacagaaacaggtaaagacttcatgatgaaactacaaaaaccaactgcaacaaaagcaaaaattgacaaatgggacctatttgaacttaagagcttcttcacaggaaaggaaactatgaatagagcaaacagacaacctacagagtaagagaaaatagttgcaaattttgcctcttacaaaggcctaatatacacaatttattaagaactgaaatgagtttagaagaaaaaaccaagaaacctcattaaaaagtaggcaaaaaatatgaacggatgcttttcaaaagacatacatgtggctaacaaacattatgaaaaaaaggtcactgctaatcattagagaaattaaaagaaaaacacaatgagaaaccacctcactcacacacgtcagaatggctatttttaaaaagtcaaaaaataacagatgctggcaaagttgcagagaaaaaggaatgcttatactctcctggtgggggtgtaaattagttcaacaacttaaaaagcagtgtggcgattcctcacagaactaaaaacagaattatcatctgatccaggagcctcaaaactgggtatatacccaaagaaatataaatgtttatattataaagacacatccacatgcatgttcactgcagcactattcacaatagcaaagacacggacaggccctgaatgcttatcagtggtagactggataaagaaaatataatatggtcagatgcggtggctcatgcctgtaatcccagcactttgggaggccacagcaggtggattgcctgagcttagaagttcgagaccaacctgggcaacatggcaaaatcctgtctccacggaaaatacaaaaagaaaaattggcaaggcatggtaacacacacgtttagtcccaaggttgaggctaaagtaagccaatatcatgccatggcactctggcctgggcaataaatgaaaccctgtctccaaaaataaaataaaataaaagatttagtaaaaacaaaatatggtacataaatatcatggaatactctgtagccattaaaaaataattatcatgtcctttgcaagaacatagatgaagctggagaccattattcttacaaaactaatgcaaagtctgggcgcggtggctcacaccggtaatcccagcactttgggaggcggaggcgggctaatcaccggaggttgggagattaagaccagactgatcaacgtggagaaaccccgtctttactaaaaatacaaaattagccaagcgtggtggtgcgtgcctgtaatctcagctacttggaaggttgaggcaggagaatcccttgatccccggaggtgaaagttgcggtgcgctgagatggcaccactgcactccagcctgagaaacaagagcaaaactctgtctcaaaaaaaccaaacaactgggccgggtgcggtggctcatgcctgtaattccagcagcttggggggccctgaggagggtggatcacgaggtcaggagatcgagaccatcctggctaacacggtgaaaccccgtctctactaaaagcacaaaaaattagccgggcgtggtggcgggcgcctgtagtcccagctactccggaggctgagggaggagaatggcgtgaacctgggaggcggagctttcagtgagcagagatcgcgccactgcactccagcctgggtgacagagcgagactcggtttcaaaaaaaaaggacaaaacagcacaacaacaacaaaaacagaaaactaatgcagaaacagaaaaccaaatgcatgctattatttttaagtaagagctaagtaataagaacacatgaacacaaaaaggagaacaatggacactgaggcctagttgagggtggagggtgggaggactcagaggatcagaaaacatacctgtttggtgctatgggtagtacctcagtgacaaaataatctgcacaccaaaccctcatgacataattttagctatataacaaacctacatgtgtacaccaaaccagaaataaaagctaaaagaaaaaaaaaaatccctgcgtgggagagtacaatgcaggtgtatgaactgattttggctacagatagtggcccaggtggaaatgtactctgattgatttcggtgtgcatgcaggcagatgagattaaacaggtggctcagaaccttagggtggtggagaaaacaggttgctgctgcagattcagtgtctgggggtggggatatgccaggagacttgtagagacttgtgggttcttggcaagaaacacctggatcaaaaatgccatggtggccaggtgccatggctcacccctgtaatcccagcactttgggaggccgagacagatggatcacctgaggtcaggagtttgaggacaggaattcaagaccagcatggtggaaggcgcctgtaaacccagttactcgggaggctgaggcaggaggatcacttgaactcaggaggcagaggttgcagtgagccaagatcgtgccactgcacaccagcctgggcaacaagagtgaaactctgtctcaaaaaaataaataaataaataaaaatacaaaaaattagccaggtgtggtggtacacacctgtagtcccagctactccggaggctggggcaggagaatcacttgaacctagtaggcagagattgtgtaatggcctaaggcgttcaccttgccctttgcctagacagagcccattcatcaatacaggagaatttgtggagaaaatattaaacgttaaatttcaactcaattgaacatggacacaaacaatggttaccaagtcctgggacaggttatgtgagccccttgaggcattcatccagcactatttttgagaaatctctgtttgaaatgcttgttccttggtgccataaagaaatagcacttgaacataaatttaatttactcagtaaggccatttttactttctgcagaaagggtacacttaccagcagttttgccatgagtgtacaccgaacaaaggagacagggtcacttataaccagatgcatcaactctactcctgtgttgttttcactggctgggactggacctcacattctgtatttgtctcgattggctagcaatgtagaactttttaaaagaggcaaacgcagaggagaacagaggaaggaggaagtaacttgtagaatgctgagaaaggtaaaaacaccttcaaataaggaagaggaacaggctatgacctaatgcttgcttggaccagtataaacatgccagagcaaatatttaggctaaacagtgggagctaagaacataaagtacattgatttctttattatggctagcagatatttaagaatattagcacaggtctttcaatacattttacttctaagagaagttactatttactcctaattagatggggaggaaagtctttgaagagaaacctctactttacttttacatctctattttaatctattcctctacgttagttattgaaaaacaatagacaattgcaaaaaaacaagttcacctatttgtgttcctggagcccattcacaaagggccctcgtgactgggcctcatgccaaacaagttgttacaaaaagagctagggccgcagactgccctagcttcaggagacctctcctcatctgtgcacggttgagtgtccgactctggagcccaggctatcacttcccggtgtggtggtgaatcctccatagtctgatgagtgtttttgtctgactctggagcccatactgttgcttcctggtctggtgaggaatcctccatagtctggtgagtgtaaacatacacacacacacacacacacacatatatacacacacatatatgtacatatacgtatatacatatatgtatatacgtatatgtatatatacatatatacgtatgtgcatatatacatatatacgtatatacgtatgtgcatatatacatatataggtatatatacatatatgtacatatacatatatacatatacatatatacatatatacatatatacataatacatatatacatatatacatatatacataatacatatatacatatatacatatacgtgtgtgtggtcatgtgtgtgtatatatgtgtgtgtgtgtgtatatatatcacttttcccttctcccctttccattgcaattttcttattatatcaatttgcttattatatctgcattgccatttacataagataaagcttctttacccttaaaggtattgtgtgtgtgtctttctttctcccctcatgagtttcctgaacagaacaccatatttttcagaggctttatttgtttcttattattcttttttccttaatcttgcctgcatgcctaattttgacaaggtgctattcaaactctgatatcctttcttctgcttggtgaattcggcttcaaatacttttgtatccttcatgaagcataaaacaaaaactaactgggcctttggccaggcatgatggctcaagcctgtaatcccagcactttgggaggtcatggtgggtggatcacgaggtcaggagtttaagaccagcctggccaagatagtgaaaccccatctctactaaaaatagaaaagttagccaggcatggtggtggaggcctgcgtcaggcctctgagcccaagctaagtcattgtatcccctgtgatttgcacgtatacatccagatggcctgaagcaagtgaagaatcacaaaagagaaaatggccggttcctgccttaactggtgacattatcttgtgaaattccttctcttcgttcagaggcttcccaactgagcaccttgttacccccgcccctgcccacaagagaaaaaccccctttgactgtaattttccactacccacccaaatcctataaaatggccccacccctatctccttttgctgactccattttcagacgcagcccacctgaacccaggtgattaaaaagctttattgctcacacaaagcctgtttggtggtctcttcacatggacgcatgtgaaagcctgtaatctcagatactcaggaggctgaggcagagaattgcttgaacctgggaggcggaggttgcagtgagccgagatcgtaccactgcactccagactgggcaaaagaatgagactctgtctcaaaaaaacaaaacaaaacaaaaacagaatacagaagatctttcttccattttgactgtagaaaatgaatgtatttccactggaaaatgtggtagataattgatgagtaacatagattcgtcaaactatccgtttctctttttgcagggtaaatttgtgacagtgactatctcggttctgtatcttgtcttgatttcttagtttaatgctaaattatatgtggtgaaacgtggtactgttagatatgagttctaaatgtcttttcaaagagtcaatatgtcagtatgttcaattctttgccttctacttataaacttaacttcctcgtaaagcaaactttttcaattacctgctccacctgactcatttcaatcacctgctccaacctgactcattcccattacctgctacctgctctgccctgactcattttttccccacataaccattttttttcccgccaaaccactcacccaatcactgtctttaaattagctaagtggaattagtttagcctatgcagtctaaccctagccaataggggaacgacacagcaacaggggccatgcgcgtcagggataagaacccctttccctcccttgtccaggtgtgcactcaccattgctccatttgtaaaggcacacccttctatagaattaccttgccttgctgagaattaaaaagaaaattttatattcgagtgctatttcttttgcggcacagaaattttatttataacaatttgggggttcgcttgtgattacattcccctccaggggtggtctctggttctctctcatgaggaggtttgccctgcccccttgtggtggcctcaggggtgagaaatccagacccactcagtgggaaaaataaccggagctctcagcaacgaggggaaaaaaaaactggccagtaacctagcttaaaggatcctcatatactgtggcaacaactctgtgcacagacccaggaaggagaagctgcgggagccagaaaagtacttcattggtggtcaaattctggagagctaaatgtgtttgtgcgtgattgatcacaaacaaccctgcttgcgatgttgttcgtgtggatggtgacaagtcctactgctgaatggagtgagtgggtcctctctgtggttccgtagctacctcatatgacttagggtggatcctgccatgagatttattctgacatgccaacactaagaggggcctaattctcccttgggggagcagccagagagaacaacacgaatgggaagtgcgcaaggaaagagggggaaagggaggaaacaggttaactttctgggacaggcaaggagagacatttctggtgtcaggggttgagacttccgggacaggcaaggtgagacagccctggtttgaggggttgaggcttctgctaatttcaagggttgaacctcacacaacccccctttccttttatcttgggggaagaaagagtagctccactcccgctggtccctcccctaggggaaggagaaggagaggacagaacagcagcataagcatctgggagaggcacggaaagaccagaagagagatgagacagagagaaagacagaggggaaagagagagaaagagaggcagagagagagagaggaagagacagagacaaagagggagtcagagagagagacagaaagtcaaagagagaaagaaagaagtagtaaagaaaaaacagtgtaccctatttctttaaaagccagggtaaatttaaagcctataattgataattgaaggtcttctccgtgactctataacactctaataccaccttgttgtcagtgtaaacaagggcgcagcccgaaagcactgaggtcactgacaacctgtagccttcctatcaaaaatccttaacccagaaacctgtggatgaaggtaattcattcaatctgtagtgacaactgctttgcccgtaatgcccaaccttgtttttactaaccctgtttttagactccccctttttctcccttaatcacctagccttgtttccacatgaataaaaccctccctgggccaggtgcggtggctcacgcctgcaatcccagcactttgggaggcctaggtgggcggatcacgaggtcaggagatcgagaccatcctggctaacatggtgaaaccccgtctctactaaaaatacaaaaaattagccaggcgtggtggtgggcacttgtagtcccagctactggggaggctgaggcaggagaatggcatgaacccgggaggtggagcttgcagtgagccgagatcacaccactgcactccagcctgggcaacagagccagactccgtctcaaacaaacaaacaaacaaaccaaaaactctcccttagctgagaaagctagacaaactccatctggcccccttgatttataagacgttaaggactccttacccacccccttcttcaaggagttaacttgtgtaaacagattctcaacatatcaaaagagtccaattaactgataaggtactgaaacaaacaatgtatgaagttcccaggatcttgctcaaaagataacaccacaaagccttgagtctgtgtccggcatagcacccatatctaacatcttatgaaggatttagagcccccgcacctgctaccgttgcttttctgtaaacatttgtcttttaaattgtctgtttctctgtaatcatttgtccttttaatttttgcatgtttttacttctgtagaattgttgcatttgagctcccctccccttcctaaaccaaagtataaaagaaaatcaagccccctcctcatggccgagagaattttgagtgttagtcatctctttggccacaggctaaataaaggactcttaattcatctcaaagtgtggcgtttttctaactcgctcgggtataacatttggaggccccagcgagatatattccccaccgggtgagagccgggctttctccaggctcccccagacagatggctggcttattggggggtgccacctgaaaaatttttccaggtccgttaaaagtgaccatcttccggaggagagcagattgactaccgtgtgtttgcccacaaaattccacctctgagtcctcaacttctgaccctggggtcaggtaagtcaggcttgactttgccctggactcagtccatatcccaggtgctgggggactgagtcctggtttctggcaggccagtctctctctctctctctctgtctttctctctctgtctcattaaagactagtctcactctctgctctctttctcactctcactctccctctccctttttctatttctcatccttctcttgttcaggtttcttggagatctccgggaaaaaaaaaacaaacaaaactgttataaactctgtgtgaatggtgagtgattgggtgattgtggaagacaagggcttgtgcttgtcttccagtttgtagctccatggcgaaagctacacagcttgagtgggccctcacctgtggttccatggtgacctcgtaaggcttaagaggcatagcttgatctgagccgggggtttataccagcctgccagtactaagaggagcccaagtcccccaagggggagtggccaggtgggcatctgaatgatcccatcatgggaccccctccccttgtctgtctaataaaaactgtcataattgtttacatgccctagggccaattttttgttttatatttattgctctgctcagtgtctattgtcttgttcagtggttgtcaaagttttgtatgtcatgtcattgatattgcccaagacatctgggtaagaacttcttcaaggtccttagtgttgattttttatcacaggaggttaaatttctcatcaatcatttaggctggccacaacagtcctgccttttctgtcagaaacaagtgaggtgttgttacggaaacgagtgtggagaacattcgcctgattgggatttctggcagcgtgaaggttgctggtatttagattgtcataccctacatccaagagctgggctgcctctaggttaaactggtggtgggttgaaaatagccaccctgcagatttccttgcttacctcttttgtcatactgtaacttttcccatgcccttaaataggacactgtgtagggaaacctacacctgtactgctttacttcatttagatccttactctgttcctctgtggctactctcccaccttaaaaatgatccgagtggcctcatccctgccccttaccctgtacatctcattttccagtgccacagcaagttcagcatctccaggacttggctctgctctcactccttaaacccttacagaaaaaggctgagtttgagctatttgcctttgagtcatggagacaccaaaagtatttagggtacaggtccagaggaagagggagaacgcctagatccaactgacccaggagacctcagggcagcctctagtccccctccctcaatcttaaagctactgtaatgtggcaagtggtattagctgttgtggtttttctgctctttctggttatgttgattctgttctttcagtactccagccccctagggagtgagtttctctgtacatgctgggtttaatatctattctcaaatcttaataaattgccttcaaaaaaaaaaaaaaaaaaagagggaaactccttctctggccttgtaagtgttggagccctctccaatgtatgccacagaatttttctctcggtttctcagaggattatggagtctgccttaaaaaaggcaagctccggacactctgtgaagtagaatggccaaagtttggagtcgggtggccccgtgtagggtcactgaaactcacaattgtccaggctgtgtggcaggttgttactgaaactcccagccaccccgatcagtttccctacattgatcaatggctgagtttggtcaggagcccccctccatgggtgcgctcatgcaccattcataattctacctccaaggtcattctgagccagaccgcattttcacctcgaccctcagccagtctgacttccctgtactgcctccctctgaagaagaggagagtctccctcacccagtcccgctgccttacaaccagcctgctcccatagaatcatcctttgtctcctcaactacttcccctgtaggctcaccgcctattgcttcttgactgtgaccacggtaggaggaagtagcccctctactaccactgagagaggcacaagtccctctgggtgatgagcgctcatctcccttcttggtttatgtccctttttctacttctgacttgtttaattggaaaacccataatcctcccttctctgaaaagccccaggttttgacctctctgatggagtccgtactccggactcaccggcccatctgggatgattgtcaaaagctccttttaacccttttcacctctgaagtgagggaaggtatctgaagagaggccaaaaagtacttcctcacatcagccaataggccagaggaggaagctagagacctccttgaggaggtctttccctctacccggcctaattgggacccaaattcctcaagtggaaggagagctttggatgatttccagtggtatatcctcgtgattattaagggagctgttcagaaacccataaacttgtctaagatgactgaagttgtccaggggcctgatgagtcaccaggagcatttttagaacgcctccaggaggcttatcagatttacaccccttttgccccggcggctcctgaaaatagccgtgctcttaatttggcatttgtggctcaggcagccccagatgttaaaagaaaactgcaaaaactggagggatttgctggaatgcatatcagtcagcttttagaaatagcccaaaaggtttttgacaactgagagtttgaaaaacaaaaacaagcaacataggcatctgaaaaaggtgctgataaagtattcaaaagacaagcaaaaatcttagtgatggctatccaagaggggaaaaagaaaaggcccccatcacagagaaatggccagggaaccttgggttcccaccataaaggtaaaggagttgaacaggctcctctaggaaaggaccaatgtgcttattgcaagcagactggcagtggaaaaaggaatgcccactacgaccagaagaaaaatcagaaaagaaaaagtcctcaccctacctgtaatggaagagcctgatgactgaaggggccagggctccctcactgttggctcccaggaacccatggtaactgctacagtggggggccagcctgtacgcttcctagtagataccagggtggagcactcggtactgtagacccccttgggcagtgtctcaaataaaagtgactgtacaagtcactggagcaactggagctattcaagaagatcctgtcacacactcatgagaagtgagcttgggacagaaaagagtgacgcagtcatttcttgtggttccagagtgtccttttcctctccttggatgagacctgctccataagttacaggcctcaatctctttctcagctcaataggctcacctcacactaggaaatacagctccctccactgcccaatttctgctaagtacccctctgtcggaggaatagcttttagtttcaccatcacaatcaccggaggagaataataatcctcttcttttggacttacagacactttttccctgagtttgggccgagccaaaccctccaggactggctaaacaccattcaccagtggttgtagaactcctggccactgtcatgccagtccaggtgaaataataccccatgagtcagggggcaagacaggggattaatccccatatttaatgactgttacaagctggcatacttacaccatgtcagtctgcttggaatgctccattattgccagtccagaaacctggaacaaatgattactggctggtacaggacttaagggaagttaacaaatggactgttactgtccatccaaccgtccctaatccttatactctacttagcctgctctcaccagaacatacagtatacactgtccttgacctaaaggatgctttttttgctattcctctggaccccaaaagccagccgatctttgcatttgaatgggcagatcctagctcagggaacactacccaactgactttgactcagttacctcagggttttaaaaactcccccaccctttttggggaggctctccagcaagatcttgtaccattccgagctagtcaccctaactgtactcttcttcagtacgttgatgatcttttattagctactggaactatggacagttgcctgcaacatatgagagacctactttacctccttcaggagctcaggtatcaagtctccaccaaaaaggcccagctctgtcttcccagagtgtcttacttgggatacgagataaaccaaggaaaaagggcactcaccagtgcccagaaagaagccatcctatgaatccccgctcccaccaccaagagacaggtacatgaattcctgggggccatgggatactgctgcctctggatattggggtccacagagattgccaagcccctgtacactgctacaggaagaaacggcccactggtttggacagacaccgaagaacaggcttttcaaaacctgaaaaaggcattaactgaagcccctgctttagccctcccaaatatctcaaagcattttcacctgtttgtccatgaaagccagggagtttctaaaggggtgcttactcagactttaggaccctggagatgcccagtggcctatttatctaagaggctggatcctgtggcctctggatggccaagttgtctgcaagccatagtggctagagcaatactagtccaagaggctgataagttaactctgggccaaaatttaacccttatggctcctcatcccatagagactttactatgaagtgctcctggcaaatggatgtcaaatgctcacatcttgcagtatcagagtttactgttagatcagccttgtttgactttctcccccacaaggtgtttaaatccagctacactactccctgatccagactccactactcctgttcatgactgtcaggatctgttggaaactaccaaaactggccaacctgatcttcaagatgtgcccctagaaaaggcagatgccactgtgttcacagatggtagcagcttcctcgagcagggagaacgaaaagctggtgcagctgttaccatggagacagacatgttgtgggcttaggctttaccagcgaacacctcagcacaaaaagctgaattgattgccctcactcaggctctccaatggggtaagaataaacgtattaacatttacactgacagcaggtatgcctttgctactgtacatgtacatggagccatctaccaggagtgcaggctactcacctcagcaggaaagactcaaaaacaaagaagaaattctagccctgcttgaagccgtatggctccctcagcaggtggctgtaatccactgcaaaggacatcaaaaagaaaacacggccattgcccgtggtaaccagagagctgattcagcagctcaggacacagcatgactttcaggcacacctctaaacttgctacccgcagtttcttttccacagccagatctgcctgacaatcccacatactcaacagaagaagaaaaactggcttcagatgttggagcaaataaaaatcaggaaggttggtggattcttcctgactctagagtcttcatatccagaactcttaggaaaagtttaatcagccacctacattctaccacccatttaggaggagcaaaactagcccagctcctctggagcctttttaagatcccccatcttcaaagcctaacagatcaaacagctttccagagcacaacctgcacccaggtaaatgccaagcaaggtcctaaacccagcccaggccaccatctctgaggaaactcaccaggaggaaaatgggaaattgactttacagaagtaaaaccacaccgggccgggtacaaatactttctagtactaatagacaccgtctctggatggactgaggcatttgctacaaaaaaagaaactgcctgcatggtagttaagtttttactcaatgaaatcatccctcgatatgggctgcctgctgcaatagggtctgataatggaccggctttcacctcatccatagctcagtcagtcagcaaggcattaaatattcaatggaagctccattgtgcctatcgaccccagagctctgggcagatagaacacatgaactgaaccctaaatacactcttacaaaattaatcttagaaacctgtgaaaattgggtaagtctccttcctttagctctacttagagtaaggtgcaccccttaccaggctgggttctcaccttttgaaatcatgtatgggagagtgccgcctatcttgcctaagctaaaggatgcccatttggcagaaatatcacaagctaatttattgcagtacttacaatctctccaacaggtacaagatatcatcttgccacttgtttgaggagctcattccaatccagttcctgaccagacggggccctgccattcgttccagccaggagacctagtgtttgttaaaaagttccagaaagaaggactcactcctgcttggaagggacctcacaccatcatcctcacgacgccaacggttctgaaggtggatggaattcctgcttggattcatcactcccacaacaaaaaggccaacagagcccaactagaaacatgggtcccgaagcctgggtcaggccccttaaaactgcgcctaagccgggtgaagccattagattaattctttttatttacctctcttgtttctttttgcctgttatgtcctctgagccttcctactcctttctcctcacctctttcacaacaggacgtgtattcgcaaacactacttggagggccggtacctccaaggaagtctcctttgcagttgatttatgtgtactgttcccagagccagctcgtacccatgaagagcaacataatttgccggtcataggagcaggaagtgtcgaccttgcagcaggatttggacactctgggagccaaactggatgtggaagctccaaaggtgcagaaaaagggctccaaaatgttgacttttacctctgtcctggaaatcaccctgacgctagctgtagagatacttaccagtttttctgccctgattggacatgtgtaactttagccacctactctgggggatcaactagatcttcaactctttccataagtcgtgttcctcatcctaaattatgtactagaaaaaattgtaatcctcttactataactgtccatgaccctaatgcagctcaatggtattatggcatgtcatggggattaagactttatatcccaggatttgatgttgggactatgttcaccatccaaaagaaaatcttggtctcatggagctcccccaagccaatcgggcctttaactgatctaggtgaccctatattccagaaacaccctgacaaagttgatttaactgttcctctgccattcttagttcctagaccccagctacaacaacaacatcttcaacccagcctaatgtctatactaggtggagtacaccatctccttaacctcacccagcctaaactagcccaagattgttggctatgtttaaaagcaaaacccccttattatgtaggattaggagtagaagccacacttaaacgtggccctctatcttgtcatacacgaccccgtgctctcacaataggagatgtgtctggaaatgcttcctgtctgattagtaccgggtataacttatctgcttctccttttcaggctacttgtaatcagtccctgcttacttccataagcacctcagtctcttaccaagcacccaacaatacctggttggcctgcacctcaggtctcactcgctgcattaatggaactgaaccaggacctctcctgtgcgtgttagttcatgtacttccccaggtatatgtgtacagtggaccagaaggacgacaactcatcgctccccctgagttacatcccaggttgcaccaagctgtcccacttctggttcccctattggctggtcttagcatagctggatcagcagccattggtacggctgccctggttcaaggagaaactggactaatatccctgtctcaacaggtggatgctgattttagtaacctccagtctgccatagatatactacattcccaggtagagtctctggctgaagtagttcttcaaaactgccgatgcttagatctgctattcctctctcaaggaggtttatgtgcagctctaggagaaagttgttgcttctatgccaatcaatctggagtcataaaaggtacagtaaaaaaagttcgagaaaatctagataggcaccaacaagaacgagaaaataacatcccctggtatcaaagcatgtttaactggaacccatggctaactactttaatcactgggttagctggacctctcctcatcctactattaagtttaatttttgggccttgtatattaaattcgtttcttaattttataaaacaacgcatagcttctgtcaaacttacgtatcttaagactcaatatgacacccttgttaataactgaggaatcaacaatttgattccccgaaaacatgggtggtgaatgtaatgcccaacattgtttttactaaccctgtttttagactctcccttttgctctcttaatcacctagccttgtttccacatgactaaaactctcgcttagctgagaaagccggacgaactccatctggcccccttgatttgtaagacattaaggactccttacccacccccttcttcaaggagttaacttgtgtaaacagattctcaacatatcaaaagagtccaattaactgataaggtactgaaacaaacaatgtacgaagttcccaggattttgctcaaaagataacaccacaaagccttgagtctgtgtccggcatagcacccatatctaacatcttatgaaggatttagagcccccgcacctgctaccgttgcttttctgtaaacatttgtcttttaaattgtctgtttctctgtaatcatttgtccttttaatttttgcatgtttttacttctgtagaattgttgcgtttgagctcccctccccttcctaaaccaaagtataaaagaaaatcaagccccctcctcatggccgagagaattttgagcgttagcggtctctttggccaccggctaaataaaggactcttaattcatcccaaagtgtggcgttttcctaccttgctcgggtataacatgctaacagaagagagtatgagattattctgttaaaaaaatgatttatcattaaccaccgtaaatccccttaacccagcaggtttcccaacagggagtctaaaccttaattaccatagaaaagtctgaccagacctaggaggaactcccttcaggacaagatgatagatggttcctcctgggtgattgagggaaaaaggcacaatgggtattcagtaactgataaggaaactcttgtagaagcagagttaggaaaattgcctaataattggtctgctcaaacgtgggagttgtttgcatccagccaagccttaaagtacttacagaatgaggaaggagtcatctataccaattccaagttaatacggactgaacaaggtcttattaatagcaaataataattgaaatcccaaattgacaaggttttcaacaaaagtaaagtttgctgaaagttaacagtgttaacatgtattatcctaacttctaatcttgtggccttaaacagtctagtccacagacaggaaggaagttcgcattggagaagaatggttatcatctttgaaagaaaaaaaagggggggaggagaatttatgtaaaaagggatgttatatggtaaattcttgttctaaaataaattaactgtttgcttaaagaaagggatgtttgcaacaagtcagaaagttgaggcatgtgaagaattatttttgaaagccttgaaaaatgttataaagggaatttatgcaggaaatgttttataatttaaaagtaattaggcgtcctgaatgtaaaactattgaagaaacaatttacttgcaaggtgtgtaaggaaagtaaaatatacttttggtaaaaggattataaggaggcataagaatgtggatttttacctacacttaaaggttaaaaaaatttattttaaaggtctcagcaagttttgaaacattaattgtaaagaaaattctgtgtgtaaacatatgagctaaagttaaaggggtatcatccagtttttctgtgaactggacattaaaataaaagcacaacaggtttttcttaacttgctctttaacaaactttaacaactaacttgctctctaacaaaaattataaaaggttaaaaagagtctataaaaatcttaccttatggtcagacattaaaagttggataaatatgtctacaaggttttattaaagttaagtttaatattaataacactaaatttagcttatctcatataaaaatcatatgggaagcattttaaaatataaaatggtgtttgactttctttggtctgaaatctaataaaaataggtactaaagaaaatttctcaacaagaacgcaccaaggactataaagtccactgttgaggtccccacatttaaaacaaaagatcgatttcttagaaatcttatactaagcgtatcttccactttactttccctcaaaactaaaagtcttttagcacaggtaccacccctagaatttctggtaaaccagcaccagccttgggatcacgttctcatcaaagggtgaaaagaaggaaaactcaagtcagcctgggaaggaccctatcttgtgctgctaactgaggctgctgttcatactgcagaagggggatgcacacatcacacctgagtcaagcaagcgccattatcatcagaatcatgggccattgttcctggatcaagccctaccaaattaaagctaagaaaagctcagtctagctatactttcctttcctttcttaacccagtgcttatattcattactattcctaccactatcaactctaaccccactttagagcacttctatgatttaggagcagaggtcactggaaaggatcctatacgattctttaagatgcgcatttttctccctcctccacctcctacatctgccctgttcccaaacctatgacaccaaactatgcctcacctcatgccaaatgacaaaagcaagctctcggtagtagaaataggagatctgaggcaaaccatagccattgaaacaggatataaagatgtaaatgcctggataaaatggattaaagattccattcacgctttaaacagaagtggctgttatgcttatgcggatggtaggccagaggcccgggctgggcctttccactggggtggtcctcaaatcaagtggacacggagtgcatgaccgctgtttttcaagattccactgcctggaataacgaatcatgccaagctttctctgctatttcctgaagtccaacaccctgtgggtcagcccctgagcgccatccagcctccatcttccaaaaccaattttacatcgtgtctccaatgacaagggaaaaaatttggcattccgtggaaactttacaggatgcagtgaagtccggcatttcctagagctgacccattagtctgctcttattcatccctgagtggatgtatggtagtattatggaggacctttactggacactctgccagataattaagagcagtacttatgctctagttcaattggctatcccttttactctggcatttcctcaaccagaggaaggaaaaataagatatcataaagtgagagaagctccttatgggtcttttgactctcaagtctatttaaacgcaattggagtcccacgggaagtaccagatcaatttaaagcccaaaatcaggccgggcacggtggctcacgcctgtaatcccagcactttgggaggccgaggcaggcggatcacgaggtcaggagatcgagaccatcctggctaacacggtgaaaccccgtctctactaaaaatacaaaaaattagctgggcgttgtcgtcggcgcctgtagtcccagctactggggaggctgaggcaggaaaatggcatgaacccaggaggtggagctttcagtgagccgagatcgtgccactgcactccagcctgggcaacagagcgagactccatcttgaaaaaaaaaaaaaaagcccaaaatcaaatagctgcaagatttgagtcaatattttggtgggtggcaattaataaatgtagattggataaactacatctattacaaccaacagcgatttattaactgcactagaaatgctgttaaaggaatagctgagcaattagggcctattagccagacggcttgggaaaaatagaatagccttagacataatattaacatacagagaaggagtttgcatcatgattaaaactcaatgttgtaccttcatcccagacaacactgcccctgatggaaatacaacaaaggcattgcaaggtctgactgctctgtccaatgagttagccaacaattcaagtgtaaatgacccctttacaagatggctagaaaagtggttcagtaaatggaaaaaaataatagcctaaattcttacttcccttgcagacgtaatgggtatacttcatcttgtcaggtgctgtgtcacaccatgactccgtgagttggtgcagaggcttataaaaacagcacttactaaaacctcccttaattatccaccaccttatccatagaagcttcttttggaaaatcaagcagaacaactaagccaagacatgttaaaaaaaatttgaaaagaaagggctgtaaggaaatgcaagaggaggggttgttagatatgacttctaaatttcttctcaaagaatcaatatgtcagtatgttcaattctttgccttctacttttaagcttaacttcctcataaagcaacctttttcaattacctgctccaccctgactcattcccattacctgctacctgctctgctctgactcattctccacccggcataaccactttttcctaccaaaccacttaccccgtcactctctttaaattagccaatcggaatgagtttagcctgtctggtctaaccctagccaataggggaaagacacagcagcagggtccacgtgcatcaaagataagaacccctttacctcccttgtccgggtatgcgctcaccattgctccatctgtaagggtgcacccttctatagaagtacctcggcttgctgagaattaaaaagaaaatgttatatttgagtgctatttctttagccgcaccgaaactttataacagtaccttctacacgtgttcccatgtgactaatcttttactgcataatttttaatagaaataataaaataatacatatattgtctgaaaaaagtagatatatttgcttttcttatggaggtgtaaaatgcaagcaacttagccaggtactgtggctcatgcctgtaatcccagcagtctgggaggccaatgcaggttgatcacttgaggtcaggagttcaagactattaggcctctgagcccaagctaagccgtcatatcccctgtgtcccacacatatacatccagatggcctgaagcaagtgaagaatcacaaaagaagtgaaaacagccagttcctgccttaactgatgacattccaccaatttgtgacctggaggggcattctcagtacacttttgagtagaaatgttcaggaagcaggatagtagcctgctgggaacattagtaagaggggctgcaaagaagataatcaaaatattgaataaggtggggtcaggagtttgagaccagtctggtcaacaaggtgaaacactgtgtctactaaaaatacaaaaattagctggtggtcatggtgggtgcctgcaatcccagattctcaggaggctgaggtgggagaactgcttgaacctgagaggcggagattgcagtgagccgagatggcaccactgcactgcagagatggcaccactgcactgcagcctgggcgacagagtgagactccatctcaaaaataataataatttattttggccactgaagacaaactcagctgattgttttaatgagaataaggagaaaatatgcagagtgtgtatctggcattgtgataagtaagaaaagagagcattatctaagtcgtaatgggaagagtgtttctttccacaaactgttactggagcacacaaaggatgtagaattttattaatcgcaaatattttttatgattttgtgtttcatctttccccatctcttttctttgttctatgcatttcttccatttggcttttcctgggctgcattttatatatatgaaaccggtaaacgtaactacagtgttttgctgagttctgtgagtagctctacccaattattcaacttcagggaggttatgggagtccccagtttttaagcagcagctcagaagcatagatgggcccatggggtttgtgactggcatctgcagtgaggacaatgttgtggaactgagccctgaatcagggtctgtgctgactctgggtggtgtcagatttcaaatgttagacaatgagttggtgttggagaattatttgatgttcagcaaactacagatttggtgccagaaaaaagatatcatggagccctggcctggaataaaattctgggtgtttgggaatgggactgaaaacttagaggaaaggagcgctgatgacagacccccttttcttgcagctgttaccacaggattcccacccactcacaaacacacacactagacattgacatgtccacactcctcccaggactaggcaccaccctcaggaacttcaccacggcatttttgatccaagagtttcttgccaagaacccacaagtctctacaaatctggcatatccccctccctggacaccgaatctgcagcagcaacctgttttctccaccaacctagggttctggacctgcttttcacaatctcgtctgcctgcattcacacagaaataaatcagagtacagccccactgggccactatctgtagcgaaaatcagtccacttacctacattgcaatctccccgacccaggaattttttttcttttagctcttatttttggtttggggtacacatgtgggtttgttacacagctatgtcatggggtttggtgtgcagattattttgtccctgagttactacctgtagcaccaaacaggtatgttttctgatcctctgagtcgtcccatactccaccctcaactaggcctcagtgtctgtttctctctctctcttttttttatttttatttttgagaccgagtctcgtactctttcccaggctggagtgcagtggtgccatttcagctcactgcaagctctgcctcctgggttcacaccattatcctgctgcctcagcctcctgagtagctgggactacaggcgccctccaccatgcctggctaattttttgtatttttaatacagacaggatttcactgcgttagccaggatggtctctatctcttgaccttgtgatctgcccgccttggcctcccaaagtgctgggattacagacatgagccactgtgtctggcctgttctcctctttgtgttcatgtgttcttattatttagctcttacttataaataataacatgcatttggctttctgtttctgcattagttttcttttttttgttttgttttgtttttttgagaaggagttttgatcttgttgtttaagctggagtgcaatggtatgatctcgactcactgcaaacttcgtttcctgggttccaacaattctcctgcctcagcctcctgagtagctgaaattacaggagggcgccaccactcctagctaattttgtatttttagtagagacacagtttctctatgtcggtcgggctaatctcaaactcctgacctcaggtgatccgcccaaatcgacctcttgaagtgctgggattatgggcctgagccatcgcctggcctctgcgttagttttctaagaatgttggtctccaccttcatcaatgttattgcaaaggacatggtcattttttgtgtgtgtgtgtggccacccagtattccatgatgtttcgtttttactaaattttgtttagtaaatttttgtttttactaaattttttattttatttttggagacaagcttattgcccaggctagagtgccaaggcatgatattggcttactttagcctcaacttcccaggctcaagcaattctctcctacctcatcctcccaagaagctaggactacacacaggcattaccaagcctggccaatttttctttttgcactttccgtggagacaggattttgccatgtttcccaggctggtctcaaacttctaagctcaggcaattcacttgcctccgcctcccaaagtgctgggattacaggcataagccaccgcatatgaccataccatattaccatattttctttattcagtctaccatcgataggcatttagggcctgtccttatctttgctagtgtgaatagtgctgcagtgaacatacatgtggatgtgtctttataatataataatttatatttctttgggtatatacccaatgatgagatccctgggtcaaatgataattctgcttttagttctgtgaggaatcaacacactgctttttacagttgttaaactatttacactcccaccagcagagtataagcattcttttttcgctgcaacctttgtcggcatttgttatttttttgaaattttataaatagccattctgttggatgcgatgtggtatctcattgtggtttttcttttaatttctctaatgattagcgatgagcatttttttcacacgattgttagccacatgtttgtcatcttttgaaaagaatctcttcaagttttgtgatgttactttttaatgaggttttttttttttttttgtaaacttgtttaagttcttggtttttttttttttttttttttttgtcttttgtttttgagatggagtttcactcttgttgcccaggctggtgtgcaatggcccaatcttggctcaccgcaacctccacctcctgggttcaagagattctcctgcctcagcctcccaagtaggtgggattacaggcatgcagcaccacgccctgctaattttgtatttttagtagagatggggtttctccatgttggtcaggctggtctcaaactcccggcctcaggtgatctgcccacctcagcctcccaaaatgctgggattacaggggtgagccactgcacctggcctaagttcttaataaattctggatattagacctttgttagagaaaaagtttgcaaattatttttattctgtaggttgtctctttactctgttgatagtttcctttgctgtgaagaagctctttagtttaaataggtcccatttgtcaatttttgcttttgtggcaattgctttttgtagattcatcatgaaggctttgtgagtttctatgtctagaatggtattacctaggttatcttgcagggtttcttataattctaagttttacatttaagtgtttaattcatcttgaattcatttttgtacatggtgtaatgaaggggtccaatttcagtcttctacatagtgctaggtaattattccagcaccatttatgaaatagagaattgttcccacattcctcttgtcagctttggcaaaaatctgttggttgtaagagggtggcattatttctgggctctctattctgttgccttggccttgtgcacttatggatttttttataacatctttctgtcttctgtttttttcccccataaaccttctttcaagtgcatatagtgtgcaaatttcagatgtcccagagttcaaaaaatttttaaagttcaaaaaaaattttgctttttctcttttcttaggtatttagattatatgtagatgtttttctctgcttttttgaaatatatgtaaatcatattaacagctaaataaaccttttgtcattttttctcactccagattttctttatctagtacttcagatttattgctttatttttggttctgagggtttatttttttcatttttagtcctctaaagtagacacagatttgtttagataaaagcgcttttcaagagcgcacagaagcttagcacaaagataggattaagttttgtaatacagaatgataaagactgaaagatgctaagtttctttgacagagacctgatgatccaaggaaattatctaatatttgcaggctgaagtacttatactgcaaaagcaagaacagttcagtgtataaactgaagagtggagtctgtagttgtaccttgctttctatttattacttcagaacaattagcatagttatgtgtagtgtttgtagacaagctgcatccatataaattaaacagtattttctttttttaaattatactttaagttctagggtacatgtgcacaacgtgcacgtttgttacatacgtatatatgtgccatgttggtgagctgcacctattaactcgtcatttacattaggtatatctcctaatgctttccctcccccctccccccaagtattttctttttttgagacagagtctcactctgtttcccaggctggagtgcagtggcattatctcagctcactgcaaccgctgtctcccgggttcaagcgattctcctgttttagcctcctgggtagctgggattacaggcgcgcatgaccacgtgtggctatgtttttgtatttttagtagagacggggtctcaccacgttggccagcttgatcttgaactcctgacctcaggtaatccatccaactcactcttccaaaatgctgggattataggtgtgagccataaacagtattttctaaaattgtatgaatgtaaagctgcaatgctgacttcgaatgaatcactttaattgttagtttaatattgttatttatacttttgaaatataaagtgttttaattgaagtatagttgctatttagttatttagagacagagtctcactctttcacccaggctggagtgcactggcttgatctcagctcactgcaatctctgcctcctgggttcaagcaattcttctgtctcagcctcctgggtagctgggatgacaggcacactccacgatgcctgatttttttttttttttgtatttttagtagagatggtgattcaccatattggccaggctggtcttgaactcctgacctcgtgatctgcatgcttcagcctcacaaagtgctgggattacaggcgtgagacaccactcctggctatagttgcaatttaaaaaatgctgcatacattaagactagtttattaaaattattcatacttagatatttatatgtaatatctaaagaaaatttactaccaagttgttacagtagatattaggcttacatgtttattactttattctatagggataattatgagtaaacacaattttagtatattttatttcactaaattggtatgctgctattacaggacaatgaagacaggtgatgtggccacccaaaattcgtaatagctcttcagttacctatgttgcaagttctaatgtgttccactatatgaacacagtcagattctatttcttcatcaaaaagtattgttggaagttgtcagatgtatttcaatatagaacctccattcaatggctaggagaggagagagcagcagagatggaacaaaaacttgataaaattcatctgaaattctgccccctttcttcataatgctcatgtttctcatgctgagagtaattgtgcactttcggtggttagagagaaattgcttttaggggactattttctggctgacttgatcaatcttacatctaatctgaactttttcttaagatctttttaactttttttcctcaaaataatcttgctcagatcaagatctgtttttctctccaatgcttttgtgtttgtttcaaaagccctattcatatctcatggtgtctgaatgaggggagcttctctatatggactctatatagagtccatctctatatggactcatttggaaattcagcagtattttttccacatcaccattataaatagaaatggaggctgaaacactgctcacattcccatgattgtgaaggtgcaattctacccaggaggcctgcgtgctctcctcctgcagctcaggccttgttctctgatgtgacactagagtgctgctgtggtgaatggtgttcatataaattgtgagctgtgctctgggttgtgcctcagtggcagatggtagaggtcaagagaggacactagcaaccaggagaaagcatccagtgccaaggagtacagagccacttcttttaaatgggaaaagtttatttgtattgaatataaggaattagcatacagagatggcctctttagtctacttgtgaagtaattatggtgactatctttctgttgttgcagcctcttaagcagattgatgatgatgcatgtcacattcaagttcacttgtgtaataaaactgttttctttctgttctattactgtagagtttctctagggcttgagaaaatttttctttttctttctttctttttttttttgagacggagtctcactctgtcacccaggctgttagtgcagtggcatgatctcggctcactgcaacccctgccctctgagttcaagtaattctcctgcctctgtctccctagtagctaagattactgtcgcctgccaccgcgcctggctaattttttgtatttttagtacagacggagtttcactacattggccaggctgctcttgaactcctgacctcgtgatccacctgcctcagcctcccaaagtgctgggattacaggcatgagcaaccgcacctggccaaaaatttttcttttaattattgtttccaaacactgtctagaattaccagacatgatataaatgcataaggtgccaaccaggattttctctagagaagactttttctctcaggcttccagtcaactcacacgtgtgttgcaaagtgcatgctgtcccctaaatatgcaggcagaattgtgtctctgcctatttggaatctatagtcctctacagtcacttccagagaggctagaccacatttctacaaacttcacaggggagcaattaaccattttacctctttcaatgactcgtgtatcttcagacgtgacactgatatagaaactatatagaccagaaacccaatcagaataacatgtgtgcactgtgtagacatagagacgtgagaatctccgtgttccccttcctcctcttgctaaagtgctcacaaatgtgcaggtaacacctgctgctactccagccattcaggcctaaatctgtagctccacattttgaatccaggtcgtgagatttgggaaataaaaaacttttatctaaaaaattcaagtccttttggttaccaaactcagagagacattaaaataaaagtgcagttatttctcccctctttgaactatgtattcatctcttgaaactgttcactattggcacaagtacctataagttaaactaataatgccacattggacagtatatcccataccctaaaccataacgatatatatctaatcaataatcaatgccatatctgtatataaataaaaatttccaacaaacaactttgtatcagcccactctctgtccttctcttgttgtctttacaaatcctcttgtaactgctgtgaatcaaagtgtagattccaggcaaattgaacctttgctcccaggttataatccttaaacttgacccaaataaactgtctacttatattcatgttgtgtcagcttttttttttttatgtagacttatcatttagaatgtgctagagcagcctctatgaggggatccctcctttgtactccatttgctgtaacaccaaacgatgcagaaccaggtggattctacctagaatctgctgataaattcaggcctctgcctgggatttataaaaatggccagatattggattgagaatgtacagaaaacaaacaagaaattttcagcattttgagatatcaacataaacatcttacagcccccatttgggagtgtggcattttgaggtttttttacatcttgttcattgacctgctgcggttatgtgagaggctccaggaggaaatagcatctgatgccagaatctgtaagtgtaaataagcatcttaggagtgagagatgaagtccacaaaatatccagagccatgaccacaactatatttacctgtaaaatgtgatactagagtgtagaatattttagttttttctcttacccaagagctagcaaatcagaatagtgatccaggttctggagctccaccagggtaattccctattccatttacattcagcctgagtctctccagcctggcttatcattgaccatcagccctgcatcactgggaattctctcacaatcacctaggtgtctttgaggcatttgaggatgtccagagcagaattatgtcaggctgacaagaacggttaattcggcttctgtctcagtgtaagagaaatgagtcattctgtgtttgttcatcccctcatagaagaagtgccattggttggtacccagatgagagtttatccagtttcctggtacttggatgataaacaaggaggagatctggagacctaaatagataaactagttgtttccatttcatatggccattaaaaaaaatgaaacagtcatggttcctacaatccagaaacgtttagtctagactagcaactggataaataattaagttatgcattatatggttggtacaataagcagatgtgtccaaaatcttgggctttatttaggccgctgtctttatattgttgtgacttctgatgtctacacctgaatgatatttatgaacagaagaattgctataatttctttttttatttttgaaatggagtcttactctgtcaccaaggctggagtgcagtggcacaatcttggctcattgcaacctctgccacccgggttcaagcaattctcctgcctcagcctcttgagtagctaggattacaggtgcctgacaccgcacctggctaatttttgtatttttagtaaagacggggtttgaccatcttagtcaggctggcctggaactcctgacctcgtgatccagccaacttggtcacccaaagtgctgggattacgggcatgagccaccatgcccagccatataatatctaattttttttaccttgttaagtgcatggtatttattttccaataaaattacactagaaaacctgaagggatttgtttaagttgcatattagtatatggtataaagttgacagggcagttgctagaaaagattaaaattagagaaattctaggatttaagtttctttcatgtaagcttagaaaaaacaaaactggtattaccccagtggcatagagaacagaattctatagggtccttaccctgttccagacctgttcatattcacacttgttggaggccttatttagatctgaatctaacctggagtcttgctctcagaactgattagtagagatcagagttttggctggtgaatcctgctgcctttctagagctggtgctcacaatttcctgaaacccaaaagcagataaatgggaaaaatgaagtatgtattgtagggtcttagtttttaaattttctgttaaaaccagtgcttgcagagacattctatttagcaacttgttttctattcctgcagatccagtagttgctccacaagtcacaaaaaagtaaatataaacagaatacaattttctctaaactacattaaactcttcctttctatgtctctttcatctgtctatatttagcttttattctttacagtttttttaaaaatttgctaacagagaaacagaagaagaaataaaaatgctgggccctttatctaaatcttggaaattattaaacccttagtaccagctccagggtgttatgacaattaaatcacataatgtgttacgcccagcacagtgctccatatcatactcttgagcacatagtacgtgcttaataaacattgcattagtacatgtgtacatgttttttaaatccagacttattcagacattgctgccttttgtttcctctgtaaactttaaagagccatcaaagaataggaaactttaggatggagatgggttgtccttatttgtacaagaaatatttggttgtgacaagagttctaagtgtaaggaaccctgtgctgtgcctgctttctctaactaatgctaataatgagcccagtggaagaaacatcagcattgacagggaacttgtttaaaacacccattcatggacccttttcaaacctgcagaatcacattacataaagtggggccaaaattaccaagtgatttataagctcgttaaagcttgagaggcaatgattagctcagtggttatcagcccaggcttctcattaggatcacatggccaatttgcagaaacctcttgtgccctccccacagcttctgtttattgttgtgggtagaaatatccatgttgtttttttttgcctttttttttttcctttttgtggagaacggggtcttgctatattgcccaggaaggtctcaaactcctgggctcaagctatcatcctgcctctgcctccctgagtgctgggactacaggtgtaagccactgcatctggctccatgttactttaatgaagggcctcatgtgactctaaggtgaggtcagaatcaagtatgagggtttcaaaatacattcatgagagttaagttccaactatgccctaaagtgcggtcacaggggcagttctgtttgggtttggtagggacaggtcagtgtggcacatatttgcattactgtagcagaaattgctggtgtctgtggcaggggagggcaactgaggacagaaaaggagaaacttatatttttatcttcatggagcggctcattgttcctgaatctcttctgttttaaaggacagaaatgagtggactttttctgtctttttctgccagttgatgtcatgctagcaggtacatgtgtggtactgacacctttaaaggcatattctcaacatgcaggtgtaatttatccagagaatctcatctgagaagaaattccagagaaggagaagaaagaaaaaaaatggcttttcttcaggtaaacaggtgtcagatgaagagctgtgtccactctgcctcctggactgccatgaatttagtacttacaaaactttatttctctacttgtgtttttcctccttaatgagtttgatttaactacttcttaaaattcttatgatagtcaagagtctctgagaaatatttctttccaatatccagtagccttctctacattttctatgttatagcttcttatatgacatgaagaattctcagcaagaatttatgatacacagtattaaaaatgttccctttgtggctgttgaacagggaaagatgtgggtactcaagatctctattggggaaacttgtggtccatagtacacatggagaacatgtcatgttgaggctccatctgtgtgttccattagctctatgcagaacaggattaagaaaatgctgatttaaatgaaatggaatttattaaccagaaagttctgaaaaaagttatttggagatatctgttttctaggttgccaaatgaagcctatttaaaattactattaaaattacacaacataggagttatctggattttgaagtttgtatacaactgattttttttatggttaaattcagactataatttacttcttttgggagaaatatttcaacactgatgctgtgttcttctatgtgaattagcacatcataaaaatttgtcctagtgcagttagtggttaaagattcacttggtggaatagctctctgatgaattattttcactacagagttaattatttttctcttcatcatgaagtatctttatgcagcggatgtgcatagaccatcacatttaatctggcagctgttcttttttctaattttttctacataattttctttggaaaatgaaggctttcatctttgcttacaggctagaaaaactgggaaaaacatgggctcttccacttactggatgtctgccaaaatatccttcttgggccaaaaacattggcattactggtgagcttgttagaaattcaaaaaatcggccaagtgctgttgctcaagcatgcaatcttaccacgttgggaggccgaggtgggtggatcacctgatgtcaggattttgagtccagtctggccaacatagagaaaaccctatgtctactaaaagtacaaaattatctgggtgtggtggtgcatgactgtaatcccagctactcaggaggctgaggccggagaatcacttgaacccgggagacttaggttgcagtgagccaagattgcatcactgaacttcagcctgggcaactagatcgaaaccctgtctcagaacaaaacaaaacaaaacaaaaaatttgagaggtgccttctaactcaacatgtcttttccatttgaaaaatattcacaactcattctgtatgatgtaaatatagcactcaaaaatgtacatgtttatgtttatggccttaattttatactttattatatggaaaaatataagaactgatattgtggatgttatgctgctcttttttctcagagttagaggatatatcagagaatatttctgtgttgatattattttattggataactttagtcagtcgaataagtcagaaccagttctctttactctctcatttcaccttaagtcaaataaaaaattctgcctatggccacatggtgaaaatgtgtgtgtgtgtgtttttcagggaccattgcaatttagagatgtggccatagaattctctctggaagagtggcattgcctatacactgcacagtgaaattgatatagggatgtgatgttatggaactacagacacctggtcttttttggtgaagatagcattaatatataattcataatatactctgaagagtatattatttctcttttttatagaatgtattatagtagtttattctttgcataaaagagtttcagcgctgggcatgatggctcatgtctgtaatcccaacactttgggaggctgaggcaggtggatcacgaggtcaggagttcaagaccagcctggacaagatgctgaaaccccatctctactaaaaatacaaaaaattagccaggcatggtggtgggcacctgtattcctagctactcagtaggctgagggagagaattgcttgaacccgagaggcagaggttgcagtgagccgagatcgggccactgcacttcagtctgagcaacagagtgagacttcatctcaaaaaaaaaaaaaaaaaaaaaaagagtttctgatccccctttatttgtaaaatcttcagaatttggtaatataggaaagaatttcttcaatatgttttatcttaatccaaactttccacagtactgagatgagctgtattcttcactctaaattagtggtacttccagaaatttagcggcataaaatattgttgccccacctgaaaatctaattgccaccaccaatttttgattcagtagtaccaggtattaaaattaagaaacctacaaattgaaagtattttctaaatatttagaaatttcttttataatttagtattttggtatcaatttactattatattttatcacatcctctctgctgagcacattactagcttgtagttggagaatatgagcaagattcatgttatttattcttaataaaacaggtattgttttctctaagccagacctgatcacttgtccggagcaaggaaaaaaacctttgactttgaagagacttgagatgattgccatagccccaggtaggtgcgagtgaaaatgaatacaacagatgacacagataagaggtcccaaggtcaaagagaaagccagtccttagaatgtgactggggaagctgagttccaaaggaaatagttcctgggcatctggggttttttgtttgttttatttttttaaattttgctctcagaaaggggcatcttttttgttacgctttttgcttttttttttttttgagatggtgtttcgctctcgttgcccaggctggagtgcaatggtgtgatctttgctcaccacagtctccacctcccaggttcaagtgattctcctgactcggtttttctagtagctgggattacaggcatgcaccaccatgcccggctaatgctatatttttagtagagatggggtttctccatgttggtcgggctgttctcgaacttccaaactcaggtgatttacccacctcagcctcccaaagtactgaaataacaggcgtgagccaccacacccagccctgctttatgcctgtaaattctctaaggattctatttttctttcagtgagcttccttcaggtttatactgaaagcaaaattcctcttcatggcatataagagactgcacaatctggctgcttttttattgtttgcaggactcacaaatatttgcatgattttgagaaactaaaactcttttttaggttttttttgcatcagatttgaaatgtgtgagagcagtagtttcttttgcatttttttgttcatttttctgcacagtcctttctgtttttattgctagtcttgaaatatagttggcaattataagtatgatatccttctgctttgctctttttccttgattgctttggctattccaagtttattttagtttcatgtaaattttagaattatattttccattactgtgaaaaaaatagcactgcaattttgattggcattatattgaatctatagatcactttggataatatggcactttagtaatatttattttcaattcatagacataaaatattttaaaatttatttggatcttccctaatttttttcatttttttattgtaaagatttttttacctccttggttaaattttttctcagacatttattatttaatactatagcaaataagatttctttcttttttttttcttttagagatagagtcttgcactgtcacccaggctggagtgcagtggcatgatcttggcttactgcaaactccgcctcctgcgttcaagcaattctcttgcctcagcctcccaactagaagagattgcaggtgcccaccatcaggcccagctaatttttatatttttagtacagatagactttcaccacgttggccaggctggtcttaaactcctgaactcagatgatcgacccccctcagcctcccaaagtgctgggatggcagacgtgagctaccatgcccagcatcttcctgtattttatcagatagttttaagtgtatgaaatcatacgtatacttgtatgttaattttatattttgctaatttactgagtgtatttggtttagacaggttttaatatactgtttatggtttctttgtgtttatttttgaggcagaatctcactttgtcgcccaggctggggttcagtggcacaatctcaactcacttcaagctccacctcccaggttcacaccattctcctgcctcagcctcctgggtagctgggactataggcacctgctgctgtgcccggctaattttttgtaattttttttttttttgtagagatggggtttcactgtgttagccaggatggtctcgatctcctgacctcgtgatccacccgcctcggcctcccaaagtgctgggattacaggcgtgagccaccgcgctcggccctgtttatggtttcttaaatataaaattttatgatctacaaactgcaactttttacttttctttaatttcaatggattaaattttttcaactaattcttctgccacatacatccagtgctagattaaaatagaagcaatgacaatgggcaaaatatagttttatattggtgtctgaatttgatggagcaaacacctcttcaaattttcataaactgatttcagaagataaaaatcttttgttggacccttagggtgatgataagctctctgaatttgtagtgaagaggggttgcagcttggtcacaaggctgctgggtctgctttagggtccaccattagttggcttgttacaggggcttggatagttgtaattcccattttatttgtgaacagaccacatgtttttcaggactttgctccatagggcagacactagggcaggtttttgcagtcggatctgcatatggtgggcctcgtatcaggatgcggatgagtgtagctttcactgagtaccagagaacatttcctcaggtaactgtgtgggtttctatgtaggcagaactgatcataaactgaggctcaggtaactgaaactgagtcattgaactgcttcacagaccccagtaaaggccaaggtttgcaggcctgcctacatggctgtaaatgggtgccttcctccaggtctctggaatggcaggaccttggccagactgtggctggtaggagtttgggataattacagagtaagttcagaattctcagtgggatcaagttgggtgaaccctatcctggtctgtagccaagaacaggggtcatgtagttttccacctgaatgagggcctgccttccgaatagaacacttctcaaccttaagctttaacagtttttcacaactccctccctggatctcaaatctctcatagaggcccttattttggagatgacgtcttgcttcataaccaaggctggtctcgaaatcctggcctgaagcagttctccaaccttaatgtaccatgtagctgtcattacaggtgtgagccataatgactggttctctaataaaggcactttttttttcctctgagatggagtctcactctgtcattcaggctggagtgcagtggcgccatctcaactctctgcaaactccgcctcccgggttcaggcaattctcctgcctcagcctcctgagtagctaggattacaggtgtgtgccaccacaaccgcctaattgttttgtatttttagtagagataaggtttcaccatgtttgccaggctggtcttgaattcctgacctcgtgatctgcctgcctcagcctcccaaagtgctgggattaaaggcatcagccacagcactcagtcaataaaggcatcagggatggctgattttttttgctgtaagggaatatgaaaatagggctcttttaaccttattgatgtcactctccctatacatttttactttctattttctatttcaaattgtctgtaactttagattcagatatttaggacaatatgctagaatttgcatggtatgcctgaagtaaattacataactagcaggcactccatatttaccaaaatacttcgttataaattcaaatttgttgcaggcaaaaaggaattacagaattttcatttacattcttcagactatatctaaagaataacagtttatttcctaatatttgtttcacatatcacagtgcctaaccctattctgccaaatatatatgtatataattttttctatgtttaacaatttaagtctattttttgcttctaaagttggattacaacagtttcattttgtgtaataatagcatatattttaaacataaagagtaaccctagtttcttttaaatgcttattaaatgtttctcattaagtcttctatttattgttttgggaaaaaaagtctttctgctactttgttatccacataaaaaaacatatcctctacaaataataattaacaaatgtccagttttattcattacaaatattaacatcatttttcttttatttatcctttatgcatcattttatacattcacacacacaaagaacattaaaaatatatccaattattcaattttggttgaattttcattaaaataagtgttaaaaatatttatttgttttctgttttgagaaggcttttattgttgtactccggagtgttatttctggagacaaagttgcctgtgctttaatagggagattcctgggagaatctaaaccataagcaacaaaattttaagttaataaattcaagacaaagcagaaagtatagatttgctttcagcattcccgaggtgtttagatttttattagtcacctaattaacatattgttccaataattgttcttttcttctgaaaataagcagaaactcatacttacacaaaaacacttcataattttcttacacctaaggtttatcttcagaatgatatgtgtatatttaaccctgtgcaaattaacactaaaagtctatgtttgcaggcagagaccacatgttcaaagaaaactatataacaaatatttttaaataatttttcaggattttctatggatttctatttcttttttttctgagatcgagtctcactgtcacccaggctggagcacagctgcaggatctcagctcactgcaacctccacctcctgggttcaagttattctcctgcctcagcctccatgtgccaccatgtctggctatattttgtatttttagtagagacgaggtttcaccacattggccaggctggtcttgaactcctgacctcagggaaaccacctgtcttggcctcccaaagtagtgggattacaggcatgagccactgggctgggccatattctatttctgtataatttttattatgaccataaaaataacaatgtagtcaataacaatttaattgtacattttaaaataattaaagtatataattacactgtttgtaataaaaagtataaatgttagaggtgatggataccttatttaccctaatgtaattactacacattgtaggcctgaatgaaaatatgccatataaggcataaatatatacacatactatatacccacaaataccaataataaatttcaataagaaaaaagaataaaaatctaacctatggaaacaatattcttaaattcatttgctgtttaaagccactcgcaaagtgattactagagatgttatttcactatgtaccaaatagtatattgctaccatcttttacctacacccttgagtaaggtgggataggttaaagttagtggaataatgcttcattaaatgcacaatagtcttaacatgttaaaaaaataaaattaagtttgcacataatctaatgatttttaaatatactgcattttattacataaaagtacaattaataatatacttattttaatatacttttaactataattaacaattccaccataatgtagaaaatagtctgaacacctagcttatacattacttaatataggttaactacaatgagcctctccacttatcttttcatcacgcatcttacattttagtgtccttacttttatagaaaaggttataaataatgcccaataaaaaaagaatctctggtatctctgatgcagcaaaaattgctcatatgttttcacatgtgaataggaataaaataacagcataaagtaatttgaaagctgtatgacatcattattcacttttgaaaaactttttttcaagaaaacaagtatacttttaatgtaattacaatgcttccaaaaatctccttttaaagctatatacaaataattttaaacaattttttatttttatatttatcaagtgcggcaaccaaataaaggctttgtcacattttatacttttctacagtttcacactagtataatttttttatgtatagaaacgttggaggtgttgggaacagcactgtcacatctttcaggtttgcagggttcctcttcagcatgaattattgccatgtctcttaagaattgagaacttatggctaggaatggaggctcatgcctgtaatcccagcactttaggaggccaaagtgggtggatcaactgaagtcaggagtttgagacgagcctggcaaatatggcaaaaccccatctctactaaaactacaaaaattagctgggtgtcattgtgggtacctgtaatcccagctacccaggagacgaaggttgcagtgagccaagatcatgccattgcactccagcctgggtcacaatagtgaaactgcatctcaaaaaaagaaaaaaaaaattgagaacttgttataggctttgccaaattcttcacacctgtagggtttctgtccagtatgaattatgtgtaataagtgttgagaacttccttacaaagaggtttgtcagcctggtgcagtggcttgtgcctgtaatcctggcaatttgggaggctgagatgggtggatcacttgaggttggcagctgaagaccagcctaaccaacatggagaaaccccatctgtactaaaaatacaaaattagccaggtgtggtggtgcatgcctgtaatcttagctacacaggaaggctgtggcaggagaatcgcttgaacctgggagatggaggtgaaggtgagccaagattgcgccattgcactccagcctggacaacaagagtgaaactccatctcaaaaataaataaataaataaataaataaatagataaataaataaataaagctttgttacagtattggtttctgtccactatgaattctcttatgtttattgaagtctgaggaccagttaaaagctttgccacattcttcacatttgcaaggtttctctccagtatgaattgtcttatattcacttagagttgaggatgcagtaaaggctttgccacattcttcacatttgtaaggtttctctccagtatgagttctcctatgtttatgggggcttgaggaccatgtaaaggtttttataccatttatagcatttctctccagtatgaattgtcttatgtatagtaaggtgtgaaaaatggttgaaggctttgccacattcttcacatttgtagagtttctctccagtatgaatcttctcatgttcactaagggttgaggataaaataaaggctgtgccacatttatcacacttgtatggtttctctccagcatgaattttcttatgcctagtaaggtgtgaggaatgggtgaaagctttgccatattcttcacatttgtagggtttctctccagtatgaatcttctcatgtttactaagggttgaggatgaaataaaggctttgccacatttatcacacttgtatggtttctctccagtatgagttttgttatgtgaagaaagggttgcaggatgtttaaaagctttgccacattctttacatttgtagggttgctctccagtatgagttatcttatgaatagcaagctgtgagggccagttaaaggctttgccacactcttcacatttgtaggatttctctccagtatggattatcttatgttcagtaagcgtagaggaatacttaaagccattgccacattcttcacatttgtagggtttctctccagtatgagttatcttatgtgtagttaggtgtgaggaccatctgaaggctttgccacattcttcacatttgtagggtttctctccagtatgaatcttctcatgtttactaagggttgaggaaaaaataaaggctttgccacatttatcacacttgcatggtttctctccagtatgagttttcttatgtgaagaaggggttgtgggatggttaaaagctttgctgcattctttacgtttgtagggttgctctccagtatgagttatcttatgaatagcaagctgtgaggaccagttaaaggctttgccacactcctcacatttgtgggatttctctccagtatgaattatcttatgtgtagtaagggtacaggagtacttaaaggctttgccacattcttcacatttttagggtttctctccagtatgagttatcttatctgtagtaaaggttgagtaccagttaaagtctttgccacattcttcacatttgtagggtttctctccagtatgaattttcttatgtgtagtaagggttgaggactggttaaaagatttgccacattctatatgtttcaaaggtttttttacagtacgtcttctgtctgtttgaatttgaaaattgatgaaagactttcacatatttatcacattgaaatattttgcaatgggtagttgtcaagcattggttaagcccattataacctcttttttgcaccttacactcatccacactttcacatcctttttttaactgtaaattgccatgtccacattttttatatcttctcagtatcactttttgaaaagaatcttttatgttctgctctagccaaagttcttgggcaaaatgagaacaaataactgaaagagacaataaaaacacaacacttcaactgctagactcagataaatatattttacaaatctaacctataaaatttcacagactacctaaggaagatgacatggcaaaataccacaagctgtaatttcttcctggacatataaatgtaacaaaaacatactgaccaaaatacaatttgtaaaaaatgtataagtgaattaagtgtgtgaagggtcccaggtgagcacaatgcaaagagccacatagaagataaagaaaagcctgttacttatacccaacacagctcttccatatctccagtataactctgtgcctttaaaagtaaattattggcctggtgtggtggcttgtgtctgtaaacccaacactttgggaggcagatgtgggtgaatcacttgaggtcaggagttcaagaccagcctggccaagatggtgaaaccccatctctactaaaaatacaaaaaattagccaggcttagtcatgggcacctgtaatctcagctactggggaggcggaggcatgagaattgctggaacccagggggtggaggttgcagtaagctgagattgcaccactgtactctggcctgggtacagagtgagaccccaccacaaaaaataaaaattaaaaaaaaaaagttaattgccaaccaggcatgatggctcatgcctgtaattccagcaatttgggtgaacaagatggaggacaaccagaggtgatcagcctgaccaacatggtgaaacctcatctctactaaaatacagaaaattagccaggggtggtaataggtacctgtaatcctagctacctgggaggctaaggcaggataattgcttgaactctggaggcagagattgtactgagccaaggtcatgcctctgcactccagactagttaatagagtgaggctctgtctcacacatacacacaaaaatgtaaattgccaactcctggtttcttttttaaaaaacaagaaaaatattgacacatacatctttatttctggcttctaggggcttttttagacactagttgatatgtcccatgacacaaaatgccaaaaaaaatggtgatatatgttagaatgacactttgagtctgaaggtaaattatagagaagcagagaaactgcagtaacccaaacagggaatgggtgtagtgaatgattacttattattaactaaacaataaacataaaattttaaacaagacacaccttaaaaacatgtttgaggaattctcagaatctagagtcaagacaattgatttcagactatgccaggacagagccatattataaagactgtaacaggtagctttttgttaatgtcctaatctcaatcaaaggttataatgtataccaaatattagagcaacatggccccatcaaaaaaattataaaattttcaaaagcaaccataaaaagtatgtaaagtaatttttaaaattccaaatgaattgaacagcccagtgttggtagctcattcctgtaatcccaacacactgggagatcaaggtgggaaaatcacatgaggtcagaagtttgggaccagcctgagcaacatggtgaaaccctgtttctgctaaaaatacaaaaattagctgctcatggtggcatgtgcctgtaatcccaggtacttgggaggttgacacaggataattgcttgaatccaggaggggaaagttgcagtaagtggagattgtaccactgcaatgcagactgggcaacagagcaacactgtctcaaaaataaagtaaaaaaggccaggcacagtggttcatgcctgtattcctagcactttaggaggctgaagtgggtagatcatttgaggtcaggagttcaagatcagcctgcccaacatggtgaaaccccatctgaactaaaaatacaaaaaattatctgggcatggtggcaggcacctgtaatcccagctactcaggaggctgaggcaggagaattgcttgaaccaggaggcagaagttgcagtgagccgagattgcgccactgcactccagcctcggtgacagaaaaatactctgtatcagaaaaaaaaccagaaacacagacaactattgaagatcagaaaaatgagaacaaaaagaaatactaaagtaaacacacacaaaaaattgtggatataaaaagtacaaaaaataactgaaaaatttattacaagaaaatacgtaaacatgaaaaagctgaaaaaacaaacttagatacacacaaatatatttataacacccaaataagcaaaatttcaaaaatcacatataagaatagaattttgggtgctgaagataaaaatgatgttccgtttataagcatagtctcatgagataaccagtgaatttatttaaaacatttttgcatgtcaaaaggaaactgatattgttaaatttataataataataaaaaagctgtcaaatgggaataataccatcagcaaaattgtactatcagataaaaagaagtccttccaaaataaccaaatcctgagaaagtatattggcactgcatacaccctacatatcaaagatgctgaaaggagtttcttccactgaaaataacataatgtaagaaaacaccacataatcatatgaaaatacataactttctggaaaagatatgcaaattcacaaaaatggtatttcttacttaacattatcataatgatacagaaaacatttttaattattctctaaatttaaaagataaaagtacagaaattattaacatctgttaatggatatacaacataagaaatataattaacaaaatcaataacaaagttgaaggcagatgttatgatgaataattttggtatgtaactgaagttaattttttaccacattaaaatacatttttgaatattttagaggttttatggagtcccctggtaccactaagattatatctgtagagctacacaaaagtaaataagagggaactgaaagcctatcaatacaaaaataaaaaaaacacaaaaaaggcagaaagagaaaatgagagacaaagacacaacaatcaaataaaacaattaataaaaataacagtaaatttttctatttcagaaaactatttaaatatatatgttatctttccaatcaagaaacatactttttttttttttttttttgagatggagtctcgctctgttacccaggctggagtacggtggtgtgatcggctcactgcaacctctgccttccagtttcaagtgattctcttgcctcagcctcctgagaagctgagattacagttgcctaccagcacacctgactactttttgtatttgttagtagagacacggtttcaccgtgttaaacaggctggactcaaactgctgaccttgtgattcacccacctcagcctcccaaagtgctgagattacaggcatgagccaccacacctggtggagtttacagtgagccaagatcacaccactgctttccatcctgggcaataaagcaagactcagtctcaaaaaaaaaaaaaaagacggtacagaaaaactttaaaattcttttataaaatataaaaaactatgtaaatttgcatgaatcaatcaatagatacaccatatgaaataatttttataacaataacaaactagaaaatgtagaggcatagtttttgtgttcaattgaagttgttatgagattaaaacatattgttttaactttaagatgtatgtaatctctggttttcaaaatgattacaaagggaatatttgtagaaagtatggaaaagaagataaaaaataatcaaagcatgccagtacaaaattaaatgaaaattaagaaagtaaaacagcaaatgagaaaaatataactattagaaacacataaaacaataacaatataactggtaataacaacttcatttctttaagtaatcattgtaaatataaattaattaaactgcttaataaaatgaaatgtaatcggaggactttcaaaggccaaggtaggctgatcacttgatcccaggagttcaagaccagcctggggaacatggcaaaactctgtctctacagaaaaaaagctacctgggtgtgatggcacttactggtaacccagctacttgagaggctaaaatgagaggatcatctgaggtttggaggttcagtcaccagtgaaccatgcaaatcagcctggttgacagagtgagaccctatctcaaaaataactgaggctgggcacagtggcttatgcctgtaatcccagcactttgggaggctgaggcatgcagatcacctgaggtcaggagtttaagagactggccaacatggtggaatcccatctctactaaaaatacaaaaaattagccaggcgtggtggttggtgcctgtaatctcagctactcaggaggctgaggcagtagaatcacttgaacttgggaagtggaggttgcagtgagttgagatcatgccattgcactccagccttggcaacaagagtgaaactttgtctcaaaataaataaatacatacataaataaatatacctaaagaaaaatccatagaatgcctcagtggtttcttaaaaagcatactgtatgctgcccacaaaagactcatcgtagcattgagtcaaataggctgaaagtaacagaaggaaaaaaatgtgtatttcatgaaaattgtaaccacaattgagtgaggtggtcataattatattagacataacatgctttaagtcaagcactaccattaggtgaagactgatattatattatagtaaagtgagttaatttaccaggaatctataactatattcatctatctatatgtatatgtgtatataacatcagggctccaacatatataaagcaaatattgacaaaactgaagcaagacatacacagcaacgtaatagttgtagacatcaagaccccatttgcaataatagaaaattcagagaaaaaaatgaaaaacaaaacttagacaatattagactatattattttgcatacagaggaatacttcagagattataatttataaagaaaaaaattatgtggctcacactttggcagactgtaaaagaagtgtgtgccagcatctgcttctggtgagggtctcaaaaaacttacaatcatggtagaaggtaaagagtaactggacatattatatggtatgagacagagcaagtgtgaggtaaagaagccaggttcttttaatgaaccagctctcatttgaattaatagagtgtaaactttttggttaccaagaggatgtaccaagccattcatgagaaattttcccccatgacacaaacatgtcccagcaggtcccacatccaacattgaggatttatcttgcagcatgagttctggagaacatggacatccaaaccatattatagaccaactaggcttcacagacacacacaaaactctccagtcaaaaccaagataatacataatattcccacttgcatctggtgtattctgttatgacatataccaagttttattaaatttaaaagtactgactaggtgcagtggctctcgcctataatcctaacactttgggagaccaaggtaagaggatccactggggccaaaagtttgagactagcctgggcaacatagtgagatcctaacattacaaataagcaaacaattagccagacatggtagtgcatgtctgcagttctagctactcagaaaactgaggtgaaaggataacttgagcccaggaggctgaggctacagtgagccaaaattatgccactgcactccagcctcaatgtccataagatcttgtctcaaaacaacaacaaatcaattaaaaaacactaaaattacacactcttgtgttttctaacaaaaactgaatgaaactaggaattaaaagcacaagccaaacaggcaaattcaaaaatatgtgaatataagacacattcttcaacatattcttgctcaggggtcaaaaaactttatttttcaaagatgtcaatacaacctacagttaaaagctacagtaacataaacaatgtgatactgacacaaagataaacagatgaaagaacagaatagagagctccggaatgaacccttctgtatatgatcaaatgatcttccaaaaggttgccatgagtacaaaatagagaaaaatcatctcttcaaaaaatgatgttgaaaactgaatatcgagaggaggtcgcggcgccggaggccccagaagggtcgaaggcgccgcgggctggggtcggtggcttagggagcccgtctggccatggtggccgcggctggtggttggcgcggctgcgctgcggcccggggcagtgcggagccaggacagtcgcggcgctgacgcccgcgggccccagctgcagatatgaagcggagccgctgccgcgaccgaccgcagccgccgccgcccgaccgccgggaggatggagttcagcgggcagcggagctgtctcagtctttgccgccgcgccggcgagcgccgcccgggaggcagcggctggaggagcggacgggccccgcggggcccgagggcaaggagcagccgcctgccttggcctcccaaagtgccgagattgcagcctctgcccggctgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaagtgaggagcgtctccgcccggcagccaccccgtccgggagggaggtgggggggggtcagccccccgcccggccagccgccccatccgggagggaggtgggggggtcagcccccccgcccggccagccgtgccatccgggagggaggtgggggggtcagccccccgtctggacagccgtgccatccgggagggaggtgggggggtcagccccccgcccggccagccgccccgtccgggaggtgaggggcgcctctgcctggccgcccctactgggaagtgaggagcccctcagcccggccagccaccccgtccgggagggagatgggggggtcagccccccccacccggccagccgccccgtccggtagggaggtaggggggtcagccccccgcctggccagccgccccgtccgggagggaggtgggggggtcagccctccgcccggccagccgccccgtctgggaggtgaggggcgcctctgcccagccgcccctactgggaagtgaggagcccctctgcccggccagccgccccgtccgggagggaggtgggggggtcagccccccgcccggccagccgccctgtccgggagggaggtgggggggtcagccctccgcccggccagccgccccgtctgggaggtgaggggcgcctctgcccagccgcccctactgggaagtgaggagcccctctgcccggccagccgccccgtccgggagggaggtgggggggtcggcccccctgcccggccagccgccccgtccgggaggtgaggggcgcctctgcccggccgcccctactgggaagtgaggagcccctctgcccggccagccgccccgtccgggagggaggtgggggggtcggccccccgcccggccagccgccccgtccgggagggaggtgaggggggtcagcccccctgcccggccagccgccccgtccgggaggtgaggggcgcctctgcccggccgcccctactgggaggtgaggagcccctctgcccggccaccaccctgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaatttaaaaaaaaaaaaaaaaaaaaagaatggactttcccaggccagctgtggtggctcacgactgtaatcccagcactgtggcaggccaaggcgggcagatcacctgagatcaggagttcaagaccagcctgaccaacacggagaaaccccgtctctactaaaaataaaaaaaattagctgggcgtggtggtgcatgcctgtaatcccagctacttgggaggctgaggcaggagaattgcttgaacccaggaggcagaggttgttgtgagctgagattgcaccattgcactccagcctgggcaacaagagggaaactccatcaaaaaaaaaaaaaaaaaaaaggactttctcaaagaaaatgtatttaaatgtctgcaccaataattccagcatgtgtacgaataaatatgatatgtcctttacaaaaaaaaaaaaaaaaaaaaagaaaactgaatatcaacatcgataaaataaagttggattattttcttgaatgatacaaaaatatattttaaataaaatacttagacacaaaaaactaacaaatctttcagaaaaaatacaggaaaaagacatgacattgtcttggcaccattttcttagatatgacattaaatgcatgagcaacaaatacaagaataggaaccattaactatagtagatgtcaaaatttctgtacatcaaaagaaaattcgagaatgacaacatatttagaaaatgggtgaatatatttgcaaattacatgtgaaaaaagttaatattaaaaatatatcaacaactctaaaaactaaaccataaagttcaataacttgatttataaatgaacaaacaaaactttcatcaaaaaactacacaaatgggaagaaacatttgacaggatgcacaaaattactcatttgcagagaaatgaaaaaaaaacacaatgacagcgaaatcatctcacacccattagaatggccactatatattttttaaaaaatgccaactctgttgatgatgcaataaaaatgaaacccatgttggttgttggtggaaaacaaagatgtagtcattattttaaaatgttattaatgttcctcatttatatatctatatacaaaatatgtaacacaggccaggtgcagtggcttaagcctgtaatcctagcactttgggaggccaaggtgggcaaatcacctgaggtcaggagtttgagaccagcttggccaacataatgtacgctatcttactaaaaatacagaaaattagctgagcgttttggcgggcacctgtaatccgagttactagagaggctgaagcaggagaatttcttgaacccaaaaggcagaggttgcagtgagctgagatcacaccactgcacttcagtctaggtgacagagcgagactccatctctacaaaaataaatatagaaataaataaatcacaggaatgaatgaatgaatgaatgaatgaataaataaatgcaacagaggaccaggaagacatatttgaaaatccatggccaggcttggtggctcatgcctgtaatcccagcactttgggaggccaaggtgggtagatcgcctgaggtcagaagttcgagactagcctggccaacatggtgaaaccctgtctgtagtaaaaatacaaaaatgagccggtgtggtggtgggcatgtgtaatcccagctactcaggaggctgaggcaggagaatcacttgaacctgggaggtggaggttgtagtgagccaagattgtgccactgcaccctgggtgacagagaaagactccgtctcaaaaacaaaacaaaacaaaacaaaaaaaaaaagaaaagaaagaaagaaaagaaaatctatgtttattgcatcagtattcacaaaagcccaaaggctgaagcaacccaaatttctcttgatttataaacatatcaaaaaatataacatatacatacaatggaatatcgttccaccttaaaaagaacaatcttgtcacattttaagatgaacattgagaatattatgtcacttgaattaatccagtaagaacattatgggtactgtatgattccactcatatgagataccttaagtagtcaaaatcataaaaacaaagtggaaggtttgtctgtcaaggacgggagagagggtaaaatgagcagatgttacttaatgggtattgagtttaaattttacaagatgtaaggtttctagaagtcttttgcataacaatgtcaatatacttaacatccctgaaatgaacagcttttcttttgagacaaggtctcactctgtcactgaagctaaagtgtagtggcacacctttgactcctcctcaacgtcccaagtagcaggtaccacagctgcacaccaccatgcctagctattactaaatttattttatataggggggtctccatatgttgcccagactgatctcaaacttttgggctccagggatcctcctgtgttggccttccaaaatcctgggaatacagatgggagccacaaccatgcatggccctgaaatatagacttgaatagatttaagatggtaaattttatgttacgtgttcttaaaacaatttttttaaagaaaaactgaaaaatgtccagaattataaatcattttgaaaattaccttcaaatcacaaaaatgtttctctcacaaaagaaaatatatgttcatcattaaacacatggtgaaaataagactgtgtctatggctactcacttaaacaagaaaattttatggtcagttctgcctatatagaaactcacacagttttctgaggaaacgctctctggtactcactaaaagccacactcatccacatcctgatataaggccgagcgtatgcagacctgactgcaaaaacatgctgtagtgcctgccctactgagcaaagtcctgaaggatatgcagtctgtccaaaaataaaatgggaattacaactacccaagtccctgtatcaagccaactaaaggggaaccctagtgcagacccagcagccttgtgaccaagctacaacccctcttcactacaaattcagagggtgtctcatcaccctaagggcccaataaaagatcattaccttctaaaataagtttatgaaaacatgaagtgtttgctccatcaaattcagacaccaatacaaaactatattgtgcccaatgtcaatatttctattttaatgtagcactggaagcatgtggcagaattagtcaaagaaataaaaaaatccattaaaattaaagaaaaataagtaaaaattggtgtttgtaaatcatacaatcttatatttaaaaaaccataaacagcacattaaaacctgtctaaactgataaatacactcagtaaattagcaaaatataagattaacatacaagtatatgtatggtctcatatatttaaaacaaactgataaaatagagaaagacaaaaaccttatttactatagcattaaataatatacttcttagaaaaaaaataaccaaggaggtaaaaaatctttacaataaaaaaaaagaaaaaattagagaagatccaaataaatttaaaaattggcatattatccaaagtgatctatagattcaataaactttctatcaaaattgcagtggtatttttttcatagtagtggaaaatacgattctaaaagttacatgaaactaagataactttgatagccaaagcaatcttgaggaaaaagaacaaagcagaaagataccatacttataatttcaaactgtatttcaagactacatagtaataaaaacagaatgtattgtgcagaaaaatgaacaaaaaatgcaatacaaactattactcttatacatttcagatctgatgcaaaaagagaacttaaaatcatgcagatatttttgtgtccccaaaacaatggaaaagcagccagattgagcagactcatatgtcataaagaggactttggttctcactgtgaacttgaaagaagctcaacaaaagaattcttagagaatttaaaagcatgatacagaagatgtcccttggtgagaacaaaattaaaaaccaaccaaccaaacaaacaaacaaacaaaaaacagctgcccaggaactatttcctttagaacacagcttcccaggtcacattttaaggactggccttctcttggatgttgcgacctctcatctgtgtcatctgttgtattcattttcacttgcacctacctgggggtttggcaatcatctcatgtctcttcacggtcagaggtttttttccttgctccagacaggtgatcagttctggcttggagagaacaatacctgttttattaaaaataaatagcatgaatcttgcttatattgtttaattacaagctagtagtgtgctcagcagagaagatgaaataaaatattctagtaaattaatgccaaaatactaatttataacagaaatttctaaatattaagaaataatttcaacttgtaggtttcttttgttttgctcttgttgcccaagctagagtacaatcactcaatctcggctcaccgaaacttcagcctcccaggttcaagcaattctgctgcctcagcctctggagtagctgggattacaggcctgagccaccatgcctggttaattttgtattttcagtagagatggagtttcttcacgttggtcaggctggtctggaactccggacctctggtgatctgcctgcctcagcctcccaaagtgctggcacccggccaccacactgggccctgcttataggttttttaaattttactacttggtactactgaatcaaaaatggcttgtgtcaatgagattttcaggtggggcaacaatattttatgccactaaatttctggaattaccactaatttagagtgaagaatagagctcaactcaggaatgcagaagtttggattaaggtgaaacatcttgcagaaattcttttctacatgaacaaattctgaagattttctggaaaaaggccatctgaaactcttatgcaaagaataaattatttaaaaacattccactaaaaaagaaataaaacttttagggttttttgtgaattatgtatttaagttgtcctcaccaaggaagaccaggtgtctgtagttctctaacatcacatccctatataaattccgctgtgcagtgtccaggcaatgccactcctccagagagaattctatggccacatctgtaaattgcaatggcccctgaaacacacacacacacacacacacacacacacacatttttaccaagtcgccatgggtggaatttttgacttaagatgaaatgagcgagtaaagagaactgattctgacttataggactaaaattatccagtaaaacaattttcaacacagaaatattccctattatattctctgactctgagaagagcagcataagatctacaacattatttcatgtatgatatttttctaaataataaagtataaaattaacagcatgaacatgaacatgtacatttttgagtgctatatttacatcacatggaattatgaatatttttcagatggaaaagacatgttgagttagaaggcacctctcaaaattttttttttttttttgagacggagtctcgctctgtcgcccaggctggagtgcagtggcatgaactcggttcactgcaagctccgcctcccgggttcaagccattctcctgcctcagcctccagagtagctgggactacaggcgcccgccatcatgcctggctaattttttctgtattttttagtagagacggggtttcaccgtgttagccagggtggtctcaatctcctgacctcatgatccacccgcctcggcctcccaaagtgctgggattacaggcgtgagccaccgcgcctggcctcaaattttaatatgtacaataagctgaagaccttatgcaggtttttttttttttccagaagatctggcataaagtctgattttttgaatttctaacaagctcaccaataatgtcaatgtttttgtcccaaaaaggatattttgtcaaacatgcagtaagtggaagagcatgtgtttttcccagttttcctggcctgtaaacaaagagccttcattttccaaagaaaagtatgtagaaaaaaaaaaagctgccagatttaatgtgatggtttatccacatcagctgcataaagataattaataatggggccgggcacagtagctcatccctgtaatcccagcactttgggaagccgaggcaggcagatcatgaggtgaggagatcaagacaatgctggccaacacggtgaaatcttgtctctactaaaaatacaaaaaattagccaggcatggtggggggcgcctgtaatcccagctactcgggaggctgaggcaggagaatggtgtgaacccaggaggcagagcttgcgttagctgagattgcaccactgcactccagcctgggtgacagagcgagactctgtctcaaaaataaaaaaaaaagataattaataatgaagagaaaaataattaactctacagtgaaaacaatctgtcagagagctatttcaccaagtgcattataaaccattaactgcacaaggacaaattttcatgatgcgctaatgcacacagaagaacacaacatcactgttgaaatattcctcccaaggaagtaaataaaatctgaatttaatcataaagaaacatgtttatgctaatttcaaagtacagaaaactcctatgttctgtaatgttcagtagtaattttaaggagacttcatttagcacccaagagatcaggtatctcctaataatttttttcagaactttctgagtaataaatgccattccatataaataagtattgtcttaatcctgttctgcataaattaatgaaacacacagatggagcctcaacattacacgttctccatctttactaaggacaaaagttttccccaatagaaatcttgagtagccgcatctttccatgttcaacagccacaaagggaacatttttaatattgcagatcataacttattgctgagaatcctgcatggcatataagaagctatgacacagagaatgcagagaaagctctgggatatagaagaaaaattattttttcagagacccttgactatcgtaacaattttaagtagttaaaccaaacccagggagaaaaaacacaagtagagaagtaaaggtttgtgagtgctacatgcatggcagtccaggaggcagagtgaacacagctcttcatctgagacatgtttacctgaagagaagcctttttttttttttcacctcctcctctggaattccttgtcagatgagattctctggccaaattacccctgcatcttgagactatgcctttaaatgtgtcagtaccacatgtttacctgctagcatgacatcaactggcagaaaaagacagaaaaagtccacccatttctgttttttacaacaaaaagattcaagaacaatgagatgctccatgaagataaaaatataagtttctcctttcatgtcctctggtgccctttctgccacagacaccagcaatttctgctacagtaatggaaatatgtgccacactgacctgcccctaccaaaaccaaacagaacaggtcctgtgcgcaccacttagtgcaaaggtggaacttcttaactctcatgaaagtattttgagaccctcatacctgattctggcctccccttagagtcacgtgaagcccttcattaaaacaacgtggatacttccacccagaacaataaacagaacctgtggggaaggcacaagagatttctgcaaattggccatgtgatcctaatgagaagcctgggctgataaccactaagctaagcattgcctctcaagctttaagaagcttataaatcacttggtaattttgactccactttatgtgattctgtaggtttgaaaagggtccataaatgggtgttttaaacaagtcccctgtcaatgctgatgttgcttctccttggctcattattagcattagagaaagcaggaatagcagagggtcccttacacttagaactcttgtcacaaccaaatacttctggtacaaataaggacaacacatctatgctaaagttttatattctttgctgggtctttaaagtttacagaggaaacagaaggcagcaatgtctggataagtctgcatttaaaaaacatgtacacatgtacaaatgcaatgtttattaagcaggtactttgtgctcaagagtatgatacagagcactatgctgggcataacatattatgtgatttaattcttgtaacattcttggagctagtactcagggtttaataatttccaggatttagataaagggcagagaatttttactgcctcttctgtttctctgttaccaaatttttttaaacattgtaaagaataaaagctaaatatatacagatgaaagagatatagaagagtttattgtagtttagagaaaattttattctgtttatgtttacttttctgtgacttgtggagcaactactggatctgcaggaatagaaaacaagttgctaaatagaatgtctctgccaacactggttttaacagaaaatttaaaaactaagactctacaatacatactttatttttcccatttatctgcttttgggtttcaggaaattggattcaccagccaaaactctgatatcttctaatcagttctgtgaggcaagactccagagtagggtcagacctaaataaggcctccaaaaagggtgaatctgaacatgtctgggacaaggtgaggatcctatagaattctgttctctatgccactgtggtactaacagttttctttttttctaatcttacctaaaagaaaaaccccagagtttctgtaattttaatattttctagcactgctctgtcaactttatactgtatactaatatgcaatttaaacaattctcttaaggttttctagggtaattttataagaaaatcagtgtgtacacttacgaaggtaaaagaacagaaattatacggctgggcacagtggcttacacctataataccaacactttgggaggctgaggtagatggatcatgaagtcaggagttcatgaccagcctgactaagatggtgaaacctcttctctactaaaaatacaaaaattagttggctgtggtgggaggcactgtaatcatagctatttgagaggctgaggcaggagaatcgcttagacccaggtgacagaggttgcagtgagccaagatcatgacacagcattccaggctgggtgacagactaagactccatctcaaaaaaagaaaaattaattataacaattctactgttcattaatatcccttcaggtggtaggtaccatgactgcttcatgtatttttttttaatgaccataagaaatggaagcaactagtttatctacttgggtctccagatctccttgtttatcatccaagtaccaggaaactggagaaactctcatccctgtacaaaccaaagacaactcttgtatgatgggttgaacaaacacagaatgactcatttttctttacactgagacagaagcagaattaaccactcttgtcagcctgacacaattctactctggacatcctcaaatgcctcaaagaaacctaggtgattgtgagggaattcccagtgacccagggctgatggcccaatgataagccaggctggagcgactcaggctgattctaaatagaaaataaaactgcgttggtggagccccagaacctgggtcacctgtcctgatatgctagcacttgggtaaaagacagaacaaaaatactctactccagtatcccattttacaggtaaacatagttgtggtcatggctctggatactttgtggcctgatctctcactcctaagatgattatttacacttacagattctgccatcagattctatttcctcctggagcctctcacatcactgtagcaggtcaatgaaaaagatgtaaaaaaactcaaaatgccacactctgaaatgggggctgtaagatgtctatcttgacaacttacaatgcagaaaataacttttgttaattttctgtacattccatatccaaagtctggcactttttaaatcccaggcagaggccggacctaatctgtagattctagataggatcaacctggctctgcatcctttggtgttacagcaaatggagtacaatcaaaggagagtaccctcatagaggctgctctagaacattctaagtgataagtctaaataaaaaaagctgacatatcaagaatataagtagacagtttatttggtttaagcttaaggattataaccagggagcaaagattcaagttgcctgaaatctacactttgattagcagcagttacaagatttgtaaagacaagagagggacatagagtggtctgatacaaagttgtttgtcagaagtttttatttatttagataaataatattgattattgattagatatatatcattattgtttagggtatagaatatagtatccaatgtggcattgttaatttactttatagctacttgtggcaatagtgaacagtttcaagggatgaatacatagttcaaaggggagagaaagatgttaactgctctttcattttaacatctctctgagtttgataaccaaaagtgcttgcactttttagataaaagttttttatttcccaaatctcaagatctggattcaaaatatggagctacagatttaggtcctgaatggcaggagtagcagcaggtgttacttgcacattagtgagcatttcagcaagagtagaaaggggatagtggagactttcttgtctacatgtctactcaattcacatgttactccagttcagtttgttggccccacggtctctgaatctgtttaaggtctgaaaatacaagagtcattgaaagagaaaaaattattgattgcttccctgtgaaatttgtagaaatctgatctagtctctctagcagtgactgtaaaggactctagataccaaataggcagggacacaattctgccttcatatttaggggacagcatgcactttgctgcacaagtgtgagttgactggaagcctgagaggaatagtcccctctagagtaagttccggttggcaccttatttgtgtttatatcatgtctggtaattctagacagtgtttggaaacaataattaaaagacagattttatccagctccagagaaactccacaataatagaacagaaagaaaatggttttattacacaattgaacttgaatgtgacatgcatcatggtcagtctgcttaagagactgcaaagatagaaagatggtcaccaatattagtccccaagcagaagaatttccagcaccatgtcatacatagttcatcctaaattcacctggagattgaagaggccatctgtgtatactaattgcttatattcaatgacaaataaacttttcacatcttcataacaggaggtagtttagcagcttgaagccaggtgcctgctgaaggtagcctcttactctgctacaaaaatggttgaatagggttcttttttgctatttacattttagagctgtggttctgtactccctgccactgggctacagcactcctgcttgctttctcctggttgctagtatgctctcttgacctctaccatgtgccactgaggcacagcccagagcacagctcacattttatgtgaatcccatttgccacagcagcactttagtgtcacatcagatagtgaagcctgagctgcaggaggagagcctgcaggcctcctgggtagaattacacattcacaataatggaaatgagagcagtgtttcaacctcagtttctacttataatggtgacaaggaaaaaatactgctgaattttcagcatgactcaagatagagatagctccaaaagttctcactatgacagcccacctcattcagaaaaaaatgggatattaatagggtttctgaaacagacacctaaagctttggagagacaaacagatctccgtctgagcaagattgagagaaaaaagctaaaactatcttaagaaaaagctcagattagatgtaagattgatgatgtcagccagaaaatattcccctgaaagcaatttctctctaaacacccaaagtgcacagctactctctgcatgagaaacattagcattatgaagaaaggggcaaagtctcagaagaattttatagtttcttttctatctctgctgatccatcatctcctagtcattgaataggggttctgtattgaaatacatctgacaacttcccacaacaccttctgatgaagaaatagaatctgactgtgttcatttattggaatatattagaacttgcaacatagctaactgaagagctactatggtttttggtggccacatcacctgtctttatttgtcatgtaatagcagcataccaatttagtgaaataaaagatattaaaattttgtttactcataattatccctattgaataaagtaataaacatgtcacactaatatctacttactgtgacaatttggtaataaattttctttagatattagatataaatatcagtatgaataattttaataaactagtaataatatatgtagttttaaaaattgcaactatacttcagttaaaacactttatatttcaaaagtataaattacaatattaaaataaccatgtaagtgattcattcaaagtaagtattgcggctttatattcatgttactgtagaaaatactgtttatggctcatgccttgtccacacttcgggaggctgaaatgggtgggtcacctgggtcaaaagttcaagatcaaactggagaacatggtgacacccatctctactataaatacaaaaacttagtcaggaatggtgatgcacacctgtaatcccagctactcaagaggctgaggcagaagaatcgcttgaacccgggaggcagcggttgcagtgagccgagatcatgccattgcaccccagcctcagcaacagagtgagactctgtctcaaaagaaaaaaaaaaagagaatactgttaaatgtatataaatgcaggttgtctacaaacattacgtataactatgctaattattctgaagtaataaatagaaagcaaggtacaactactgactccactgttaagtttatacactagactgttcttgtttttgcagtgcaagtacttcagcctgcaaatattggataatttccttagatcatcaggtttctgtcaaagaaacgtagtatcttttattgtttaccattctgtgttactaaatttaatcctatctttgtgctaagcttttttgtgctctaaaattagcttttacctaaacaaatctgtgtctattttaaaggactaaaaatgaaaaaaataaagttttcagaaccaaaaacaaaccaataaatctgaagtaccagataacgataatctggagtcagaaaaatgacaaaaggggatgggcatggtggctcacgcctgtaatcccagcactttgggaggcagaggtgggcggatcacaaggtcaggaggtcaagaccatcctggctaacatggtgaaaccccgtctttactaaaaatacaaattagccaggtgtggcagcatgcgcctgtagtcccagctacttgggacgctgaggcaagagaagggcatgaacctgggaggcagatgttgcagtgagccgagattgccccactgcattccagcctgggtgacagagcgagactctgtcttaaaaaaaaaaaagaaaatgaaaaagaaaaaatgacaaaagacattatttagctgttaatatgatttacatacatttcaaaaaagcagagaaaattgtctatatataatctaaatcccttaagcaaagagggaatagcaaaatatttttttggaacttattgaagagttttgaactcttggacatctgaaatttgcacactctatgcacttgacagaatgtttatgaaggaaaaaccagaaaagagaaagatgttataaaaaaatccatgagtgcacaagaccaatgcaacagaatagagagcccagaaataatgccaccctcctacaaccatcagatttttgatgaagctgacaagagaaatgtgggaaggattctctatttaataaacagtgctggaataactacctaacattatgtagacgactgaagctagacctcttcattataccgtatacaaaaatcaactcaagataaattaaagacttaagtgtaaaacttaaaattatggcggggcgcggtggctcatgcctgtaatcccagcactttgggaggccgaggcgggtggatcacgaggtcaggagatcgagaccatcctggctaaaatggtgaaaccccgtctgtactaaaaatacaaaaaattagccaggcatggtggcgggcgcctgtagtcccagctactcgggaggctgaggcagaatggtgtgaacccgggaggcggagcttgcagtgagccgagattacaccaccgcactccagcctgggcgacagagcgagactccgtctgaaaaaaaaaaaaaaaacagaaaccaaccaaacaaaaaaacccttaaaattatgagaaaccctccaagataacctaggaaataccattctagacatagaaactggcaaagacttcatgaggaagctaccaaaagcaactgcaacagaggcaaaaattgaaaaatgggacctatttttcaattgtgaagatcttaagagcttcttcacagcagaagagattatcaacagagtagacaacctacagaataaaggaaaatatttgcctctgacaaaggtcgactttccagaatttattaagagcttaaacaagtttacaagaaaaaaacaagcaacctcattaaaaagtagacaggacgggcacagtggctcacgcttgtaatcccagcactttgaggggacaaggagggtggatcacttgagaggagttcaagaccaacctggccaacatggtgaaaccccgtctctactaaaaatatcaaaaattagctgggcgtggcggcaggtgcctgtactcccaactactcaggaggctgaggcaggagaatggctcaaacccaggaggtggaggcagaggttgcagccagctgagatcacgtcattgcaatccagcctgggtgacaagagcaaaactgttgcaaaaaaaaaaaaaaaaaaaaaaaaagtaggcaaaggctgggtgcggaggctcacacctgtaatcccagcacttttaaaggctgaggtgtgctaatcacctgaggtcaggagtttaagatcagcctgataaacatggataaatcccgtctctactaaaaatacaaaattagctaggcatggttgtgtgcacctgtaatcccagctacttgggaggctgaggcaggagtattgcttgaacctgagagtcaaaagctgccgtgagccaagatcgcaccattacactccagcctgggcaataagatcaaaactctatctcaaaagacaaaacaaaatgaaacaaataaataaataaataaaactaatgtagaaacagaaaaccaaatgcatgttattatttaagtaagtgctaaataataagaacacatgaacacaaagaggagaacaagagacactgaggcctagttgagggtggagggtgggagaactaagaggatcagaaaacatacctgtttggtactatgggtaggacctcaatgacaaaataatctgcacaccaaacccccatgacataattttagctgtataaaaaacccacacatgtacaccgaatcacaaataaaacctaaaagaaaaaaatactccaaggtgggggagagtgcaatgtaggtgcatggactgcttttcactatagatagtagcccaggtggggctgtactctgatttatttctgtgtgaatgcaggtagatgaaattacaaacaggtggcccagaccctaggctggtggagaaaacaggttgctgctgcaaatttagtatctaggggtggggatatgccaggagacttgtagagatttttgggttcttggcaagaaacactaggatcaaaaatgccatggtgaagttcttgagggtggtgccgagtcctgggagaagtgtggatacctcaatttctagtgtgtgtgtttgtgagtgggtgggaatcctgtagtagcagctgcaagaaaaggggtctgtcataagagcttcttctgagttttcagtcctctgtcaccctgggagaagacctggaatcacaggacaatgggcaatgtgacagcctgtgtacaggagagcagagcctcccatttctaaacacccagagctttgttccagtccaggcctctgtgatatcttttttctggcaccaaatctgtagagtttgctgagcatcaaacaattctccaacaactaattgtctaacatttaaattctgacaccacccagagtcagcacagaccctgattcagggctcagttccacaacattgtcctcactgcagatgccagtcacaaaccccatgggcccatctacgcttctgagctactgtttgaaaactggggactcccaaaacctccctgaagttcaatgatttggtagagctactcacagaactcatcaaaacactgtagttatgtttaccggtttaatatataagatgcagcccaggaaaagccaaatggaagaaatgcatagaacaaagaaaagagatggggaaagatgaaacacatagataatcatgaaaaatgtttgtgattaataaaattctccagccgggcacggtggctcacacctgtaatctcagcactttgggaggccgaggagggtggatcacgagatcagagatcgagaccatcctggctaacagggtgaaaccccatccctactaaaaatacaaaaaattagccgggagtggtggcaggcgcctgtagtcccagctactcaggaggctgaggcaggagaatggcatgaacccgggaggcagagcttgcagtgactggagattgcaccactgcactccagcccgggtgagagatcgagactccgtctaaataaataaataaataaaaaataaattgtccatcctttgtgtactccaggaacagtttatggaaacacccttcaccttatgacttcaatggtgctcttttttcttacctatcacacaggcaaacacactctctgcacattttctcctatttctcattataaaaatcagctgattttttcttcagtggtcaattttttttttttttggtgtgatcgagtcttgctctgctgcccaggctggagtgcagtggcgccatctccattcagtgaaaccttcgcctcccaggttcaagaaattctcctgcctcagccttcccagtatctggcactacaggcgcccgccacaacgctcagctaatttttgtatttttagtagacacagggtttcaccatgttgggaaggctggtcttgaactcctgacctcaggtaatccgcctgccccggcctcccaaactgctgggattacaagcgtgagtcaccacccctggcctaaaataaagtaattcttaatgaaatttacttaagtttatctccctccgtcaggctcctgaactttgagctaccctcggtctgagtcgacatacaaccccatttacgtccctcctaagaacatgctgatttcagggtaagacattctgtgatctaaaatctgaccttttcaccctccatttgccattcccttcccacctcctttctaatcttgtttaatcctccttaggaaagaaagtccttttgtgcctacagttttgcaagccacaaagaccttatagtaagttgatactttctcctattgcaatacttttttggaattcattgttttacataaatctaacgttgttatcttacaaagtctaaaacttgcctcaaaacaaaaacttcattatcagtaagaccctcccagtttcctttcatcttaatcttaactgcatctgcctgtggggctccagctttccagggctctgtagcttctctcaggataaaggctctttccatagctggggtgagcaggctgggacatctgcagggaagtctccccagcaaaaaaagaactgggcctttaataacctcctgttggccgagtgcgctggctaaagcctgtaatcccagcaatttgcgatgccgaggcgggcgaaaaacctgaggttgggagttggagtccagcctgaaaaacatggagaaacctcctctctactaccacacaaaattagccgggtgtgatggcgcaggcctgtaatcccagttactcgagagcctgtggtaggagaatcccttgaacccgaggtagaggttgcggcgagccgagatcgagccattgcactgcaccctgggcaacaagagctaaactccatctcaaaatttaaaaaaaacaaaaaacaaaataaaaacacctcctttttgcagccttaatattagccttagcttggaattactaggttcaagcttcagtttccatgtcagtgttattcacctggtttttgaaactaagtgtttgaaaaatccagtgaaattactcaaacatagtgtttacataaacggagattttaagatactttttaaaattttattaaacaggagtctcgctctctcatgcaggctaatgtgcaatgacgcgatctcagcttactgcaacttccgcctcccggtttacataaaggaaggaaattttaagatccttacttttttttttttgcgatggagtctcgctctgtcgcgcatattggaatgcgacggcgcgatctcggctcacggcaacctccggctcccgggttcaagcaattctcgtgcctcagcctcccaaggagctgggattacaggcatttgccaccacgcctaattttcgtatttttagtagagacggtgtttcgccatgttagccaggctggtctagaactcctgaccacgtgattcgcccgccttgctctttgaaagtgttgggattacgggcgtgagccaccgcgcccgaccaggaagtggttttttaaccctaaggcagttttgtttttgtgttcttcccctattgcctggggtcagaccagatcatctaaactgatcccgactggcttagaccccaactttttccaaataggataaacggagatttgcagggaaagaagagggaagaaggcgtagtattgatttacaatttttacaatttatgacctggaagttgagtctttcaagaggaacttagttgtcctaacaaccctttacctcaagggatccgcccgcctcagcctcccaaaatgtgggattacaggcgtaagccaccgcgcctggccccataaatttttaatacgagaaaagagaaactgtgaaccccacggaccaaagctcttcccattcgggaacccgcaccccgagtcaagattctcccctaaagaccctctcgtggttcctgcacaatctgggagatacccggagctgtgggtgcagagctgcccagagagggctccaggccggggcacactcgctgccaagggaagagtcaggacgcccgggaccggcttatagagcacccgccatcttttttttttttttgagacggagtctcgctctgtctcccaggctggagtgcagtggcgcgatctcggctcactgcaagctccgcctcccgggatcacgcaattctgcctcagcctccctagtagctgggactacaggcgcccgccatcatgcctagctaatttttttgcatttttagtagagacggggtttcaccgtgttagccaggatggtctcgatctcctgacctcgtgatccgcccgcctcggcctcccaacgttctgggactacaggcatgagccaccgcgcccggcggagcagcttccatcttatggatggtggggactaacgccaagctgggcaaggagaactcagggcacagattgtggagctgactgcggggagccctgagtcccgccactgccacttcccatcaaccagtccctcccctctctggggatgttggaccggtactcttaccatttctagacttctagggggtcctggctcttggctgtggatctcccaatacctgcaggtcaaagggcctcagaggctgggcctctatgagcagagaacacagagcagtgaacaagagatctggagctccagcggcagcaagagacaaaggccgcgccataccagaaagccgtcctcttcgctccagctgcctgcctgattggagggtttccagaccagcctccctgattggattatgcttaaggctctgccccctcagtacctgagtgacagaagatgtaatcagattctgggctgagtgaaggagtaacagcctaagatgcagcctttccagacagggcttcctccctgagctgagccaggctcaccccagagaagggaacaattctgtatcttttttactctctctgtttttgaatgtattcaaaaggtgagcaggagtatttttctgtcatatgaataatacataatatttttgttcaagagaaaatcaacttttactttggtaatagtgtattatcaatactaaagctaattttaataaaaccttataaataaatcaaatttgccacttttaacctctcgagatttacacatatattttgtaatctcttgtaatttttttaactttttatattttatttttatctacattctattttttcaatttgaaacaacctttaagtaatttcaaattgttgtaggagatagaaagaaatcatttaaggccaggcacagtggctcatgcctgtaatcccagcactttgggaggccaaggtgggcagatcactttaggtcaggagttcaagaccagcctggccaacatggtgaaacctaatttctactaaaaatacaaaaaattagctgggcatgctggtgcacacctgtagttgtagctattccggaggctgaggcaggagaatcacttgaatccaggaggcggaggttgtgtaatggcccaaggggtacaccttgccctttggtttagacagagctgatttatcaagacgggccttttgcctagacagagcctattaattaagacaggagaatttgtggaggaaaagttaaatattaaatttgaactcaattgaatgtggacacagacaatggtcactaagtcccagaataggttgtgtgagccccttgaggcatttatccagtgctgtattggagaaatctgtaattcaatctattcccatacatttattattgaaaaacaataggcaatcacaaaaacaaattggcctttttgtgttccttgggcctagtcttgaaaggctgtcataactgggccttatgccaaacaacttgctacaaaaagagctagggtcccagtgtagcaggacaagccacagacaaaacctctcagacatcgagttgtagaaggaagggctttattcagctaggagcatcagcaagctgctgttttaaaatccaagctctctgaatgcacaatttctgtcctttttaaaggctcacaacactaaagatttcacatgaaagggtcgtgattgatttgagcaatcaagggttacatgacaggggctgcatgcaccggtggtcagagagaaacagaacagggcagggagtttcacaatgttcttctatacaatgtctggaatctacgaataaaatcagtttttaagttatgagttgattttttattattaggtttaggccaggcaggcccagggctgcctgtctttaacttcacttccttgtttttttcttaaaacaggtactgagtataaaacaataaaacaatatgagtgggtctctctcttccctcatttcctctctttgagactctcacttttttattagtgggagttctcactcttatttttgctacttatgtctttttgtgcaatagattgatagtgatttatacagtatgcttgtgctgaagtattttggtgaactaaggtagcgacgaagttttttatcatttggagaaatacaggtatcagacaagggagcagtaagcaggttcctgttactattattactcttattataagagttttaaatcttcctatttctggaattaatttctaaacatggctcttggattgagtctgtgccacacttgcacgggtacatgtgctagttttgttatatctttaactatatcttcaactacttgcccctgatcatctgtgtgtagacaacaattagtaaggttaaattttctacaaacttctccttcagctgctagcaagtagtcaagagctagtctattttgatagacagcatttctcatcagagtccctcatggggcaagaacagtcaaggcttgaccagttttattagtaataatttttaaaaacagcttgtaaccctatgatttggttgagcctgtagatgggggctcgatatccttatgagccatcttgtgcctaagtggcaggtctatagtattgtatgattttttcagggggccattcattatctttctaatcacctatggctatgcttcatttttcatgggaagcatagactgggaagcctagaaattcacctgtttttatggacagcaagaagaaatggacagcttaatggtgccaattacacagctacctgtctactgatcaggtagcttagcataagctctgtgtctatagatccagtataacctggtgggggctgtccagtcccgtggaattctgggtggacttaacaggctgcaactttggaaatttactgaatggatttctttctgtgtaattggaacttcaccatgtaactgtttttgtggtattattacacagcttttgtcctaggcaactaagtcaacttacagaatgagtgaattttgttctttttctggatatgcaatattgtccaataattgagacttttagaacctagaaatgatcagggtgattcttttgggccaggaattcatcaggaactgggtccgtaggcactaattcttgggcttcttatggccattgatcttttattacagtttatttacaaacataacatgaagtgatatttagagattgggctacatgctcggctaattgcaaaaacaaatttttagtttttcctggaatctcaggtactggcacatttagttcatcatagaaagtctgaaatactggttctgaagagtgtttttgaacctccttttattagcatgcttatactaggatctagtccttttccatcaatgcctaatgttacattatattttttgttctactttgggtctgaggggtttgtgattatcgattttaaaaggttgcagctcctacttgtgcaggaggggctgacttttcctttttggagctaaacaggatcttttttatctttttttcaagtagcctaaatgacacaagactagtattgacacatcttagataaatatgattcttgacagatatatacatttttttttactgtgtaacttttttttctaatttagagaactgcatcttattccatgctgcttactatcaatagcgcacaagcaccaaattttaaggttacatttttggggacccctctttcttctgttctagctattactttacttgtgtcacttagaaaaggaccagtcctaaattttattttaaaaatgctgatcatgggaagcttaaaatgggtcataacatgcatcaggttatttcttgggctacataccttggatagaatagcattatacaaacaagtttcttttagagtcctggtacacctacaataactataaaataataggactgtagcaatcttttgtcttacttcagtgacttgatgtatatactggaaacagttctcagtctgaggaaggtcagttgaagtctttactgtacaagtccaaattttaaggaaaatgagtgctgcaatgagtttcttcatgctttggctatgtgtggaccagtcagcttctgggtgtgactggagcagggtttgtggtcttcttcagagtcactttgcaggggttggcgaagctgctcctatctatgtacagctcctagtctactgatttttaagggtagtctcggaggttgggcccactagaataaaatgagcctaatacttctacacagtttatgtttaactgggctctctgatactaggagtaaggtggcggggttagggtgttgcaatcttcaatggttgtgtggggattttcacagagcaagctttggtatctagttagtctagcattcattagctaatggtgtcctttggtatttattaaaatcaccacagcatggggggactttatgtttaggttttgtctaagagttagcttatctgcttcttgtggtaacagggccattgctactagggcctttggacatgggggctagcctttggaaacccaaactagttgttttgagagattggccactggccttggccagggcctcacagtctgagttaaaactctaactgccattttttttttctttctgacacatagagtgtaaacagttttgtcaggtcaggtagcctcagggctgtggctgacaagagttttttttttttaacttgtgaaaagctcattgctgttggttgtaatagatgtagtttatctaatctacatttttattgactgtcatctcctaaaatattgacttaaatcctgtaactatttgatttcaggctttaaattgatctggtattccttgcggggctctaattgcatctaaatagatgtgagagttgaaagacctataagggcttctcctgctttatgatgtcctattatttatttatttatttatttatttcctctggttgatgaaatgccagtgtgaaagggatagccaaatggactaaaacacaaatgccactctagttattcggcagagtgcccagtaaaggtctaccacaataccaccacacatccgctcaaggatgaagaagggctgactgattgataagctcttgaaaattcttaagctcactgtatcctttcaggtctctaaggaatgctaagtcttagtgttcctaagtgttaggaagtgaacttagtgttgggagatggaagctggatggccttcggggactgacctgcagggacttcagaatatagcagagagaacttggcatgacttattactctagactgtagaatcctggaaaagagctatcatgcagcctatgcctggtcaactggaggaccacattagtggaagggggacaatcagggcctctggcctgccatgtgcacaagcataacaattgcttttgtttaaggtgcagatggaatatgtgatctattttaaccaggaatttgcatcttggtatgctgtcttaattgccaaagtttgttttaactctttaacttttatgatcctctagtaaaatgaacgtctcctttagcaccaatttttattagtttttagactaaagaaagctaaacaccactttatatttaataatgtttcttgtatgatttttataccagataagctaaattttacctttatattagtgtgttattaatattaatcttaattttaacataaccttgtagacatatttatcaaatttttcatgtttgaccataagttaagattttatagactatttttaaccttttataatttttgttaaagagcaggtgatgctttaagaaaaacctgttgcatttttactttaatgtccagttcacagaaaaactggatgatactgttttaactttagctaatgtgttcacacacagaattttctttataattaacattttaaaacttgcttaaacttttaaaacaataatttttttaaccttttaatgttggtaaaaatctacattcttatgcccttttataatctttttactaaaggtatattttacttttcttatacactttgcacataaacttttttttaaatagtacttaggaggctttattacttttaaattatataacatttttgaataaatttttttataacactttttctttcacaactttcaccaacaattcttcaacatgtctcaactttttgacttattacaaacatttattttttctttaaacaactagttaatttatttcaggacaagaatttaccatataacactctttttacataaattctacctcccccccccctttttttttttttgaagataacaattcctttttttaaagcgaactttctttatgtctttggactagactgtctaaggccacaagattagaagttaccataatacacgttacactgttaacttttagcaaacttcacttttgttgaaaactttgtaagtttgggatttcatttaccctttgctattaataagaccttgtttagtttaaattaacttggaattggtataggtggcctttttttctctctgccggtctttccttgcctctgccagccgcttatgctgctgttctcttaattactgtaggggggaagagggtctaaaaccagctgtaactgtctatgtatggaaactggtctgggtgccttggcttgcagattacattgtgtcatacttttgaaacaagggacctgtccaggcttccttctgatggtcaacccacctctaatgctggccagtctatttcacacaaagttctaagttttcttggtgtcatagtaacactgtaatctctattaaatcttttcttgaaatttttttaacatagttcctaatggggtgggcttacttatgcctgacctatgcttctttgagacaaaacactatgcttacaccacacacacaccacaaaacaaaacaaaaaaaaaaacaggtaaaaagggcacacacacacttttgcagtttacaccaaactaaaatcaaaaccaaaatcagagtatccagaaatctaagccaggtcaaaaccaaaactaaagtatcatgcagtctaagtcaggtcaaaaccagaacaaaagtgccaatgcaggcacactgtgggtgatcaggccactcttccattcagatggggtggggcaagttccaaagactaatcttaccaagtcaagccaagtcaaaaccagaacaaaagtgccaatacaggcacactgtgggtaatcaggccacacttccactcagatggagtggggcaagttccaaagactagtcttaccaagttacagatgtccagactccaaatgccagttccttctgggtgttcagccactgtgttaatcctctgtggggacctgctactcgctgctctggtgaggtgttccgccagggcaatttcctacctgggagcactctttggatcatgtaactcaggctggctggagtcccccgcagagatgctccacagggcaggcttaagccacctgaggggctgcctcagctgcccatcagttacctcatttcccagtcagagaaccaagaaatgtagcaggacaatccgcagaaaaaaacctctcagacactgagttgtagaaggaagggctttattcagctgggagcatcagcaagctactgctttaaaatccgagctctccaaatgcacgatttctgtcctttttaaaggctcacaacgctaaagatttcacatgaaagggtcagattgatttgaacaagcaaggggtatgtgacaggggctgcatgcaccagtggtcagggaggaacagaacagggcggggagtttcacagtgttcttctatacaatgtctggaatctatgaataacattgatttttaagttatgagttgatttttaactactaggtttaggccaggcaggcccagggctggttttgggcctggcgccaggctgcctgtctttgatttcacttccttgtttttttcttaaaacaggtactgagtataaaacaataaaacaatatgagagggtctctctcttccctcaccagagggggccaaagttttatgagacatctcctcatctgtgcacagatgggtggcggactctggagtccaggctgttgcttcccattctagtggtgaatcttccatagtctggtgagtgtaaatatatatacatctctttttccttctcctattcccattgcaatttgcttttatcaatctgcttattacattgatttgcttattatatctgaattgccatttatgtgggataaagtttgtttacccttaaaggtattgtgtgtgtgtcttttcttctccccttctgtgtttcccacacagaacatttttgtcattacaaacagaaatcaaaaacaaaagtgtgctgcttcttggccagaaggacagggctgatggctacgggacttcccataacctgggatgagaactcccgcagttctccccctttgtgatcgaatggtccaggggaactgacctttgtgagaactgggaatcttaattagtgcaatttaaacctttgcctgtgcatgaagtgctgcaggagattccagtcagcaaaggagctgctgagttgatctcccggagtggatggtgtttgcttactgcttataagttaatgtatcaagacaggggatggttgctacaagagaaatgtaagctggaaaagaaaaatgctagtctgacttccagactggccctggcccaatgccaggcctatgtcttgactgatcaggctcaaagatatccacctattgatgaaaaaagcagctgtccaaatggccccatcatggtaaaactgaagaactagttagctaggcttggagcaggtaaaaacccagctactggccaggcacagtggctcatgcctgtaatcctagcacttttggaggctgaggtgggtggatcatgaggtcaggagattgagacaatcctggcaaacacggtgaaacccagtctctactaaaaaatacaaaaaattagccaggcgtggtggtggctgcctgtagtcccagcaacttgggaggctgagacaggagaatggcgtgaaccagggaggcagagcttgcagtgagcagagattgcaccactgcactccagcctgggtgacagagtgagactccgtctcaaaacaaacaaacaaacaaacaaaataagcaaaacccagctcctgtctcaaggatgggaaattaaccttagtaaaattcaaggacctgcacaaagtgtacaattccttgacatcttatggaatgcagagaaatagcccattttaccaaaggctaaggctaaaataccagaatttgcaacccctagcaccaaaaaggaggaccagaaatttattggtttgtttggattctggaaacatgatattccccacttgggtaacattttacaacctctgcatgtagtcactaaaaaacactatgactttcactggggagagaaagagagcatggcttttaacaagctaaacaagtggtgcaactggccctggatctgtggcccatatgggatgggccagtagaactgcaagtaactgtcccagatcaacctgctaatttgagccttaggcagaaacctttcgggtttgggacccagaaactgccagaggctggcaaagcttatacccctttgtagaagaaattgttagcttgtgattgggctttgctgaaaagagaacaccactgcttcaaccttgatgtctttatgaggcctgaaattcctatcatggcttggtgtcatgaattccccaaaacccaccagataggacatgcccaaggaagtagcatcataaaatggaaatggtacatacaagaccaggctaagccaaaaccaaaggggttatcacttttacatgaggatgtacgaaacttgtccgctcaaaaaaccaccaaactatcctgcagataggaaagaaaccccccccacaatccacccaaaggggccaatcttttaaataactaagcccaaatgatcagaaacatgcttaatttatggatggatccacaaaatacattggtgggacccaatgctggaaggctgtggcttctgttaatcctgttaaaacataagcattactggccagatgcagtggctcatgcctgtaatcccagcactttggtaggctgagttgggcagatcacgaagtcaggggttcgaggccagcctggtcaacatggtgaaaccccatttctactaaaaattacagaaattagccagggtggtggtgtgcacctgtaatcccagctactcgggggagtgaggcaggaaaatcactggaatcccaggaatcagaggttgcaatgaaccaaaatcacaccactgtactccagcctgtgcaacagactgagactcaatctcaaaaagaaaaaaaaaataacaaacaaacaaaaacataagcattcctgatgaaggaagtggtgggagcagccagttagctgaactagtatccatattctaagctcttcaggaagaggccagagagatctgtcacttgtataccgactcttggtcagtagcaaatggtcttactacctctatgctccaatgacaacaaaacaaatggctaattgggaataaaggggcttggggaaaacaatactggaaagatatctcaatcctggcacagactaccattatcactgttttccttttttttttttttttttctttaacgcagagtctagctctgtcaccaggctggagggcagtggcacaatctaggctcactgtcacctccgcctcccagttcaagccattctcctgcctcagcctcccaagtagctgggattacaggcacacgttgccacccccagctaatttttgtagttttagtagagacaggttttcaccatgttggccaggatgatcttgacctcctgacatcgtgatctgcccacctcagcctcccaaagtgctgggattacaggcatgagccatcgttcctggccctttttccatgttgatgctcatgggtctctgctttcttttgacagaccatttaattagcaggaagatcaacaggccaaaatttccaccataactgtaaacttgaatgtgcatgaatggaatacaatgtgttcaagccttgcaatgagaggcattataatgtatggtgctataattggtagtgattaccggggagagttaaaggacattttatacaataccactccagatttttttgctataagaccgcagatgcctgttgctcaattattagtggtaccttgtcaacaattatcccgtgaggaaatctctgccccaacagaggctacatacagaattgggggattcagatccactcctacaggtagcttaaatcctggagccaatatatggatacagggttcaacagatcctgcccctaaggctggtgaccttgtagctatgaaagcagaaaatgaaggcatagtacaatttcctaaagatgaaaaacaatatgttcccctctgtttttgttattacaaggaataacctatctactaatggtcagcacctgtgtctttgtgtctaaagccaagaataaattcatttactaggtagccactgctgcaacaaaagccaatcacagagaatgttggctgtacatcgagttgccagaggctgccaggaatgggctaccttgaagaatcgtccctgacaatatttctgaatggctatgtcgttatcaatggggccacaacaacaacacttgtaatccaacctggacttcctttcaccacactaagcaatctgtctttgcccaggtcagacaaaaggtgaactccaccctcaccttccatcaaaagccttggtattttgcccaatattcctggaacggtatatattggaaacctgctgtgctggtggctggattccacacagcccctgcttcatctggaggccttaaatggctcctctaatgttactctggggtttctccagacaattgtcaacacatactccaaatcaacaacattgcccccaatgaaccacaatctctttcctattttaataacacattagtacagtatgtttacagtaggtccatggctgtcccctggggggccctctgggtatgcagatcctgtgggtgttggtacctgcccccacactgggcagggagatcacttgtgggtggccattaattccattcaccatccgggataatatccccctcccaagtaatctggatgcttacaaacaccactggttatgaatgtgccggcctccttggtggcgataccttatcacagtattctcccctgccgctagaacaatcctgcttcaccaacaaattaaaatattaagcttatatgtagaaaaagctcttaatgatagtagcactggacttatgctgttatcagatgaatttgctcagctgcgtactgttgtgttgcaaaatcaaatggcattagatatgcttaccgcagcccaaggaggggtttgcgccttactgcatactggatgttgtgtgtatatccctggcaattctcacaatattagtctccttgcaaagccatgagtatgtttttttttttaaattgtgcttttaattctcctatgcttaccctgtatccataatctatgtcaactatgagttccccatgtatctataacggtattttaatacaattgagtaccgaattgaggccgaatgttgacgaaaagttaagtattaaatttgaactcaattgaacgtggacacaaataaaggtcaccaagtcttggcacaggttgtgtgagcccctttgaggcgttcattcagcactgtttcagagaagtctctatttcaatctattcctatatgttagttattgtaaaacaatagccaatcacaataacaagttgacctttttgtgtttcttgagcccagtcacaaagggccctcgtgactgggcttcatgccaaacaacttgttacaagaagagctagggtcccagaccacactaaagcttcaagaaacctctcctagtctgtgcaaggactgttggctgactctggagcccagactgttgcttcctggtctggtgataaatcctccatagtctggtgagtgtaaatatatatatatatacacacatatatatatatattcccttctccccttcccattgcaattttcttattatataaatttacttactatatctgcattgccatttacgtgggataaatcttgtttatctttaaaggtattttgtgtgtatgtcttttcttctccactcactcatttcctgcaaagaacaccatatttctcagagcctttgttggttcctttttattattttttctttaatcgtgtctgcatgccttattttagcaaagtggtcttcaaactctgatatccttcttctgcttggtcagtttggctattgatacttttgtatgcttcatgaagttctcgtgctgtgtttttcagctccatcaggtcatttatattcctctccaaactggttattttagttagcagttcctctaaccttttatcaaggttcttagcttcattgaattgggttagaacatgtttctttagctcagcagagtttgttgttaaccgtcatctgaaacctacttctgtcaattcatgcatctcattctctgttcagttctgtacccttgctcaagagacattttgatcatttggaaaagaggcactctggcctttcagccattttttgttgattctttctcatcttgagtttgtctagtttcaatcatttgagggtgctgacccttggatggtttttttttttttttggacacagtctctgtcacccatgctggactgcagtggcaccatatcagttcactgcaaattctgcctccaaggttcaagtgattctcatgtctcagactactgagtagctgggaatacaggcatgcacaaggatgcctggctaatttttgtattttttagtagagaggaggttttaccatgttggccaaagtattgggattacaggtgtaagccactatgtgcagccttggatgaggtttttgtgggtacttttttttcttgttgatgctgttgttgttgctttctgtttgtttttctttcaatggtcaggtccatcttctgtagggttgctgcagtttgctagggttcacttcaagccctatccatctggttcactcccgtgcctagagatgttactcaaggaggttggagaacagcaaagaagaatgtctgttccttcctctgtcatctctgacctcaagagacacaaatctgataccagtagaattgctcctgtatagggtgtctgacaattcctattgaaggtggaatggggagcagatggggagcagaacccatttaatgaagcactttgactgtcctttggtggagggaggtgttttgctgtgggaaaatccactcatctgggctgcttaaatccctcaaaactagcaggaggaaaggctaagtctgctggtccacagagactgcagccacccctcctgctagggttctgctctgatccttgttatttctttttttctgctgggtttgggtttggcttgttcttgttgctctagttctttgaggtgttatcttagattgtctacttatgctctttcagactttttagtaggcacttgatgctatgaacttcccttttaacaccactattgctgtatcccagatgttttgttagattgtgtcattattattgttcagctcaaagatttttaaaatttccatcttgatttcatacaacaatcattcaaaaacaggttgattgtaaattttatgttttatttaatttccatgtatttatttaatttccatgtatttgcatggtttgagggttcatttggagttgattttcacttttatcccactgtagtctgagagagtagttgatataattttgattgttttaaatttattgagacttgttttgtggcccatcatatgtctgtcttagagaatgtttcatgtgctgatgaataaaatgtatattctacagttgttggttagaatattctgtaaatatttgtcaagactgtttgttctagattatagtttaagtcctttttttgttgttgttgtcattgactttgtcttgatgacttgtctagtgctgtcagtagagtattgaagttcctcatcattattgtgttgccatttatcccatttcttaggtctagtagtaattttttaataaattgggagctccagtgttaggggcatatatatttagaattgtgatattttcttgttggactagtccttttatcattatgtaatgtcccactttgtctttttctttttttaagtgtttttgctttaaagtctttttgtctgatgtaagaatggctactgttgcttgcatttggggtacatttgcatggactatcttttcccaaccctttaccttaacttcatgtgtgtctttgtgtgttgggtgagtctctggaagacagcagatttttggttattaaattcttatccattctgctattctgtatcttttaagtggagcattaaggccactaatcactatcaattatatcaccatacattataatgtctgtcattgcaaggcttggaacacatagtaatccattcatccacattcaagtttgcagttataataaaaattttggcctgttgatcttcctggtgattaaatagtctgtcaaaagaaagcagagacacataaacatcaacatggaaaacagtgataatggtagtgtgcaagaggattcagatatcttcccagtattgtttaccccaaacctctttattcccaattaaccatttgtttcattaccattggagcatccaggtagtaagaccatttactactgaccaagtgttggcatacaagtgacaaatgtttctgacttcctcctgaatagctcaaaagacagctaactgggagctaactggctgctcccacccctttcttcatcagaaatgcttatgtttttaacaggattataggtcatggccttccaccatcaggtcccaccaatgtatttggtggatgcatcagtaaaccaagcatgcctgtgatcctctggacttagttctttaaaggagttgccccattgtacaagggaggtttccttgcctatctgcatgactttgttggtggtttactgagctgtcaagttttttacaccctcatgtaaaagtgataacccctttggttttggcttagactgatcttgtatgtaccatttccattttatgatgctactttcttgggcgtgccctatctgatgagattgtgtggaactcatgacccaagtcatagtaggaatttcaggtctcataaagacatcatggttgaagcagaggtgttctgtttccagcaaagcccaatagcaagctaagaatttcttcttgaaaggagtataaggttttccagcctctggcagtttctgagtccaaaacccaaaaggtagcctcttcccatcttgtttctgcctaaggctccaattagcatgttgatttaggatagttacttgcagttctactggcatatcccataagggctatggatccagggccagttgacttgcttgtttagcttgttcagaagccatgctctctttctctctccagtgaaagtcatcgtgttttctagtgactgcatgcagaggttgtaaaatgttactcaagtggagaatatcatgtctccagaatccaaacaagccaatacatttctgggcctccttttcagtggtaggggttgcaaattctagtatttcatcttagcctttggtaaaatggatgatttccctgcattccataggatgtaaaggaattttacactagatgcctgtccttgaattttactaaggttaatttcccatccttgagataggagctgggtttttacccactctaaaccccggctgcctagttcttcaattttatcctgatggggccactgggacagctgcttttttcatcaataggcagatatttctgagccttatcagtcaagacacaggcctgacatggggccagggccagtctggaagtcagattagaattttccttttccatcttacgtttctcttgtagcaaccatcccctatcttgatacattaacttataagcagtaagcaaacaccatccactctgggagatcccatcaccatctcctttgctgactggaatcccctgcagcacttcatgcacagtcaaattttaaattgcgctaatttagattcccaattctcacaaaggccagttcccctggaccattcaatcgccaaagaggaaaactgggggagttcccatccctggatatgggaattcctcgagtttccatccctgtccttctggccaaaaagcggcacaattttgttttcgaattctgtttatgatgccaaaaatgttctgtgtgggaaacgtgaaaggggagaagaaaagacacacacacaataccgttaagggtcaacaagttttatcccatgtaaatgggaatgcagatataataagcaaatgatataataagcaaatcaatgtaataagcagatttatataataagcaaattgcaatgggaagaggagaagggaaaagatatatgtatgtgtgtgtatatatatatatattgcccaccagactatggaggattcaccagcagactgggaagcaacagtctgggcttcagagtaagccactagtctgtgcacagatgaggacaggtctcatgaagcttcggcacagtctgggaccctagatcttttgtaactagttgtttggcctaaggttcagtcatgagggctgttcgtgaatgggctcaagtaacataaaaaagtcaacttgtttttacaattgtctattgtttttgaacaactaatatataggaatagatttaaatagagatttctccaaaagagcactggattaaagcctcaaggggctcacacaacctgttctaggacttgttgatcattgattgtgtccacgttcaaatgagttcaaatttaatatttaacttttcctccacaaattcctctgtcttgataaattggctgtgtctaggccatgggcaaggtgaaccccttggacagttacacaactctgccctctgggttcaagcgattctcctgcctcagccttctgagtagctgggactacaggtatgcaccacaacatccagctaattttttgtatttttagtagaaatggggtttcaccatgttggccaggctggtcttgaactcctgaccacaagtgatctgcccaccttggcctcctaaaatgttgtgattacaggtgtgcgccagtgtgccctaaataatttcttttttttttttttttttttgtatttttagtagagacagggtttcaccatgttggccaggctggtctcaagctcctgacgtcaggtgacccacccacctcagactctcaaaaatgatttctttctatctcctataacagtttgaaattacttaaagtttgtttcaagtagaaaaaataaaaagaaagtgaataaaaataaattgtagagttaaaaatattagaagaaattacaaaatatgtatgtaaacctggagtggccaaaaatcatgaatttgatttatttataaggttttattaaaattagctttagtgttgacaatacactattaccgaagtaaaagttgttgaatacattcaaaaagagagagagtaaaaaagagataggacccccattcaatcgctaggagatgagacagcagcagagatggaaaagaaactttataaaattcttctgaaattctgccacctttcttcatattgctcatgtttctcatgctgagagtagctgtgcactttgggtgtttacagagaaatttcttttaagggaatatattctgactgacttgattaaacttacatcttgtcagagctttttcttaggatctttttaactttcgtctctcaaaataatcttgctcagatggagatctgtttttctctccaatgctttttctgtttcagaagccctattagtatcccatggtgtctgaataaagtgggctgtcacagtgagaacttttggagctatcactatctagagacatgctggaaattcagcagtattttttccgtgtcacaattaaaagtagaaactaagcctgaaacactgctcccatttccattattgtgaaggttcaattctatccagggggcctgcaggctctcctcctgcagcttaggcttagctctctgatgtgacactagagtgctgctgtggcaaatgagattcacataaaatgtcagctgtgctctgggctgtgcctcagtggcagatgatagaggtccagagagaacactagcaaccaggagaaagcaagcaggaattctgtagcccagtgccagggagtacagagccactgctctaaaatgtaaatagccaaaaagatagaacactattaaaccatttttgaggcagagtgaaatcctaccttcagcaggcacctggctttaagctgctaaactacgtcctgttatgaagatgtgaaaagtttatttgtcgttgaatataagtaattagcatacacagatggcctcttcaatctccaggtgaatttaggatgaactatgtatgacatggtgctgtaaattcttctaattgtggactaattatggtgaccatctttctgtctttgtgatctgttaaacagattgactatgatgcttgttacattcaagcttagttgtgtaataaaaccattttctttctgttctattactgggaagtttctttggggctggagaacgttttttttctgtttcttttttctttttttcttttttttttttttttgagacagaagtctcactctgttgcccaggctggagtgcagtggtacaggtgtgagccaccacacccagcccgatttttctgttaactattgtttccaaacactgtctagaattaccagacatgatataaacacataaaatgccgaccagaatttactctagaggggattttccttctcaggcttccagtcaacttatacttatgcagcaaagtgcatgctgtcccctaaatacacaggcagaattgtgtctctgcctatttggtatctatagtcctctacagtcacttctagagaggctagaccacatttctacaaacttcacagggcagcaatcagtcactttacctctttcatggactcttgtatgttcagacctgaaactgattcagatactatgaagcccagaaacttattcagagtaacatgtgtgcattgagtagacatatacacacgagaatctccactttccccttcctcctcatgctaaaatgcccacaaatgtgcaggtaaaacctgctgcgactccagcaattcagaccttaaatctacagctccaaatttttaatcaaggtcttgagatttttatcttaagttccattttatctgaaaaatgcaagtcttttggttatcaaactcagagagacattaaaatgaaagtgcagttatgtatttctcccccctttgaactatgcattcatctcttgaaagtgttcactattggcacaagtagctataaattaaacaataatcaatgttatttctgtaaataaaaatttctgaaaaacaactttgtatcatcccagtccctgtctctctcttgtctgtagaaatcctcttttaactgctactaatcaaagtgtagattccaggcaacttgaatctttgctcccagattacaatccttaagttgacccaaataaactgtctacttatatttatgttgtgtcagcttttttttcttttctttgaggcagagttttgctcttgttgcctgggctagatggagtgccaaggccctgtctcggctcactgcaacctctgcctcctgggttcaagtgattctcctgcctcagcctcccgagtagctgggattacaggggcctgccaccacaccaggctaaattttgtatttttagtagagaagaagtttcaccgtgttggtcatgctggtctcgaactcctgacctcaggcaatccactcaccatggcctcccaaagtgcttggattacaggtgtgagccacagcacctggctgcttttttttttttaatgtacacttatcatttagaatgtgctagaggggcctctatgagggcatctctcctttgattgtactcctcttgctgtgacaccaaaggatgcagagacaagtttattttacctagaatctgcagataaggtctggctactgcctgggatttacagaaaagggccaaactttggatagaaaatgtacagaaaactaacaaaaggcattttctgcattgtgagatgtcaacatagatatcttacagcctccatttgggagtgtggaattatgagatttttcacatcttgttcattgacctgcgacagttatgtcagagtatccaggaggaaatagcatctgatggcagaatctgtaagtgtaaataagcatcttaggagtaagagatcaaggccacaaagtatccagagctataaccacaactatgtttacctgtaaaatgtgatttttgtattttacctgtaaaatgagtatttttttctttcttttatgcaagagctagcaaatcaggacaggtaatccaggttctggagctccagcaaggcagtttcattttctatttagaatcagcctgagcctctcccgactggattatcattgggctatcagctcagggtcactgggaattccttcaaaatcacctagatgtctttgaggtatttgaggatgtccagagcagaattgtgtcaggctgagaagagtggctaattctgtttctgtcttagtataagagaaatgaatcatcctgtgtttgttcctcccctcatacaagaggtgtcttcggttggtacccagatgagaatttctccagtgtcctggtatttggatgataaacaaggagtaaatctggaggcccaaatagataaactagtttcttccattttatatggccgttaaaaaaaatacatgaagcagtcatggttcctacaatccagaaacttttagtctagactagcaactggataaaaaattgaattgtgcatcatatggttggtccaacaaatagatgtgtccaaaatcttgggctttatttaggccactttctttatattgttgtgacttctgatgtctacatctgaaggcatacttatgaacagccttgttattataatttctttttcttgagaccgagtctgttgcctaggctggagtacagtggtgtgatctcagctcactgcaacctctgctgccctggttcaagtgattctcctgcttcagcctcctgagtagctgggattacaggtgcctgccacctcacccagctaatttttgtattttaggtagatatggggttttaccatattggtcagtctggtctcaaactcctgacctcatgatccactggccttgggctcccaaattgctgggattacatgtgtgaaccaccatgcccagccttataatttctatttcttttactttgcttagtgtacatatttattttctaataaaatttccctagaaaggccaggcatggtggctgaaacctgtaatccaagcactttgtgggggcatagacaggtggatcatgaggtcaggagtttgagaccagcctggccaacatggtgaaacaccgtctctactattaatacaaaaattagctgggcattgcggtgcacacctgtagttccacctactctggaggatgaggcagaagaatcacttgaacccaggaggtgggagttgcagtgagctgagatggcaacactgcactccagcctgggcaacagagtgaaactccctctcaaataaataaataaataaataaataaataaataaataaatgaaaaactagcctagaaaaccttaagggatttgtttaaattgcatattagtacatagtataaagttgacaaagcagtgtctagaaaagattaaaattacagaatctctgggatttaagtttcttttaggtaagcttagaaaaaacaaaactggtggtacttcagtggcatggagaacagaattcaacatagggtcctcactgcagtgtctcagacctgttcagatttatcctttttggaggccttatttaggtctgactgtaccttggagtctggcctcacagaactgagtagaagagatcagagttttggctggtgaatcctgctgtctttctagagctggtgttcacaatttcctgaaacccaaaagcagataaatgggaaaaataaagaatgtattttagggtcttagtttttaaaggctctattaaaaccagtgcttggagagacattctatttagcaactggttttttcccctgcagatccagtaattgctccacaagtcacaaaaaagtaaatataaagagaataaaattttctctaaactacgttaaactcttcctttattatatctctttcacctgtctgtatttagcttttattctgtacaattttattaaaaatttgagaaagagaaatagaagaagaaataaaaatgctgggccctttatctaaatcctggaaattattaaacactgagtaccagccgggcgtggtggctcttgcctgtaatcccagcactttgggaggccgaggcgggcggatcacgaggtcaggagatcgagaccatggtgaaaccctgtctctactaaaaatacaaaaaattaactaggtgctgtggtggatgcctgtagtcccagctactcaggagactgagacaggagaatggcatcaacccgggaggtggagcttgcagtgagccgagattgtgccactgctctccagcctgggcacagagcaagactccatctcaaaaaaacaaaaacaaaaacaacaaacaaacaaacaaaaaattgagtaccagatttcagggcattatgagaattaaatcacataatatgttatgcccagtacagtcctctgtatcctagttttgagcacatagtacctgtttaataagcattgtattagtacatgtgtacatgctgttttttaaatccagacttattcagacattactgccttctgtttcctctgtaaactttaaagagacagcaaagaatataaaactttaggatggagatgggttgtccatatttgtacccagaagtgtttgattgcgacaagagtgctgagtgttaagagaccatgggctgtgcctgctttctctaactaatgctagtaatgagacaaggggaagcaacatcagcactgacaggggacttgtttaaaatgcccattcatggactcttttcaaacctgcagaatcacattacataaagtggggccaaaattaccaagtcatttataagctcgttaaagcctgagaggcaatgcttagcttagtggttatcagcccaggcttctcattaggatcaaatggctaatttgcagaaatctcttgtgccctccccacagcttctgtttattgttgtgggtggaaggatccatgtttttgagtgaagggcctcatgtgactctaaggtgaggccagaatcaagtatgagggtttcaaaatacattcatgagcattaagttccatctttgcactaaacagcagtcacaggggtggtgctgtttggatttggtagggaaaggtcagtgtggcacatatttgcattactgtagcagaaattgctggtgtctctggcaggggagggcacctgaagacagaaaaggagaaatttatatttttatcttcatggagcagctcattattcctgaacttcttctgttttaaatgacagaaatgggtggactttttctgtctttttctgccagttgatgtcatgctagcaggtaaacatgtggtactgacacctttaaaggcatattctccatatgcaggtgtaatttgttcagagagtctcatctgagaaggaattctagagaaggaggagaaagaaaaaaaatggcttttcttcaggtaaacatgtgtcagatgaagagctatgtccactctgcctcctggactgccatgcatttagtacccacaaacctttacttctctacttgtgtttttcctccctaatgattttgatttaactacttcttaaaattcttatgatagtcaagggtctctgaaaaatatttttttcctatatcccagagccctccctacattctctacatcatagcttcttatatgtcatgcaggattatcagcaagaatttatgatctgcaatattaaaaatattccctttgtggctgttgaacatgaaaagatgtggatactcaagatttctactggagaaaactgtggtacttagtaaagatggagaacatgtaatgttacggctccatctgtgtgttccattagctctatgcagaagaagattaagaaaatccttatttaactgggatgacatttattactcagaaagttctgaaaaaaaattaggagatatctgctctctagggtggcaaatgaagcctccttaaaattactactaacaattacagaacataggagttatttgtattttgaagtttccataaaactgatgtttctttatggttaaattcagattctatttacttttttggggaaagaatatttcaacagtgatgctgtgttctcctgtgtgcattagcacgtcataaaaatttgtcctcctgcagttaatgattaatgaatcacttagtgaaattgctgacagatttttttttactatggagttaattagttttctctttattagtaagtatctttatgcagctgatgtgcataaatgatcacatttaatctggcagctgtctttttttcttatgtttttctacatatttttctttggtaaatgaaggctcttagttttgtttacaggcttgaaaaactgggaaaaataccgactcttgcacttactgaatatttgacaaaatatccttcttgggacaaaaacattggcattactggtgagcttgttagaaattcaaaaaattggctgagcatggtggctcatgcccgtaatcccagcactttgggaggctgaagtgggtggatcacctgaggttgtgagttcgagaccagcctgaccaacatgtagaaaccccatctctactttaaaaaaaaaaaaaaaaaaaaaattagccaggcgtagtcacgcatgcctgtaaccccagctacgcaggagacaaaggcaggataattgcttgaatccgggaggtggaggttgcagtgagccagatcatgccattgcactccagtctcagcaacaagagtgaaactctgtctcaaaataaatacatttaaaaatcagactttataccagatcttctggaaaaaaaaaaaccctgcaaaacaaggtcttcagcttattctacacatcaaaatttgagaggtgctttctaactcaacatgtcttttccatctgaaaaatattcacaagtcattttgtatgatgtaaatatagcactcaaaaatatacatgtttgtgttcatgtccttaattttatactttattatccagaaaaatatcattatatgaactgatcttgtggatattatgctgctcttttttctcagagatagagaatacattagaaaatatttgtgttgaaaattattttattggataattttagtcagtcctataagtcagaatgagtgctctttactctctcatttcaccttaagtcaaattaaaaattccgctcatggcaacttagtaaaaatgtgtgtgtgtgtgtgctttacagtgaccactgcaatttagggatgtggctatagaattctctctggaggagtggcattgcctggacactgcacagcacaatttatatagggatgtgatgttagagaactacagacacctggtcttccttggtgaggataacttgagtacataattcataatatatcctaaagattttatttctctttttatttttattttttgagatggagtctcactctgttgcccaggctggagtgcaatggtgcaatctctgctcactgcaacctcagcctcctgggttcagtgattctcctgcctcagcctcccaagtagctgggattacaggtgactgccaccacgctcggctaatttttgtatttttagtagagatgggatttcaccatgttggccacactggtctcgaactcctgacctcaggtgatatgcccgtcttggcctcccaaagtgctggaattacaggcataagccaacatgctcagcctatttctcttttttgtagaatgtttttagacctttattctttgcataaaaaactttcagatcccctttttccagaaaatcttcaaaatttgttcatttattaaagaatttcttcaagatgtttcatcttaatccaaactttccacattcctgagttgagctgtattcttcactctaaattagtggtaattccagaaatttagtggcataaaatatttttgtccccacctgaaaatcgaattgccaccaccaatttttgattcagcagtaccaggtagtaaaattaagaaacccacaaattgaaagtattttctaaatatttagaaatttctgttataacttagtattttgctattaatttgctagaatattttatcacattctctctgctgagcacattactagcttgtaattggagaatatgagaaaaatttatgtatttatttttaataaaacaggtattgttgtctctaacccagacctgatcacctggctacagcaaggaaaagaaactttgaccatgaagagacaggtgatgattgccaaacacacaggtaggtgttttttttgctctcacaaaggggcatcttctgtcttatgcttttaaattctctaaggattctgcttttcttttggtgagcttccttcaagttcacagtgagagccaatgtcctcttcatggcatagaagagactgcacaatctgactgcttttccattattttggggacacacaaatatctgcatgatgttgagaaactaaaactatgttttaagttcccttttttcatcaggtttgaaatgtgtgaaagtagtagtttctgttgcatttttttgttcatttttctgcacagtccattctgtttttattattatgtggccttgaaatatagtttcaaattataagtatgatatccttctgctttgttctttgtcttcatgattgcttcggctattcaaaatttattttagtttcatgtaaattttagaattgtattttccattactgtgaaaaaaaaccacagcaattttgataggaagtttattgaatctatagattactttggataatatggcactacaataatatttattctttcaagccatagacaaaatattttaaaatttatttggatcttctctaatttatttatttttttattgtaaaaatgttttacctccttggttaattttttcctcagaaatttactaattaatgctctagtaaataaacgtttttctttatcagacagtttaagtgcatgaaaccatacatacacttgtatgttaattttatattttgctgatttactgagtgtatttattagtttagataggctttaatgtactgtttatagttttttaaatgtatgattgtatgacctacaaacagcaactttttactcatttttcaatttcaatggttttttttaaatttctttgactaattcttctgttacatacttccagtgctacattaaaatagaagaattgacaaagggcacaatatagttttgtattggtgtctgaatttgatggagcagacacctcttcaagtttttgtaaactgattttagattgtaaagatcttcttttattggttccttagggtgatgagatgccatctgaatttgtagtgaagagggattgtagcttggtcacaaggctgctaggtctgcactagggttcacccttagttggcttgttacaggggcttgggttgttgtaattcccattttatttttggacagactaaatatccttcagtacttttctcagtagggcaggcactacagcatgtttttgcagtcgagtctgcatatgctgggccttaaatcaggatgtggatgagtgtggctttcatgagtatgagagagcatttcctcaggtaactgtgtgggtttctatgcaggaagaactgatcataaactgtggctcaggtaactgaaactgagtcattgaaccacttcagggacctgagtaaaggccaaggtctgcagacctgcctgcatggctgtaaataggtgccttcctctgggtctctagaatggcaggacctctcccagacagtggctgggaggagtttgggacggttatatgataagttcagaattctcagaatctcagtttgggaccaagttgggtgaactctatcctggtctgtagccataaacaggaatcctgcactttcccacctaattgagggcctgctttctgagtagaacacttttcaatcctaagctttaacagagtttcatcactccttccctggatctcaaatctctcttacaggcacttattttggagatggggtcttgctacataacccaggctggtctcaaaattctggcctgaagcagtttttccaccttaatgtacgatgtagctgtcattacaggtgtgagccataatgcctggttctctcataaaggcatttttgtcagggatggctgacattattttgctgtaaggggatatgaatgtaggggacttttaatcttttcatcttactgatgtcactctccctatacatttttactttccattttctatttcaaatttttctgtaattttagattcagatatttaggacaatatgctagaatttgcatggtatgcctgatgtagttagaaaattagtaggtactccatatttactaaaagagttacttataaatgtaagtttgctacaggcaaaaaagaattataggattttcatctactttcttcagcctatatataaataataacatagtttatttcccaatatttgttttacatatcagaggatctaattctattctgcaatatatacatgtatattttctgtctttaacaatgtaagactattctttgcttctaaagttagaatacagcagtttcattttgtgtaagaataacatattcaaaacataaaactaactctagtttttttaaatgcttatttattaaaagtttctcattagaatcttctatttatgattatactgcatattttctgaaattttactgccacacagtgcatgccaatgattcaaaatacctgcatttaatgagtacacagtaacagctaaatattgcagttacccagacaaatttttttaaattatttttttgagatggactcacagcctgtcacccaggctggagtgcagtgctgcaatcttggctcactggaaactccacatcctgggttcaagcagttttcatgcctcagcctcccaagtagctggaattacaggtatgtgccaccacacctggctaatttttgtatttttatgtgagatgaggtttcatcacgttggcaaggttggtcttaaattcctgacctcaggtgatctgcccgcctcagcctcccatagtgctgagattacagatgtgagccaatgcacccagcctgacaaattctttttaatgatacatcaatgttgcataccaggttttatgagtaaactcttctcttattattgttttgaagtttcacattagtgtgtttctttaatgaaggtttctgtttttttgggggggacagagtctcactctgctgcccaggctggagtgcagtggcatgatctcagctcactgcaacctctgcctcccaggttcaagcaattcttctgccacagcctcccaaattgctgggactacaggcttgtgccacaacatctggcagatttttgtatttttcatcgagacagggtttaaccgtattggccaggcttgtctcgaactcctgaccttgtgattcatctgcctccgcctctcaaagtgctgggattacaggcgtgaacccccgtgccaagcctcatttatatttcaaatagggtctcacttggttaaccaggctgatttgcagggctcactgctgcccgaacctcccaaactcagatgttcctctcacttcagcttctcaaatagctgggttacacatttttgccgtcacacccagcttgcttttttgtattttttgtagagacagagttttgccatttgcccaggctcctgttgaactactgagatcaagtgatcagcccaccttggccttccaaagtcctaagattacatttcattttattaagtagtttaattaatttatatttaaaataattgcttaaaaaatgaagttgttattaccagttatactgttattgttttatgtgtttctagtagttatatttttctcattttctgttttactttcttaattttcacttaatcttgtactagcatgctttgattatattttgttttcttttgcatactttctataaatattatctttgtaatcagcttgaaaactgaagattacatacaccttaaagttaaaaaacaatatattttaatcttataacggcctccattgaatacaaaaactatgcttctgtattttccagtttgttgttaatattaaaattattattattattttttgagatggagtctccctctgtcgcccaggctgtagtgcagtggaacgatcttggctcactacaacctccgtcgccctggttcaagggattctctgcctcagcctcctgagtagctgggattttaagctcctgccaccacgcccagctatttttgtttgttttagtagagatggggtttcaccatcttgaccagtctagtgttgaatgcctcacctagtttatatggtgtatctattcacagatttatgcggatttacatattgttttttatattccataaaagcactttaaaggttttatgtaccatcattttggtttttttgttttgttttgtttggtgtgggattatttttttcagactgagtcttgctccatttcccaggatggagtgcagtggtgcgatcttggctcactgcaacctccacctctcggcttcaagcaattcttcttcctcagcctcctgagaggctgggattacaggtgcctaccaccatgccctgctaattgtttgtatttttagtatagatggagtttcaccatgttggccaggctggtctggaactcctgacttcaagttatctgcccgcctcagcttcccaaagtgctgggattacaggtgtgagccaccacttccagcctgtaccatcattttgatagtaaagaattccatatgtgtccatttatttacattagtgtatagctttatatttatatatgtttttatgatgctgtccagggtcaatttgtgtttcaacataatggacacattctaacatttctgtatttttagatatagaatctcattatgttgttcaggttgatgttgaacttttggtctccagtgatatgactgctttggcctctgaaagatgtaggattacagacatgaacaattgtgcctgagcctcttgtagtatttttttttacttttttttttttttgagacggagtctttctctcctagctcaggctaaagtgcagtggcacgatcttggctcactgcagttttcgcctcccaggctcatgcgattctcttgcctaagcctccctcccgaggagctggggttacaggagcatgccacaatgcgcagctaatttttttttttttgtagttttagtagagatggagattcaccatgttggccatgctgctctcaaactcctgacctcgggtgatctacccgccttggcctttcaaagtgctgggattacaggcttgagaaaccgtgcccggcttttatttttttaaatttttttaagagtgagtctcactctgtctcccaggctggagtgcaatggcatgattttgactcactgcaactcccacctcctgggttcaagcaattctgcctcagcctcctgagtagctgggactacaggtgtgtgccaccatgcctgggtaatctttgcatttttagtagaaatggggtttcaccatgttggtcaggctgatctcgaactcctcacctcaggcaacccacccaccttgacctcccaaagtgctgggattacaggcatgagccagtgcacccaggcccatgtattatattatgagagacagtgatagttgtgatgaatactctcaccttttattttggaaagtctttatttttatcttctttttgaagtaaagtaattttgaatcgagtattgttagaaattttttttgttacatcaaaattggggaagttttcagtttttttaatcttcgtgtaacctctatattactttttccctatattctaagatttgtttcatgaatacattgatctacttcatggtatccaataagttttatattctatgttttacttttgttccacaattttatatttttgtgttatatatattttgggtatgccacatcacaccagttaattgtattttaattttttagtttatattataattgtatatgacaatttttaactctgtacaatttaagacagtatggagcaaaattaaatatgaataagccatatgtctattgccaatataattatttatatgtttgtttgcctggataaatattatctttgtattttttgtcacttgtatatttattgtgtaggtttgctgtaacagttttttttttttttttggaagagaggtttgctcttgttgctcatgctggagtacaatggtgtgacctcagctcactgcaacctccgcctcctgggttcaagtgattctcctgcctcagcctcctgagtagctgagattacaggcatgcaccaccatgcccagcgaattttgtatttttagtagagacggggtttctccatgttggtcaggctggtcttgaactcctgacctcaggtgatctgcctgcctcagcctcccaatgtgctgtgattataggtgtgagccaccattcccagtctgtaacagttttttaatcctgtctaggtgagtagtcataaaaattctcctgatttcagcatttatttatgtgtgaatctatattttttcggtgggggagaaacacctaaagaaatgtgttatgtgtcaaaaacacataacaaaatttacaataaaatatttctaggctgggcacagtggctcacacctgtaatcccagaactttgggaggccgaggcgggtggatcacgaggtcaggagattgagaccatcctggccaacatggtgcaaccccgtctctacaaaaatgcaaaaaattagctgggcttaggtggcgggtgcctgtaatcccagctactcaggagggcgaggcaggggaatcgcttgaacacaggaggtggaggttgcactgagccgaagttgtgccgctgcactccagcctgggaggaagggtgagactccattttaaaagaaaaataagtatatatatatgtatataaatatatatatgcttctaaatattcagtttggtcatattaattctgttgacattgttatgcaacatatcactagaatatttttatcttgcaaagctaattctcaatagtcattaaacaactaccaattctagggccgggcgcggtagctcacgcctgtaatcccattactttgggaggccgaagcaggcgaatcatctgaggtcaggagttcaagaccaacctgaccaatgtgcagaaaccccgtctctactaaaaatacaacaaaattagccgggcatggtggcgcatgcctgtaatctcagctacttgggagcctgaggcaggagaatcgcttgaacgcgggaggtggaggttgcggtgagccaagatcgcaccactgcactccagcctgggcaacaaggtcctaactcggtttcaaaaaaaaaataataataataaagaaagaaagaaacaactaccaattcttctcattttgtggtacttttcaaacaccactctgttttctgtttctaagagtataattgctttgtatatctcatacaatctctgtctctttgtggatggcttattttattttgcataatgtcatcaatatttatcttaatagttgttagaatattttctgctttttgaaatctgagtgatattccagtatttttatatctactgaatgatttggagacagaaatttgcattgcttttacctattggcttccagtaacaatgttacaatagttatgtgaaagttaatatatgtgctgcattctgttttattagtctacattttcacctttataatcataccgaattgttgtaattctatacgtttttgatgtgtttgaaatcagaaattgtaatgcctccaacattgttcctttttctcaagattgttgggtactttattatctctttagattccatatacttttggagttggtgtttttgtttcttcaaaaatgcaatgagaaatttgagaaagattgtattaaatctgtagattaaattgagcagtatagacatcttcacaatattaattatttcttttttcattgtttgtttttgagatggggttaaattcacccacctcagcctcccaaaatgctaggattacaggcatgaaccactgcacccagcccagttatttcaacaagtgcatgctcaagagtgtgttgtatcatttctatatagatgtaaatttatcatttatttatattattgttttgtactctaattctatttttgtcatagaaaataatctatgaaatttcagttgtaaataatgtgttaagactttgtttttggcctaacaggtggtctataaagaagaatattgtatgagctatcgagaaggctgtgtatcctgatgttgttgaggagtgttctctataccttcattagaaataattgttttttactgccttctagtcctctgttccattactaatattatgtcttgttttattattattacagaaagtggggtattgaaatatcctactataatcatattgctctctctgtattcaattttgttagtatttgcttgatataattgaaaccctaatttgagacacacacagaaaaatacacacacgtgtataaacaaatttgtcataggttcccagtgaatgaatctatatattgtttaacgcccttctttgtctttttgaagttttgacttaaagtacattttataaaatatgacagtttttttacttaagatgtagcttgtgtaatattattttgacctcttctgctgtaatttggttaatatttatataaaaattctacttttgtcttgcaactttcagtcttttcttgtcattagatctcaactgactctttaaaaaggtaagttgagtctgatttttaaaactttttaatgaacctttttattgaaattatgtctcttgaatggaaagataattgtatatatttaaatagttttctgaaagagaaaaacttagttattttaattgttttatttgattattgtatccttgtgtgtcattttctctgtctttttgtgttgttttgatttttatattgacatgctttcagttttctcttattgttttttgtgtatccatatggattttttttagtggtatcttagggaattacctaaaacctctaaaagattcaacaatatattttaatgtagtaagaaattagcttcagttgcatacaaaaattcttattacatctgccttaaactttgttactgactttactaattacattttttatgttgtatattcatgaacagatgcttataatttctatacatttatcttttaaattttaaagaataattaaaaaagttttctgtaccattatgataatgttaagtaagaaattctatttttatgtgtgtacatatctttcccagaaatttatgtattttcatatgattatgtgttgttttcttgcattacgttattttctgtagaagaaactcctttcagcgttcttgatatgtaggacatatgcagtgccaatataattctcaagatttggttattttggaagaacttctttctatttggtagtacaattttgctcttatggtaatactcccatttgacaacttattttgaaattataattttaaaaatatcacagtttccttctgatctgcaaaaatttttttgataaattcactggttatctgatgagactatgcttatagattattattatatttatcttgcagcttgcaaaattcttatctgtgatttttgaaattttgcttatatatgtgtttgttataaatatatgtttgagtgtatcctagtttgttcagctttttcatgtttaccccattttttcttacttttaagaaatttttcagttttttttacatccactattttcattttctgctattttaatattttttgtggttaatctcatttttccgatcttcagtagttgtctgtgtttctatataacttcctggatattattcaatttattttatttatttattattctttttttttttttttttctgagatggggtctcaccctttcacccaagctggagtgcagttgtgtgatctcggctcactgcaacctctgcctcctggattcatgcaattctcctgcctcagcctcctgaggaactgggattacaggcacctgccagtatgcctggctaattttttgtgtttttaaatgaggtgggttttccccatgttggctaggctgatcttgaattcctgatttcaaatgaactgcccatctcagcctctcaatgtgttgggattacaggtgtgagccaccatgcttggcctattttattttatttttgagacagagtcttgctctgttgcccaagctttagtgcagtggcacatctccactcaccgcaaacttcccttcctggattcaagcaattctcctgtgtcagcatcccacgtagctaggattacagtcagataccaccaggcccactaatgtttgtatttttagtacatacagggtttcaccatgttggccaggctggtctccaactcctgacctgtgattctaccaccttggcctcccattgtgttgggattacaggaatgagcctccaaatatggtctgttcaatctattttgaatttttaaaattactttatacatttttaatgattgcttttgaaaattttataatttttttgatggggcaatgttgccttaatattttgtatacattgtaatctttgatcgatatttgaacattaacaaaaagccacctgttacaatctttataatatagctctgtcctggcatagtctgaaatcaattgtcttggctagagattctgggaatttctcaaacctgtttttaggaggtgtcttgtctaaaattttgtgtttattgtttagttaaatcagtttattaatatttcttcttaataatcagtaatcacttgctacacccatttcctgtttggggtactgcagtttctctgcttttgtaacatttaccttaagccttggcagactcaaactgtcattccaacatatatcaccatttctttcagcattttatgttgtgggagaccttaaccagtgccttaaaaagtccctagaagccagaaataaagatgtatgtgccaatatttttcttgtttttttaaaaagaaaccaggagttggcaatttacatttgtgtgtgtgtgagacagagtctcactctgttacttaggctggagtgcagtgacattatcttggctaacaacagtctctgcctccagagttcaagcaattctcctgcctcagcctcccaagtagctggattacaggtacctgttaccatgcctggctaatgctttttatttttagtagagacgggtttttaccatcttggccaggctggtcttgaacacttacttacccttgtgattcaccgacctcagcttcccaaagtgctgggattacagacttgagccatcctgcctggccaggaatgtacatttaaaggcacaatgttatactggagagcaggaagaagtgaagaatatttcttctaaagacagccattagaaatataaagggggttgtagtgcctttacttgcatcatagatcttattgcacacattttgtactagaggaaaaccctgaagcagttgctcaagctttgttcaacattggaatttatattggagaagagtcctgaaatataatgaatttaaaaacacttatatttcaaaaactacagcttagaaaacaccagagagtttatactaaaatatatttttgcagatgcagtaaatataaaaaaaattaatttaaaattgattttatgtaaatatcagagaatttacggtagaataactaaggcactgacatttcagacattacagcaaatcagtgttgagtataaaaactaatctacagctacagctgttagataaattgcttgtatataactttaaaaggagtagatttttgaagcatggtaattctattgaaagtatacttatttgcggccttgagcagtggctcatgcctgtaatcccagcactttgggaggcagaggtgggcagatcacgaggtcaggagatcaagaccatcctggctaacatggtgaaaccttgtctctactaaaaatacaaaaaaattagctggatgtggttgcacacacctgtagtcccagctactcaggaggcttaggcaggagaatggtgtgaaccctggaggtggagcttacagtgagccgagatcacaccactgcactccagcctgggcgacacagcaagactctgtctcaaaaaaaaaaaaaagaaagtatacttattcgcttgaaaaaaattttttgaaaagtgaataatgatgtaatacaggtttcaagttactttatgctgttattttattcctatattattcacacatgaaagcatgtgatcaattgttgatgcatcagagatactagacattgttttttattagttgggcattatttattaccttttctataaaagagtaagaacattaaaatgtaagatgcatgatgaaaatgtaagtggagaggctctttgtagtaaacctctattaagtaatgtataaggtggtggtttgtgttctcatttgtgtaatcctagcctatgacttaatgttgacactttgctttgtcttttggatggcctaacctacattaacatatacgcagaacattttaaacctttttttcaaaaatcataaagaattactttatcaataaacaaaggtaaacaataagctgagggttcagagtaatacttttctacattatagtgagagaaataaattattaattatagtcaaaagtattaaaataaattagtattgcaggctgggcgccgtggctcatgcctgtaatcccagcactttgggaggctgaggtggacggatcacgaggtcaggagatcgagaccatcctggcaacacattgaaaccctgtctctactaaatatacaaaaaattagccgggtgaggtggcaggcgcctgtagtcccagctactcgggaggctgaggcaggagaatggtgtgaacccgggaggtggaggttgcagtgagccgagatcgtgccactgcactacagcctgggggacagagcatgactcagcctcaataagtaaataaataaataaataaataaaaataaaataaaataaattagtattttactaattgtacttttaagtaataaaatgtattacatttaaaaattgttagattatgtgtgaacttaatttttttaccatgttaagcctattgtgcatttaatgaagcattttttttaatgaagcattattatgccactaactttaaactatttctccttacccaagcgtgtaaataaaagatggtagcaatatactatttggtatatagtggaataacatctctagtaatcactttgccaatggctttaaactgtaaatgtattgaagaatattgttcccataggtcaaatttttattctttattcttattgaaatgtattattagtatttatgagtatgtagtatgtgtatatatttatgccttatatggcatattttgagttaggcatataatatatagtaattactttagggtaaataagatagccatcagctgggtgtggtggctcatgcctgtaatcccagcactttgggaggccgaggtgcgtgaatcatgaggtcacgagattaagaccatcctggccaacatggtgaaaccccatctctatttaaaataaaaatattagttgggcacggtggtgcgcatctgtaacctggaatcccagctacttgggaagctaaggcaggagaatcacttgaacctgggaggtggaaattgcagtgagctcagaatgcaccactgcacttcagcctggtgacagagtgagactctgttaaaaaaaaaaggtatccatcacttgtagcatttatccttttattacaaactgtaattatacatttttagtgtataatttagtgagaaggattgcctggtgtcaggatttcaagaccattttgcccaacatggtgaaatcccatctgtactaaacataaaaaatttagttgagcatggtggcacacgcctagaggctgagtcaggaaaatcacttttaactccagaggtggaggttgcagtaaggcaagatcatgccattgcactccagcctggttgacagagcgagacttcatctcaaaaaaagagaaagaaatataaataaaatccttacatttctgagtcctgaaaaattattaaatatttgttatatagttttcttttaacatttggtctctctgcctgcgaacatatagacttttagttttaatttatgtggggaaaagtgagagaaatcagattgttactgtgtctgtgtagaaagtagacatgagactccattttgttctgtactaagaaaaattcttctgccttgagatgctgttaatctgtaaccctacccccaaccctgtgctccctgagacgtgtgctgtgtcaactcagggttaaatggattaagggttgtgcaagatgtgctttgttaaacagatgcttgaaggcagcatgctccttaagagtcatcaccactccctaatctcaagtacccagagatgcaaaacactgtggaagaccgcagggacctctgcctaggaaagccaggtattgtccaaggtttctccccatgtgataacctgagatatggcctcatgggaagggaaagacctgaccatcccccagcccaacacccataaagggtctgtgctggggaagattagtgaaagaggaagacctctttgcagttgagataagaggaaggcctctgtctcctgctcatccatgggcaatggaatgtctcagtgtaaagtccaattgtatattccatctactgagataggggaaaactgccttagggctggaggtgagacatgctggcagcagtactgctctttaatgcattgagatgtttatgtatatgcacatcaaaagcacagcacttttttctttaccttgtttatgatgcagagacctttgttcacgcgttttcttactgaccttctctccactattaccctattgtcttgccacatccccctctctgggaaatgcccgataatgatcaataaatactaagggaactcagaggccacggcaggcaggcgcggttcccccttatgctgaacgctggtcccctgggctgatttttttttctctatactttttctctgtgtctctttcttttccaagtctctcattccacctaacgagaaacacccacaggtgtggaggggcaacccagcccttcaaatttacatagagttaaatatacacatattactctgaagataaatcttaggtgtaagaaaagtattaagtgagtgtttgtgtgagtatgagtttgtacatattttcaggagaaaagagcaataattgcaacaaaatgaataaataaggtgactaatagaaaactaaacacctcaaaaatgctgaaagcaaatctatactttttgctttgtcttgaattcctttattcattttattttattttatttttttgagacagagtttcactcctgttgcccaggctggagtgcaatggcacgatctcggctcactgcaacctccaccttttgggttcaagtgattctcctgcctcagcctcccagtagctgggactacaggcacatgccaccatgcccagttaatttttttttttgtatttttagtggagactgggttttaccatgttggccaggctggtctttcattcctgatctcaaatgatccatccacctaggcctcccaaagtgctgggattacatgtgtgaactgccacattcagtgtgtcttgaatttattaatgtaaaatgttatggcttatggtttggattctccctagaatctgcctattaaagcacaggcatctttgtcttcagaaatgacactcttgagtagaacaataaaaaccctcttcaaacagaaaaaaataatcatttttaacacttattttaatgaaaatttaaccaacattgagtaattggatatatttttattgttttatgtgtgtgtgaatgtataaaatggtacatacaggaaaaataattcaagccagaaaaaagatgtaagttaatatttgtaatgaatgaaactggagagtagttaattattatttgcagataatatatttgtttatgtagataacaaaaggagcagaaagactattttaaaagtttatttaggtgggtaggcaacattttaagataataccctggattaccagtctgttgcacacctgctgtgtcatactttcctcttgagtgaaaaaaaaatgtatgactgtggtgggaaatcactcatgaaattaggttactcaactgttgactttgtgtttatcaaaatggagattattctgattgtgttaaacttaatcacaggtgcttctaagagaaagagacacatagaaaaacaacctgctggcctgattgttttgtgtgtttttctgtgctggcttactttacttggcataatatttttcaggttcatgaatattgttgcaaataacaagactttcttatttttaagtgcagagaagtatttcattgtgtacatataccacattttctttttctattcaactattgatggacacttaggatgattccataccttagctattgtgagtaatccacttccttccctctgttttgttttgtttgagatggagtctcattctgttgcccacgctaaagtgcagtggcacgatctcagctcaccgcaacctatgcctcccaggttcaagtgattctagtgcttcagcctcctgagtagctgaggttacaggtgtgcaccaccatgcttggctaatttttgtatttttagtagaggcaggctttcaccatgttgaccagagtaactttcatttgtttgtatatatttttcttccttttctatttctagaagcatgttaattttaaaatataaattatgaatgttaaaaaccttcattctctgtctttgattactattacaactgatttaaaaataagtttttttgaaattccctggataaaggttattacttcattattaacataacttgagacagcatagaaatgaaagtgaatatttgatagtaaaacagcaattatgtagctcctggtagtcatttaatctctcacccactctttggaacttctatcaagacaagaattctatttttgaaatgcttatgtttttaacaggattataagccacagccttccagcatcgggtcccaccaatgtatttggtggatccatttgtaaaccaagcatgtttctgatcttctgggattagttttttaaacgatttgcgccattggtcggggtgggaagggtggtttccttccatatctacaggacttgctcagtggtttttttgagctggcaagttttgtacatcctcatgtaaaactgataccccctttggttttggcttagcctggtcatgtatgtaccatttccattttatgctgctactttcttgggcatgccctatctggtaggttttgggggaactcatgtcccaagtcacaataggaatttcaggccacataaagacatcatggttgaagcagaggtgttccatttccagcaaagttcaatagcaagctaaaaattgcttcttgaagggatataatctttgctggcctctggcagtttgtaggtccgaaatccaaaagtaccctcttcccatgttgttcctgcctaaggctccaattagcatgttgatctaggacagttacttgcagttctactggcccatcccctataggccatagatccagggccagcttcaccacttgtttagcttgttcaaaagccatgctgtcttcctctccccaaagaaagtcatagcattttctagttgctgcatgcggaggttgtaaaatgttacccaagtggggaaaatgatgtttccagaatccaaacaagacaatacatttctggacctccttcttagtggtagaggttgcaaattgtagtattttagctttagcctttggtaaaatggactatttctctgtattccataggatgccaaggtgttggggtgatcagacccaacaccaggtcataggggctatgaagtctgatagagtcaaagaatgagacaagacaagttaaaagttcatagggtgggtccagggggccaactccaagcatggtggctgtgaagaccccaagctctgggagcccatgctatttataacttataacttattggtaatcaaacaaaaaagcagttggtgaggacatgtggacatgggggtagacaggtgaggatgtgcggatagaaaggtagtggtgaatcaagcgtagctgtgatggttgagcatatgctctgctacttgagataaaggagaacaggttcttctaattcaagacacaatcaatttatggtctcaggagagcaagaagcaatgggccaacgagtctggatacattccagaggctacaaggggttttatgccctgagcctgggttctgtccaagccacaaggggttttatgccctgggcttagactgtagtgtggcagggcagccttccaccctttggcacagagcttggtgttccacaggccacaaggggttttagaccctggaaccaggacatgttccaagactcttttatattatgtcagacaagcaagccctgcctcagctcttctgccaacaccaaggaattttacagtttgtgcaggtcctttgaattttactaaggttaatttcccatccttgagataagagttgggctcttacccgctccaagccccagctaactagttcctcagtttcaccctgaccaggccatttagacagctgcttttttcagcaataggctgatagctttgagcctgatcagtcaagtcataggcctggcattgggccagggccagtctggaagtaaaattagcattttccttttccagcttacatttctcttgtagcaactagcccttatcttgacacattaacttataagcagtaagcaaacaccatccactctggcagatccctcagcttctcctttgctgactggaatctcctgcagcacttcccgcacagtcaaaggtttaaattgcactaatttagattcccaattcccacaaagagcagttcccctggaccattcaaaagggagaactggaggagttcccatcgcgggatatgaggagtcaccgagcctccagccctgtccttctggccaaaaagtggcacacttttgttttgaatcctgttcgtgacgccgaaactgttctgtgcgggaaagaggcaaggggataagaaaagacagacacacaatacctttaagggtaaacaagcttcatcccatgtaaatggcaatgcagatatattaagcaaatgatataataagcaaaaaaaatataataagcaggttgatataataagcaagttgcaatgggaagaggagaagggaaaagtttgtgaagtttacgctcaccagactatggaagattcaccaccagagtgggaagcaacaacctgggctccagagtcggccacccatttgtgcacagatgaggagaggtctcatgaagcttcagtgcagtctgggaccttagctcatttgtaacaagttgtttggcatgaggcccggtcatgagggccctttgcaactgggcttaaggaacacaaaaagattaacttgtttttgcgattgtctattgtttttcaaaaatgaatgtatatgaatagattgaaatagagatttctccaaaacagcactggatgaatgcctctaggggctcacaaaacctattctgggacttggtgaccattgcttctgtccacgttcaattgacttcaaatttaatatttaactttacctccacaaattcctctgtcttgatgaatcggctctgtctaggcaaagggcaaagcgaaccacttgggccttacacaacctttacctcctcgattcaagcgattttcctgcctctgcctccgaagtagctgggactataggagtgcaccaccacaccctgctaattctttgtatttttagtagagatggtgtttcaccatgttggccaggctggtcttgaacttctgaccccaagtgatctgcccaccttggcctcccaaagtgctgggattaaaggcgtgagccaccatgcctgtccctgaatgatttctttctatctcctataactgtgaaatcacttaatggatgtttcaaactgaaaataataaaaagaatgtacataaaaataaaatacaagaagtcataaaaattagaagagattacaaaatatatatgcatatctcgaggggtcaaaaatgagaaattttgtttatttacagcgttttgtttatttatttatttaattttttttgagatggagtctcactgtgttgcacatgctggagtgcagtggtgtgatcttggatcaccgcaacctccacctccctggttcaagcaattctcctgcctcagcctctggagtagctgggaccacaggtgcatgccaggaggcctggctaatttttttgtattttcagtagagacgtggtttcaccatgttagccaggatcgcctcgatttctttctatgtcctatagcagtttgaaattacttaaaagttgtttcaaattgaacaaataaaaataatgtgcataaaatataaatagtttaaaaaattacaagacattacaaaatacgtatgtaaatctggagttgtcaaaaatgacaaatttgatttatatataaggttttattaaaattagctttaatggatactacactattaccaaagtaaaagttgattttctcttgaacaaaaatttgttgtattattaatatgacagcaaaatacttctgttcaccttttgaatacattcaacaggagagagtaaaaaagaaatagaattttcccatgctctgggatgtaagaattatccaatcagggacactgtgctggaaaccgtccaatcaggcacacagctgtagcgaacagcacggcttccgggtttggcggggcctttgtgtctctctgcagcctgagctccaggtctcttcttcactgctctgtgtcctctgcccctagaggcccagcctctgtggccctgtgtcctgtaggtattaggagatccacagctaggacgccgggatcccggaagcccggaaatggtaagaatgccggtccgacatcccgagagagggggaggggctggttggaaccggaaggaaatgtctttggcaagactcagctccagtcagtcagctccacaatttgtgccccgagttctccttacccagctcggcctcagtcctgttcagccataagatggcggctacacagaagcctggccccctgggcgtcctctcttccgtgcgcaatgactgtgtcctggcctggagccctctgtgggcagctctgcatctgcagcgctgtgtctctcccagattgtacagggatcatgagagggtcgtcaagggagaatcctgacttggggttcaggttcatgaatgggaagagctttggtccgtggggttcacagtttctcttttctcctattaaaaatgtatggggccaggagtggtggttcatgcctgtaatcccagcactttgggaggccgaggcgggcggatcacttgaggtaaagagttattagaacaagtaagttcctcttcaaagactcaacttctttgtcataagttgtaaatcaaatttatccctgctttccccttctccttttgttgcaaattgctcgtttaccctatttggaaaaagctggggtctaagccaaccgggatcagcttagattattgggtctgacccaagccaatagaggaaggacacaaaaacaggaactgtgttagggttaataaccccttcctggctgggtgcggtggctcatgcctgtaatcccagcaatttgggaggctgaagcgggctgatcacgtggtcaatgtaaggctcttgtattggtttgaaccgtgagagcgtgccaacagacaacaccaggcagtgtggagcaacatgctgttttagtgagtgccagggtgcaggccggctgaggcctacaatggcgtcagcaccaaatgaggacgaggcaggagttttattgtctccagtaaacaggaagtctcccagtctgatggggctgctacgtagtacccagacagcctctttctcaaacttcagggttacatgtcttctggccagagttgatgtcttccagacggttctcttcctgcttctgctatcttgctggcacacactgctgatgcaggtaggcttgcgccttgggactgggcctgggaagggaggagttactcatcccttcaagctttcagaccccggggagattctttctttcctctctttttggttatagaaagaaagggaaaaggggtgactttctcaataactacttcaggtgtgacatagggggtggcattggaaccttggaaaaaggtgcgtggctgggtttagatgggagctggttaatttttggggtattcttgagagacgggttggtgtccatcgtgttgttgaagcagaagcatcatctggattgtctggcagttaactgtagtttcaacgagagttttaatggcttttattattagtgggataacacaggcgagaaacaggaggaacctaatgataaaggtaactgtccctaccagccttttaaatcctcctaaatgaaagaaccaccctcctaggaggtttgttgggccacatcccttccaggtttagactggtacatgggctacttttctcatgtttgaagtgatttctagaacaacttttctgttatcatctatgttaagacagcaattaggatattaaacttaccacagattccaccctttcctgctaataagtagcctagtgctggcctgttttgataaattgctgtgcgcatttgattttgttgttgtgtgaacatttccaaggctgagaccgtttggttagtgattatctttagaacagcctgtaattattctatttagcatatatatgggagtgcgataacctcatgaaccatcctctgcctaaatggcagggccataatattcgatgatccattgcagaggccactcgtcttcttgcacagggactccaagggtgtcacctgctgttaatgttttggaggaaggagtagccttggagatgagcttgaccctggtgtgatggatccagtgggggagttcttggactctcactacagttggcatgctgagtatgacagtgtaagggcctgtccactttggttgtaccttttggtgagggctgggttggcagataaacatgtctatgcctgcaaggcagttatgttgagaggacaaggaggtgctgacagggagaggcatggcctcatttgctgcttcacgaatgaaagactgtgttggattaagtaggggaggtaattcctgagtggctcggagtctggtaaggatggaggccttaagacaaaagtatggctatgtatgattttgaagggagtataaaaagagggtgcttttggtgttgtgtggagtctcatgagggtgaaagggagatttcttgtccacaactgacaggtttctagagctagcttggtgagttgggttttaaggacagagttgactttttaaactttgcctgaagattgaggcctgtagggtgtatggggaacctatttgattcttaaggatgtagagacaccttgggtaatttggctgataaaggtgagcctgttatcatactggatggatgttgggagtccgaaacggggaattatatgcatgatgagagtttgtgtgatgacatttgcaccttctgaagttgttgggaatgcttctacctacccggagaaagtacagacaaagactggaagatagcggagccgtttatcgggcagcatgtgagtgaagtttacttgccaatcttgcctgggtaccttgccctgggcttggtgggtaggaaaaggtggtggccagggtaagccttggggtgacactaagtggcatatagagcaggacagggtgattccttgaacacagcaggaaagatgaggacaagtgagaatagggtggagaaattgagggagaagtttgtaactgacatggaaagagttgtggagactttggaggatagggattgtttgagattgaggaaggatgaagcacccttccttgacataccatggtccttgcttttgaaggtttttggcctggaagtcctctttttctttggaggagtgaaaaggagggaatgaggacagggacagagcatggctgggtttagatgcgagctgttagcacagtgatgtggggagtttctatgaatagagcatacagttggaggagcagtggggcagagatgagacttagtacactggggtgagctagcatgtctttgatgttatgggttgaataaactgttaggttggcatggagagatagttttaggctttcaagggtgagaacagcagctgccgtcaaggctcagagacaggcaggtcatccaagaactgtggcttcaagctgtttagagagttaggcaacatcctggagggtgggtcccttatactgggttagaacacctagtgcaactctacgctgttcgtcggtatagagggagaaaggtttggtaaggtctgcgtctgggagaacgaggataggggctgagttgagagccttttggagtagacagaaaggttgggtaataggctgtgcagggtttaaaggctcatggagagggcctttagtggcttggtataacggattggcaagtagagcgaaggaggaaacctagagactaaaatatcccgctagtcctagaaaagagaatttcttgctagtttgtggaggcgggagggactggaggagggatatgtggttggttgtgagccttcggtttcgtggggtaagagctaggcctagataggtgactgagggggtgcatatttgagttttaggggagacctgatacccccattctgccaagaagtttaaaagaaagatagtatgggcgttgcagtctctttgagaggggctacacaagagcagatcattagcatattgaaggggagtggatggtgttaggaataaggtacagaggttgcaagccagggcctgcccaaaaaggtggggactgtctctgaaaccctgaggttactacttcaagggtaggtgggcacagcctggtgggcttacctgagggggcatggcctggtgggcttatctgggtatgcaccaggtgaaaggtgggtgtcggggttttcctacgtaaaggcaaagaggtcctgagaatcagggtgtgaaggaattgtgaaaaaaagcattatttagtttaggacagaaaaatgggtgatattgtagggaaccacggaaagtaaagtgtatgggttagaaactactggacatactgggagtacagcttggttaataagcctagggcctggactaagtgataagttccatgtagctttttaacaggtagaatcagtgtgaaaaggggagtttgttgggcagagtaggtgattggcgaggaggcgagaaatgatagggtttaggcctacaagagctgcttgggggttggatactgcttctgtgataggaactgggtggggtttttaagggtaatgtgaacgggggcgtggtgttctgtcactgagggtgtggaagtatcctaaacagtgaggttaactatggatggggaataaggaaaggctgcatgttttaaggtgggaggttggaggagaagaagaaaattagaagcccccgaggggtctgggtagatgcgttgggtactatggggaatgtggaggtggagagtagtgtggagttttgagaggatgtctctactttggaggggagttgggcatgagggcaggactaagaaagagtgagtaaggaaaaggtgtgcagggaccagaaaagtggaggagtggctcatggtttggacacttgtccatcaattcctacaacagactgggaggactgggaaattaggtaaagcagagtaggttgccccagtattaattttaaaaaacatactggcctacctgccaccatcagtgttacccttggctcagatgaagatatggtagttgctgggatgccctttccagggcaccatcagtcttcagcagcaaggctggtgagatccaagtaggaggttttggctggctcaggaagggatgagggcagtgcttctgggggacgctcacagtctgacttccagtggagtcctccatagagggggcacgaactggtgggcttacctgggtttgggcattgtctggaccagtggccttcattgccacacttgaaatgtgcaggtgcaggtggattcctaggggcttccatgtggagctgtggccccatgggcctgcagggcccctgatggcggaggcaagcatttgaaactctgcctgtttttgccttttactttcctcatcatgattgttaaagactttgaaggctaaattaagatctttttgtggggtttgtgggctgttaccaagcttctggcttctgaagcttgtgctgaatatcaggggtggattgggaaatgaactgaaggtttaaaatagtggttccttctgagctggttgagtctacgttgttatattttctcatggcttcaggtaaacaagagggagaaaaagggctgggttttcatcaggacattgggtgatttctgaaagtttttcatagttgactgctttatgggcaccttttgagtcctgcaaggagacacacaatcatgtggtcttgatagtggcatccagggtccctgtcttgataatcctagtgggggtcctggttggggactgcctctgtaccagtagctgggcaagagcctggtgattaattgtattagcatgtgcctgagctagggtccagatagtctcagtcttctggggtgagagttgaagagaggataatgtagaggtcatgccaagttagttcataagactgggtaaggtactgaaattccctaaaataagaggtagggtcttttggaaatgaaccaaatcttttgttaatttgagagagatcagtgagggagaagggagcatgaactctcacaataccttcagctcctgctacttcccaaagggggcactctagcaccgacactgaagtaagggtggggcatgggccaaagatggcacctgagtgagtatggatgggagagaaggaagaagtcggaagtggttcctactgaccatttgaagggagaaggggggttgagttgataggcagtggaggatagataggggtgtaaggtggttggatgggtttacaggcctcaagagagggcggtgggggaggagactgggtacaggcaatactagaattgtcctgaggaggggacgatgtaggaaaagaagtggatactgctgactgggaagatggcagctgagaatataaagaggaggcttggggggttatagaagacagttgagagggagaggtaggggctgtgaggggtggacagcagtctgctggatccagtaagaaaaaagacgtagggttgggaggagaaaggtgatcaggtcggtgagaatggagaagtatttgaacaagtgagcaagaattgcagaggtcttgttgtgatctgagtgcaaaaaggcctggacataaggcatttctgcccatttttccagcagtcagcaataattgctttaatcagttaaaattgtaaagtcgaatgttccatttgtgggccatttggacccattatccaattcataatgtggccagactgaattgcaaaaaaagacaaggtgcttagggcagatatcttgcctgaggcctaaggtttgcaggttttttacaaggcagcctagaaggctgtccttcagaatggaaaactgggaattttctataatggagggtaggcactagagaacagagaaaaggagaccgtcctggatagccggatggagacaataaaaggagcagttgtcatcactgcctttttcattcctggaacgggatcagatggcttagaggggttcccctaaggccagatgatcagctagtgcctgacacatgccagagccttcttggaccaacattggatttttggacacaagaaccaagagaggccatacagatttttccctgttaagcgggctcccacagaaagctaccagtaggtgagatcactgactgatgtgcatgtacagagaggcaactggaggctgaggagcttcttttgtccagctgctgtggcctgctctccagggcagaggggtaggtccatggggatgcagacatcagctctcctgggttttggcaccaaaatgtaaggttcttgtattggtttgaaccctgagagcacactaacagacaacatgaggcagtgtggagacacatggtgttttaatgagtgcctggttgcaggcgggctgaggcctaaaatggccccagcaccaaataaggatgggtcagggatttcatggtctcctgtaaatcagaagtggcccagtctgacatggctgctatatagtacctggacggcctctttcttgatcttcaggagtacgtgtcttctggccagggtgggtgtcttctggccatctctctttctactactgctatcttgctggtgcacactgctgatgcaagtagccttgtaccttgggactgggcctgagaagggagttactcatcccttcaagctttcaggccccggggagaatctatcagtcaagagttctagaccagcctggacaacatggtgaaacccgtctctactaaaaatacaaacattagtggggcgtggtggcaagagcctctaatcccagctacttaagaggctgaggcacaagaattccttgaacccgggaggtggaggttgcagtgagctgagatcctgccatcacactccagcctatgtgaaagagccagactcattctcaaaaaaaaaaaaaaaagaaaaaagaaaaaaaaaaggtaagcatcttaaaatttcctttgtttatttaaacactgtgagtaatttcactggatttttcaaacacttagtttcaaacacgaagtgaataactctgacatggaaattaaagcttgaacctagtgattccaagctaagactaatactaagcctacaacaggaggtttttgttgttgttattgttgtttttgagacagagattcgctcttgttgcccaggctggagtacaatggcacgatcttggctcactgcaccttccggttcaagtgattctcctacctcagcctcaagagtaactgggattacaggcatgtgccatcacacccagctaatttggtatgtttagtacagacggggtttctccatgttagtcaggctggtgtccaactcacaacctcaggtaatttgcctgcctcagcctcccaaagtgctgggattacaggcctgagccaccgcgcctggctaacagtaagttattaaaggcctactgtttttttctggggagcctcccctgcagatgtcccagcctgcgcatcctagcaatggaaggagcctttatcctgagagaagctacagagtcctggaaagctggggccccacagcttgatgcagttaagatgaagacgaaaggaaactgggaggttctaactgataatgaagttattgttttgaggcattttttagactttgtaaaataacaacgtcagatttatgttaaaaaaaaaaaacgaattccaaaatgtattgcaacaggaggaagtatcaactaactataaggcctttatggcttgcaaaaatgtaggcagaaaagggctttctttcctagggaggagcaaacaatattggaaaggaggtgggaggggaatggcaaatggagggtgaaaaagtcagattttagatcagagaatgtcataccctgaaatcagcatgttcttagtagggacataaaatggggttgtatgttgacacagactgagagtagctcaaagttcaggagcctgagggagaaagataaacttaagtaaagtttgattaagaaatattttattttaggctgagctcaatggctcacgcctgtaatcctagcactttgagaggcagaggcaggtggatcacctgaagtcaggagttcaagacctggctaacatggtgaaaccctgtgtctaccaaaaatacaaaaattagctgggtgtcattgcagtcatctgtaatgccagctacttgggaggctgaggaaggagaattgcttgaacccagaaggcagaagttgaagtgagccgaggttgagccactgcactcctgcctgggtgacacagcgagactccatctcaaaaaaaaaagaaaagaaaagaaaagaaaatgcttatttaagtgggatggcatttattaaccagaaagttctgaaaaaaattattaggagataccagctctctacggtgctgaatgaagtctacttaaaattactactaaggtgattccgttccaagatggccaaatagggacagctctggtctacagctcccagtgtgattgacacagaagatgggtgatttctgcatttctaactgaggtacctggttcatctcattgggactggttggacagtgggtgcagcccatggaggcagagccaaagcagagtggggcattgcctcacccagaagcacaaggggtcaggtgatttccctttcctagccaaggaaagccatactttcaccaaagacagtgcctgaaaaaataggaaacttccacccaaatactgtgcttttccaatggtcctagcaaatggcacacaaagagattatatcccatgactttcttggtgggtcccatgcccacagacccttgttcactgctagtgcagcagtctgagatcaacctgcaaggcagcagcctggcagggggaggggcgtctgccactgctgaggcttgagtaggtaaacaaagcagtcaggaagcttgaactgggcggagtccaccacagctcagcaaggcctctgtctctgtagactccatctctgggggcagggcatagctaaaccaaaggcagcaaaaacttctgcagacttaaacatccctgtctgacagctctaaggagagcagtggttctcccagcacagtgtttgagcttggagaacatacagactgcctcctcaagtgggtcactaacccccgtgtagcttaactgggagacatctcccagtaggggctgactgacagctcatacagccaggtacccctctgggatgaagcttccagaggaaggatcaggcagcaacatttgctgttctgcaatatttgctgttctgcagcctccactggtgatacccaggcaaacagggtctggagtggacctccagcaaactccagtagacctgcagctgagggagctgactgttagaaggaaaactaacaaacagaaagaaatagcatcaacgttaacaaaaaggacatccacaccaaatcccatatgtaggtcaccaacatcaaacaccaaaagtagattaagccaaaaagatggggagaaaccagatcagaaaagctgaaaattctaaaaaccagagtgcctcttctcctccaaaggatcgcagctcctcgccagcaatggaacaaagctggatagagaatgactttgaagagctgacagaagtaggcttcagaatattggtagtaacaaacttctctgagctaaaggaggatgtttgaacctatcacaaggaagctcaataccttgaaaaaagattagacaaatggctatctagaataaacagtgtaggaaggagcttaagtgacctgatggagctgaaaaccatggcacaagaactacatgacacatgcacaagcttcaatagctgattcaatcaagtggaagaatgggtatcagtgattgaagatcaaattaattaaataaagtgagaagagaagtttagagaaaaaagagtaaaaagaaatgaacaaagcctcccagaaatatgggactacgtgaaaagaccaattctacgtttgattcatgtacctgaaagtgacggggagaatggaacgaggtagaaaacactctccaggatattaaccaggagaacttccccaacctatcaaggcaggccaatattcaaattcaggaaatacagagaacaccacaaagatactcctcaagaagagcaaccccaagacacaaaattgtcaggttcaccaaaattgaaatgaaggaaaaaatgctaagggcagccagagagaaaggtccggttacccacagactgaagcccaacagactaacagcagatctcttggcagaaatgcgacaagtcagaagagagtgggggccaatattcaacattcttaaagaaaataattttcaacccagaattcatatccagccaaactaagattcataagtgaaggagaaataaaatcctttacagacaagcaaatgctgagagattttgtctccaccaggcctgccttacaagagctcctgaaggaagcactaaacatggaaaggaaccaccagttccagccaccacaaaaacatgctaaattgtaaagaccattgatgctaggaagaaagcccatcaactaacaagcaaaataaccagctaacatcataatgacaggatcaaattcacacataacaatattaaccttaaatgtaaatgagctaaatgccccagttaaaagacacagactggcaaattggataaagagtcaagacccatctgtgtgctgtattcaggagactcatctcatgtgcagggacacacataggttcaaaacaaagggatggaggaagatctaccaagcaaatggaaaggaaaaaaaaaaaacagtggttgcaatcctggtctctgataaagcagactttaaaccaacaaagatcaaaagagacaaagaaggccattacctaatggtaaagggatcaattcagtaagaagagctaactatcctaaatatatatgcacccaatacaggagcacccagattcataaagccagtctttagagaagtacaaagagatttagactcccacacaataaaaatgggagactttttagacagatcaatgagacagaaggttaacaaggatatccaggacttaaactcagctctgcaccaagcagacctcacagacatctacagaactctccaccacaaatcaacagaatatacattcttctcagcaccccatcacacttattctaaaattgaccatatagttggaagtaaagcactcctcagcaaatgtaaaagaacagaaatcacaacaaacagtcttgcagaccacactgaaatcaaattagaactcaggattaagaaacttactcaaaactgcacaactacatggaaactgaacaacctgctcctgaatgactactgggtaaataacgaaatgaaggcagaaataaagatgttctttgaaaccaatgagaacaaagacacaatgtaccaaaatctctgggacacatttaaagcactgtgtagagggaaatttatagcactaaatgccaacaagaggaagcagcaaatatctaaaatcaacaccctaacatcacaatagaactagagaagcaagagcaatacgcattcaaaagctagcagaaggcaagaaataactaagatcagagcagaactgaaggagatagagacacaaaaaaccctttaaaaaatcaatgaatccaggagctggttttttgaaaagatcaacaagatggatagaccactagcaagactaataaagaagaaaagagagaataatcaaataggtgcaataaaaaatgatgaaggggatatcaccaccaatcctgcagaaatacaaactaccatcagagaatactataaacacctctatgcaaacaaacttgaaaatctagaagaaatgagtaaattcctggacacatacaccctcctaagattaaacaaggaagaagatgaatctctggatagaccaataacaggctctgaaattaaggcaataattaatagcttaccatctaaaaaaagtccaggaccagacagattcacagctggtttctatgaggaggagctggtaccattccttctgaaactattccaatcaatagaaaaaaaaggaatcctccctaactcattttatgaggccaacagcatcctgataccaaagcctggcagagacacaacaaaaaaaggagaattttagaccaatatcactgatgaacatcagtgcaaaaaacctcaataaaatactggcaaactgaatccagcagcacatcaaaaagcttatccaccacaatcatgttggtttcatccctggaatgcagggctggttcaacatacacaaatcaataaacataatccatcacatacacagaaccaaagacaaaaaaaccacatgattatctcaatagatgcagaaaaggcctttgacaaaattcaacaaccttcatgctaaaaactctcaataaactaggtattgatgtaacatatctcaaaataaaaagaggtatttatgacaaacccacagccaatatcatactgaatgggaaaaaagtggaagcattccctctgaaaacttgcacaagacagggatgcccactgtcaccacttctattcaacatagtgttggaagttctggccagggcaatcaggcaagagaaagaaataaaggtattcaattaggaaaagaggaagttaaactgtccctatttgcagatgacaaaattgtatatttagaaaatgccatcgtctcagcccaaaatctccttaagctgataatcagcttcagcaaagtctcaggatacaaaatcaatgtgcaaaaatcacaagcattcctatacaccaataacagacaatcagagagccaaatcatgagtgaactcccattcacaattgctagagagaatcaaatacttaggaatccaacttaaaagggatgtgaaggacctcttcaaggagatctacaaaccactgctcaatgaaataaaagaggacataaacaaatggaagatcattccatgctcattgataggaagaatcaatatcatgaaaatggccagactgcccaaggtaatttatagattcaatgccatccttatcaagctaccaatcattttcttcacagaattggaaaaaaactactttaaagtatatatggaaccaaaaaagaccccacattgccaagataatcctaagcaaaaagaacaaacatggaggcattatgctacctgactttatactatactacaaggctagagtaaccaaaacaccatggtactggtgacaaaacagatatatagaccattggaacagaacagaggcctcagaaataacaccacacatctacaactatctgatctttgacaaagctgacaaaaacaagatatggggaaaaaattccttatttaataaatagtgttgggaaaactggctagccatatgtagaaagttgaaactggatcccttccttacaccttacacaaaaactaactcaagatggattaacgacttaaatgttagacctaaaaccataaaaaccctagaaggaaacctaggcagtaccattcaggacataggcatgtgcaaggacttcatgactaaaacaccaaagcaatggcaacaaaggcaaaaatagagaaatgggatctaattaactaaagatcttctgcacagcaaaagaactaccatcagagtgaagaggcaactttcagaatgaaaaaaaatttttgcaatgtacccatctgacaaagagctagtatccagaatctacaaagaacttaaacatatttagaagaaaaaaaacctcattaaaattgggcaaataatatgaacagacacttctcaaaagaagacattcatgcagccaacagacatatgaaaaaaatggtcatcattaccggtcattagataaatgcaaatcaaaaccacagtgagataccatctcacaacagttagaatggcgatcattaaaaagtcaggagacaacagatgctggagaggttgtggagaaataggaatgattttagactgttggtggaagtgtaaactagttcaaccattgtggaagacaatgtggtgattcctcaaggatctagaacaagaaataccatttgacccagtgatcccattactgggtatatacccaaaggattataaatcatgctactataaagacacgtgcacatgtatgtttattgcagcactattcacaatagcaaagacttggaaccaactcaaatatccatcaatgatagactggattaagaaaatgtggcacatatacaccatggaatactatgcagccataaaaaatgagttcatgtcctctgcagggacatagatgcagctggaaaccatcattctgagcaaactgtcacaagaacagaaaaccaaacaccacatgttctcactcataggtgggaattgaacaatgagaacagttagacacagggtggggaacatcacaccctggggtctgtcatggggtggggtgcagggggagggatagcattaggagaaatacctaatgtaaatgatgagttaatgggtgcagcaaaccaacatggcacatgtatacctatgtaacaaacctgcacattgtgcacatgtaccctagaacttaaagtataataataaaaaataaaaaaaagtactactaaaaattatggaacataggagttatctgtacattgaagtttgcataaaacatgtttctttaaggttaaattcagattttatttactttgtgttggaggaatatttcaacagtgatgctgtgttcttctgtgtgcattagcacatcataaaaatttgtccagtgcagttaatggttaatgattcacttgcttaaatagctctctgacagattttttcactcttcagttaattatttttctcttcattattaagtatctttatgcagctgatgtgtataaaacgctatacttaatctggcagctgcccttttttcttattttttcttcatatttttctttggaaaatgaaggcttttatctttgtttacaggtgagaaaaacttggaaaacccaggcttttccacttactggatgtgttacaaaatatccttcttgggccaaaaacatagacagtattgctgagcttgttagaaattaaaaaaatcagactttatgtcggatcttctggaaaaaaaaaaaaagaaaaaaacctgtataacaaggtcttgaacttattgtacatatcaaaatttcagaggtgtcttgtagctcaatatgtctttttccatctgaaaaatatgcacaactcattcagtatgatgtaaatatagcactgaaaagtgtgtatgttgatgttcatgctcttaattttatactttgttagctacaataacatcatatatgaactgatgtggatcttatgctgttctttttttctcagagttaaaaaatacattagagaatatttctttgttggagattattttcttggataatttaattctataagtaagaaccagttccttttactttccaatttcaccttcagtcaaaataaaaactctgcccatggccacttggtaaaaatgtgtgtgtgtgagtgtgtgtttgtttcaggggccattgcaatttagagatgtgcttacagaattatctctggaggagtggcattgcctggatactttacagcaaaatttacatagcgatgtggtgttagagaacaacataaacctggtctttcttggtgaggataactttaatacataattcataatatactctaaaggttttctttctcttttttgtggaatgttttttagtaatgtattcattgatcaaagagtttcagaacccattttccagaaaatctttagaaatttttcatttagaaaagaatttgttcaagatgttttgtgttaatcaaaactttacacattcctgagttgagctatattcttcactctaaattagtgataattccagaaatttggtggcataaaatattgttgtccccacctgaaaatctaattatcagcaacaagttttgattctgtagtaccaggtagtaaaattaaaaaacctacaagtaggctgggcgcggtggcttatgcctataatcccagcacttcaggaggctgaggcaggaagatcatgagatcaggaattcgagaccagtctgaccaacatggagaaattccatttctaataaaaatacacaattagccgggcatggtggcacatgaatgaaatcccagctaccctggagactgaggcaggagaattggttgaacccagaaggcagaggtttcactgagccaagatcgtgccattgcacttcaacctgggcaataagggggaaactctgtctcaaaaagaaaagaaaagaaaagaaaaactgatgaattcaaagtgttttctgggagccaagatggccaaataggaacagctccagtctacagctctcagcatgagtgacacagaacacgggtgatttctgcatttccaactgaggtaccaggttcatctcactggggagtgccagagagtgggtgcaggatactgggtgcactgcaccgtgtgtgagccaaagcagggtaaggcatcccctcacccaggaagtgcaaggggtcagggaatttcctttcctagtcaaagaaaggggtgacagacagcacctggaaaatcgggtcactcccaccctaatactgtgcttttccaatgagcttaacaaacggcacaccaggagattatatcccacacatggctcagagggtcctacgcccatggagccttgctcattgctggcacagcagtctgagatcaaactgcaaggcagcagagaggctgggggaggtacgcccaccattgctcaggcttgagtaggtaaacaaagctgccagaagcttgaactgggtggagcccacctcagctcaaggaggcctgcctgcctctgtaggctccacctctgggggcagggcacagacaaaagaccgcagtaacctctgcagacttaaatgtctttgtctgacagctttaaagagagtagtggttctcccagcacgccgcttgagatctgagaatgggcagactgcctcctgaagtgggtccctgacccctgagtagcctaactgggaggcatctcccagtaggggtggactgacacctcacatggccgggtactcctctgagacaaaacttccagaggaacaatcaggcagaagcatttgtggttcaccaatatccactgttctgcaaccactgctgctgatacccaggcaaacagggtctggagtggacgtccagtaaactccaacagacctgcagctgagggtcctgactgttagaaggaaaactaacaaacagaaaggacatccacaccaaaaacccatctgtacgtcaccatcatcaaagaccaaaggtagataaaatcacaaagatggggaaaaaacagagcagaaaaactggaaactctaaaaatcagagtgcctctcctcctccaaaggaacgcagctcctcatcagcaatggaacaaagctgagcggagaatgactttgacgagttgagagatcaaggcttcagaagatcaaactactccaagctaaaggaggaagttcgaaccaatggcaaagaagttaaaaaatttgaaaaaagaattagactaatggataactagaataacccatgcagagaagtccttaaaggacctgatggatctgaaaaccatggcatgagaactacgtgatgaatgcacaagcctcagtaaccgatgcgatcaactggaagaaagggtgtcagtgatggaagacgaaatgaatgaaatgaagcatgaagagaagtccttaaaggacctgatggatctgaaaaccatggcacgagaactacgtgatgaatgcacaagcctcagtaaccgatgcgatcaactggaagaaagggtgtcagtgatggaagacgaaatgaatgaaatgaagcatgaagagaagtttagagaaaaaagaataaaaggaaatgaacaaagcccctaagaaatatgggactatgtggaaagaccaaatctatgtctaattggtgtacctgaaagtgacggggagaatggaaccaagttggaaaacactctgcaggatattatacaggagaacttccccaatctagcaaggcaggccaacattcaaattcaggaaatacagagaacgccacaaagatactccttgagaagagcaattccaagacacataattgtcagattcaccaaagttgaaatgatggaaaaaatgttaagggcatcccaagagaaaggtgggttacccacaaaaagaagcccatcagactaacagctgatctctctgcagaaactctgcaagccagaagagagtgggggccaatattcaacattcttaaagaaaagaattttcaacccagaatttcatatccagccaaactaagtttcataagtgaaggagaaataaaatactttacagacaagcaaatgctgagagattttgtcaccaccaggcctgccctaaaagagctcctgaaggaagcactaaacatggaaaggaacaaccagtaccagccactgcaaaaacatgccgaattataaagatcatcaagactaggaagaaactgcatcaactaatgagcaaaataaccagctaacatcataatgacaggatcaaattcacacataacaatactaatcttaaatgcaaatgggctaaatgctccaattaaaaggcacagactgacaaattggataaagagtcaagacccatcagtgtgctgtattgaggaaacccatctcatgtgcagagacacacatgggcttaaaataaagggatggaggaagatctgccaagcaaatggaaaacaaaaaaaggaaggggttgcaatcctagtctctgataaaacaggctttaaaccaacaaagatcaaaagagacaaagaaggccattacataatggtaaagggatcaattcaacaagaagaactaactgtcctaaatatatgtgcacccaatataggagcacccagattcataaagcaagtccttagtgacctgcaaagtgacttagactcccacacaataataatgggagactttaacaccccactgtcaacattagacagatcaacgagacagaaagttaacaaggatatccaggaattgaacacagctctgcaccaggcagacctaatagacatctacagaactctccaccccacatcaacagaatatacattcttttcagcaccacaccacacctattccaaaattgaccacatagttctatggaagtaaagcactcctcagcaaatgtaaaagaacagaaattataacaaactgtctctcagaccacggtgcaatcaaactagagctcaggattaagaaactcactcaaaaccgctcaactacatggaaactgaacaacctgctcctgaatgactactggctacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacacattcaaaagctagcagaacgcaagaaataactaagatcagagcagaaccgaaggagatagagacacaaaaaaatccttcaaaaaaatcaatgaatcccagagctggttttttgaaaagatcaacaaaattgattgaccgctagcaagactaataaagaagaaaagagagaagaatcaaatagacgcaataaaaaatgacaaaggggatatcaccactgatcccacagaaatacaaactatcatcagagaatactataaacacctctatgcaaataaactagaaaatctagaagaaatggataaattcctggacacatactctctcccaagactaaatcaggaagaagttgaatctctgaatagaccaataacaggctctgaaattaaggcaataatcaatagcttaccaaccaaaaaaagtccagaaccagatggattcacagctgaattctaccagaggtacaaggaggaactggtaccattccttctgaaactattccaatcaatagaaaaagagggaatcctcccaaactcattttatgaggccagcatcatcctgttacaaaatcctggcagagacacaacaaaaaaagagaattttagaccagtattcttgaacattgatgcaaaaatcctcaataaaatactggcaaactgaatccagcagcacatcaaaaagcttatcctccatgatcaagtgggcttcatccctgggatgcaaggctggttcaacatatgaaaatcaacaaacgtaatccagcatataaacagaaccaaagacaaaaaccacatgattatctcaatagatacagaaaaggcctttgacaaaattcaacaatgcctcatgctaaaaactctcaataaattaggtattgatgggacgtatctcaaaataataagaggtatttatgacaaacccaaagccaacatcatactggatggacaaaaactggaagcattccctttgaaaacttgcacaagacaaggatgccctctgtcaccactcctattcaacatagtgttggaagttctggccagggcactcaggcaggagaaggaaataaagggcattcaattaggaaaagaggaagtcaaattgtccttgtttgcagatgacatgactgtatatttagaaaaccccatagtctcaccccaaaatctccttaaactgataagcaacttcagcaaagtctcaggatacaaaatcaatgtgcaaaaatcacaagcattcttatacaccaataacagtcaaacagagagccaaatcatgagtgaattcccattcacaattgcttcaaagagaataaaatacctaggaatccaccttacaagggatgtgaaggacctcttcaaggagcactacaaaccactgctcaatgaaataaaaagaggatacaaacaaatggaagaatattccatgctcatgggtaggaagaatcaatatcatgaaaatagccatactgcccaaggtaatttatagattcaatgccatccccatcaagctaccactgactttcttcacagaattggaaaaaactactttaaagttcatatggaaccaaaaaagagcccacattgccaattcaatcctaagccaaaagaacaaagctggagacattatgctacctgacttccaactatactacaaggctacagtaaccaaaacagcatggtactggtatcaaaacagagatatagaccattggaacagaacagagccctcagaaataatgctgcatatctacaactatctgatctttgacaaacctgacaaaaacaagcaatagggaaaggattccctatttaataaatggtgctggaaaaactggctagccatatgtagaaagctgaaactggatcctttccttacaccttatacaaaaattaattcaaggtggattaaagacttccacgttagacctaaaaccataaaaaccctagaagaaaacctaggcaataccattcatgacataggcatggacaaggatttcatgtctaaaacaccaaaagcaatggcaacaaaagccaaaattgacaaatgggatctaattaaactaaagagcttctgcacaacaaaagaaaccaccatcagagtggacaggcaacctaaagaatgggagaaattttttgcaacctactcatctgacaaagggctaatatccagaatctacaatgaactcaaacaaattcacaagaagaaaacaaaccccatcaacaagtgggcaaaggatatgaacagacacttctcaaaggaagacatttatgcagccaaaaaatacatgaaaaaatgctcatcatcactggccatcagagaaatgtaaatcaaaaccacagtgagataccatctcacgccagttagaatggcaatcattaaaaaggaaacaacaggtgctggagaggatgtggagaaataggaacacttttacactgttggttggacggtaaactagttcaaccattgtggaagtcagtgtgacaattcctcagggatctagaactagaaataccatttgacccagcaatcccattactgggtatatacccaaaggattataaatcatgctgctataaagacacaggcacacgtatgtttattgtggcactattcacaatagcaaggacttggaaccaactgaaatgtccatcaatgatggactggattaagaaaatgtggcacatatacaccatagaatactatgcagccataaaaaattatgagttcatgtgctttgtagggacacggatgaagctggaaactatcattctcagcaaactatcacaaggaccgaaaaccaaacactgcatgttctcactcataggtgggaattgaacaatgaggacacatggacataggaaggggaacatcacacactggggactgttgtggggtgggggaagggaggagggatagcattaggagatatacctaatgctaaatgacaagctaatgggtgcggcacaccaacatggcaaatgtatacatatgtaacaaacttgcaagttgtgtacatgtaccctaaaacttatagtataataataataacaataaaagtgttttctaaatatttagaaatttctgttttaacttagtatttttgtattaatttactagaatattttatcacaccctctcagctgagcacattactagcttgtaattggagaatatgagcaagattcatattatttatttatttatttttatttttttgagacagagtgtcactttgtcacccaggctagagtgcagtggtgcgatctgggctcactgtaagctccacctcccagattcatgccattctcctgcctcagcctcccgagtagctgggactacaggtgcctgccaccatgtgtggctgattttttgtattttttagtaggtacagggtttcactatgttagccaggatggtctcaatcttctgaccttgtgatccacccaccttggcctcccaaagtgctgggattagaggcgtgagccaccacacccggtctcatgttatttatttttaataaaacaggtattgttgtctccaagccagacctgatcatctgtctggagcaaggaaaaatcctttgagtatgaggagacatgagatgattgccaaacacccaggtgggtgcaagtgaaagtgaatacaacagacgacacaggtaagagatcccaaggtgaaagagaaagccagtacttaaaatgtgatttgggaagctgtgttccaaaggaaatagttcctgggcggttgttttataatttttctctcacaaagggacatctgctgtcttatgctttcaaattctctaaggattctacttttctttcagtgagcttccttcaagttcacagtgaaagccaaagtcttcttcatggcatataagacactgcacaatcttgctgcttttacattgttttgatgacacaaaattatctgcatgattttaagaaactaaaactattctcaaagttctctttttgcattttgaaatgtgcgagagtagtagtttctgttgaatttttttcattattctgcacatttccattctgtttttattactatatagtgttgaaatatagttggaaagtataagtatgatatccttctgctctgttcttttcatcaagattgctttggctaatcagtttattttagtttcatgtaaattttagaattgtatttttcattactgaaaaagacaccactgcaattttaataggaagtttattgaatctatagatcactttagataatatggaactctaataatatttattctttcaatccatagacataaaatactttataatttatttggaacttctctaatttctttcactgattttttttggtaaaggtttttcatttcattggttaatttttttctcagaaattatttaatgctataacaaataagatttttttgtcctatttttatcagatagtttgatttaagtgtataaaaccgtacatatacttgtatgttagtttcatattttgtaatttactgagtgtatttattagtttagataggatttaatgtactgtttattagtttttaaatataatattgtatgatctacaagcaaaaactttttagttttcttaaattttaatggatttttttttatttctttgagtaaatcttctgccacatacttccagtgttacactaaaatagaagcattcacaatgggcacaatatagttttgcattggtgtctgaatttgatggagcaaagacctattcaagttttcataaactgatttcagaaggtaaatatcttcttctgttggacccttagggtgatgagatgccctctgaatttgtagtgaagaagggttgtagcttggtcaccaggctgctgggtctgcattagggtccacctttagttggcttgttacaggggcttgggttgttataattcccattttatttttggacagactgaatatccttcagagctttgctccataaggcagacactagggcatgtttttgcaattggctctgcatatggtgggccttgtatcaggatgtggatgggtgtggctttcagtgagtaccagagagcatttcctcaggtaaccgtgtgggttactatataggcagaactgaccataaactgtggctcaggtaactgaaactgagtcatggaactgcctcagtgaccccagtaaaggccaaggtctgcatgcctggatgcatgactgtaaatgggcaccttcctccaagtctctggaatagcaggacctctgtcagactgtggctgggaggagtttgggatggttacagagtaagtttagaattctcaatggaaccaagttgggtgaaccctatcctggtctgtagctaaaacaggggtcctgtagtatcccacgtgagtgagggcctgccttctgaatagaacacttctcaaacataagctttaacagcatttcacaactgcatccctggatgtcaaatctctcttagaggtacttattttggagatggtgtcttgctacataacccaggctggtctcaaaatcctggcctgaactagttctccaaccttaacgtaccatgtagctgtcattacaggtgtaagccataatcctggttctctcataaaggcatttttgtcaggggtggctgactttttatgccataagggaatatgaaaatagggcacttttaatcttttcatcttactgatgtcactgtccttttacatttttactttttattttctatttcaaatttgtctataattttggattcagtcatttagcacatatgctagaatttgcatggtatacctgaagtaaatgagatattagtaggcaccccatatttactaaaatagttacttataaatttatgtttgctccgggcaaaaaggaattataggattttcgtctactattttcagcctatatctaaataataacatagttcatttcctaatatttgttttacatatcagaggatctaaccctattctacaaaatatatatatatttttctatatttaacaatggaaggttattatttgcttttaaagttggaatacagcagtttcattttgtgtaagaatagcatatatttaaaacaaaaagcaactctagtttcttttaaatgctaatttattaaaagtttgtcattggagtcttctatttataattatactgcatattttctgaaattttagtgccacacagtgcatgccaatgattcaaaatacaggtatatgatgattacatagtagcagttgaatatcacagttacctacacaatttttttttttttttttttttttttgagaaagagttacctctcttacccaggctggagtgcaatagtgtgatcttggctcactgcaaccttcatctcctgggttcaagcaattctcatgcctcagcctcccaagtagctgggattacagggatgtgccactatgcctggctaatttttgtatttttagtagattttgggtttcaccacattggctaggctgcttttaaactcctcacctcaggtaatctgcccccctctgcctcccaaagtgctgagattacaggcatgagccactgcacctgcctgacaatttttttttgatgatacatcaatgtggcataccagattttgtgagtaaatatttctcttattattgttttgaagttctgtgtatcaggggtcccgcccccaatatttcaatgtatgttctttctattttccataagtgtcagctggttgaaaaataaagagaaagagtacaaagagaggaattttacagctgggccaccaggggtgatatcacatatcggtaggaccacgatgcccacctgaaccttaaaaccagcaagtttttattaaggattttaaaaggggagggagtgtatgaacagggagtaggtcacgtgcttcaaggggcaaaaagcagaacaaagatcacatgcttctaaaacaggaccagagcaaaatcagaactcctgataagggtctatgttcagcagtgcacgtattgtcttaataaacatcttaacagaaaaaaagggttcgagagcagagaactggtctgaccaaaaatttaccagggtgtagtttcccaatcctagtaatcctgagggtactgcgggagaccagggcatatctcagtcattatctcaaccacataggacagacattcccagagtggccattcatagacctccccccaggaatgaattcctttcccagagtattaatatcagtattccttgctaggaaaagaatttagtgatatcttccctacttgcacacccatttataggctctctgcaagaagaaaaatatggctctttttgcccaaccccacaggcagtcagaccttatggttgtcttcccttgttccctaaaaatcgctgttattctgttttcaaggtgcactgattgcatattgttcaaacatacatgttttacaatcaatttgtacagttaacacaattatcatactggtcctgaggtgatgtacatcctcagctaatgaagataacaggattaagagattaaaataaagacaggcataagaaattatgaacatattatttgggaagtgatagatgtccatattaaaatgaaatcttcacaatttatgttcctctgctgcgactccagctggtccctctgtttggcatccctgacttcccacaatatctctccctttctttttatataaatgtaccaacatcgcatgcaatgttcaagagtcactagctgatctccaagccaaagtatagattgtcttaaatcattaatttgattagataatttttgatcaatgccttgttgagaattccacatttggttggaatttgcttgccaaagattaacaaaatgggccgtttgaatagattggtgtaatgccactccggcagtagtggccagtgcagtgactataaataggcccatgatcacagtgattaaagtgaaaacaaatctcttagattttttgagaattctttgtaacacttcattcattaaatgtactgagagggaagattcccagtgtctgggtaaagttaccgaatccagattccttctcgagctcgaagccacattacacttctcctggagtcaaaatgggagttaacacaagtgtataaatgacaattaatgcattggacagtttgtgtgtccaaattttgatatttcccactaacagcacgtaaggaggcttaacacaactttgtataggaatagtcaggctggaggtaaacaaagcagaacattgatactgagggagagtagaggtggtggcaacgcccaatgttgtctgccataaagaagcaatccgaggtgcccagggatgctgaggaagtagaggggcatacctgggtcaagaagaattatcataatgccaattggagtcccataaaggaggatcagcatcaaaaagaggaaaagggttcaaaggggatttatcatggggttcagagtcatggatgcaaggggcagtagtggggataacagacagaaaagtttacccttcccatactcacagtccagacatggcaatagccaatttccaaagttctgagtgttccaggctcagaatggggaatatcatatgaggcctcggaggggtaatgcccttatcttcccattttaagggaaagaatgagctgaacttcctatgtaaagtagaacgatgatcctcgtcctcccaataagaaataaaataagtagcctccaggcattcccttccaccagaggagcaattgttttttaaatagccctttggtgcccatcctattactaaaccatatgcgtcattttttagtactactacatgtgagttaacacagtcttcccaaattaaaattttagatgggccctcaaaatttttaggacatggttttcctacaggtttatattgaaagtttggggtatctcctattactccccctttcatttgtcttaaaggagaaagagagaggctggagatcaaatgtccctgttctcttgtagctaatctctccggaagataagcagcccagatttgagcttgtagatgaatacaaccatctacatgtgcatgtccaaggcacagaggagggtatttataacccatggtaacattaaattcagtgctttcttctcctggttgagtggggcaatggtcatctgtagctccatgtatccacacactatcattagtatagatttctgcaggagcattcatccaggtgagaggtcgaataagtggaagaaaaggcacataagcccaataagaataattttgtgtagcaggtaaatcattttgaggggaaactgatgagacagaaagtttaagaagaattattaaataaaacctattgtaagcaagatcctgtgctgaaggaggaagagaagaacagagggatgttattttcaggctaatagaaatggtgagatttttaggtttagaagtggcattaattagaggggtctccgttgccattagggaggattgaaccagacccattttgatttggcatgccagtttttgagaagtcggcagagatctcaccaggtatgaaggcggtctctgacttggatgtcttttccctgtggctttctttgtcactattcacacgaagtttgagtctctcagtgggcacccagacaggggattgatctcctggtgaaacacaagcataccctcttccccatgttataattgttccaggttcccaggtattggtttgggagtttttccgtaacactggcttgccttcatttagggagaattttttgcctgtataatggcattcagctgcagtcagagttgtctttaggaacatttagaaagtttaaagtaaacaatgctaaatgtaattgggagtggggagtggttaaattatgcttttgttgctcagactgtttggacaattgagtttttaaagtgcaattggcctgttccaccacagtctgtccctgaggattgtaagggattccggtagtatgggaaattccccttgttgcataaataaatcaaaagacttacatatccaggggtgttgtctgtttttatctgacatggaagccccataactacaaagcaagaatacttatgtcttttaacatgggcagtgccttcccctgtttggcaagtagcccagataaagcctgaaaagatgtctacagaaacatgcatatatgaaagtctgccaaaggagctaacatgagtcacatgcatttgccataagtcattaggagttaggcctctgggattaatgccagattcctgatttggaagtacaaaaacttggcactgagggcagcagtggataataagcttagcctctttccaggtgagagcaaatttatattttaatccagtagcattgacatgagtgagattatggaactctgagcttcttggtttgcaaaagagaccggtcaaccttttgattaccagcaggcatgggtcccagtaaagtggtatgagatctgatatgtgtagtatagaaagggtgtctacactggcgaaccacctgttgtaaacttgaaaataaaaaaagccaattcagaattatcaatatgtttgatagtagcgatttctatatttttagtggcatgtacaacataaacagaatcagagacaatatttaacagtttggggaaatcctgtaaggcaataattacagcaattaactctgccttttgagcagatgtgtgaggcgtagaaataagcttgtctgcaggacacagataaccagcatttccgttactggagccatcagtgaacactgtaacagcctcaggaatgggctgatctttggtctattgagggaccacccaataagtcatttttataaaatcaaacaatttttttgataatgattgacaataacacagataaaatcagtcaagtgaatttgccacagtatggaatgttgaaaagcagcctgaactttaagccgatttaaaggaaccacaatagatttggatcaaatccagaaattttaagtgatctacaccaagcttgtccaattagattggctatttggtccagataaacagacaaagtttttgacacagaatgaggaagaaaacaccactccactaaatcattatgttgaacaattagcccagtaggggagtgcaatgaagcaaaaaccagaagctgaaaaggctgagatggctgtaccctagacaacagggcagtttggattctttcttccatgaattaccgttccagtgaagcctcaggggtcaaagtcctgagactgtggagattggaatctccacacagtatagaaaacaagttagacagtgcatattttggaatgcctaaggtagatcttaaataattaatgttacccaaaagtttttggaaatcatttaaggttttcaaagaatctctcttaatctgaactttttgaggttgaatatattctttattgaccaccattcctaaatattgagcaggagtggtcttttgaattttatcttgagtgatgtgtaatccagcctcagtgacatggtggctcaaaaattgataacagtcaattaattctttatcagtgggggcagcaattaatatatcatcaatataatgaagaatataggcctggggaaattgagctcacactggtgaaagcacccatccaacataaagctggcagatggtagggctattcagcattccctgaggaagtactctccattgataatgagctacaggctcctgattattgatagatggtacagtaaaggcaaatttttcacaatccaatttatgtaaagcaataaaaatactttaagatcaataactatgagaggaaattcttaggtattaaagcaggggcaggcatgccaggttggatggctcccataggtttaattacagcattaatggaccttaaatcagttaccatccaccacttgcctgatttcttttttactagaaacacaggagaactccagggggaaagagaagattccacatttccaagttgtaactgttcagaaaccaattgagttgaagcctccagttttttttagagagtggccactgatcaatccaaacaggtgttttagattttcattgtaaaggaataggattaggaggcatggcagtggccgccattaaaaaggagaacctaaaccagcgctgtcttcttttacagtaacttgaagaggtttagcaattccttcatgttttggactgaaaccgagtctgggaacaaaccccatgttttccattatatgttgactgggagcactataagagttatgctgaatattaatttcagctcccccttgtgccaacaaatctctaccccaaagattaatggggattggcatgatataaggctgaattgcacccttttgaccatcagggccaatgcaaggcaagataaatgtgctctggtgaacttcatcagcttttccaacacctactagtcccatgttagtgggatgtttaagtcaagaggaaggccataaattagaggaaatattagaaatgtcagccccagtatctactaggccctcaaacttttttccttgaaggcgtatggtgcaggtgggccattgtttagaaattacgttaatcaaataagtggctttttcaccaccagagcccatcccagggccccgtgtcttatctcctttgtttaaacaatattaggtagtgaaagtaattgagcaattgactcactggccggaatggaaacaggaaccttggcagacaccataagtttaatctcatcagaggaatcagaattaatgagacaagtatgaactatgatacctttagcagaggtggataccctacatcctacataacaccaggcccaccgaaccttgagataaagggccagtgacccctctggggacaattaaaggcaaagaattaggtagtaaatttagaggaatggtaatacagagatcgacccccctgacccctactgtggaggtagacaagcactgtactgagatagaagaagaggatgggacccatctgggttggctgtaggtaaatttgtttgtgctgggggctacgttgggaccacttgaagtggaaatgcaacattggtctgagtctgaggtgtcccatttgatattggggtctgggactggccccacttcccatttccctggttctgtggcaagggatttgcatctatatcagacttagaggggcaagtacttgcccagtgtttatctttagacaacatgggcaaacagtagtaggagaatttgactgtgtttgttgagccagcttggctgcttttaagtttttaacaggctccaagaaaagaataagttgagacagtttgactgccatccttcatggcctgtgcccacagaatagctttgtgggtctctgatccaatgccttcccaagctttaatatatgcaggcaacacctcatgatcaggaaaattttgtctttggatggaacacatggcaattttacattcatggttcacattctcaaaagctaacatatgaaggagaataccttgagcatgctcatgagagacagatttttcaacagcatcttgtaatttagccaaaaaaatgagggtataattctgaccttgtttaacactagtaaatgaaacaggagcttggcctggggtgtgtaatttatcccaaactctcatacacaacttcgttacttgttccatggtgagagcatcaaagcctaattgaacgctagtgtcagagtaattatcagagcctgtgagctgagcctgagtaattagaatgccatcagcccaatttagttgagcctgcagacgggcctcctctgaccaccaggtacagaattgtaaatgctgagatgcagttagaacagcttttgccaaaaagtcccagtctaaaagaagcaaaatgacctcagtacaaagagtctgtaataccattttaacatatggagaactaggaccatactgaataaagagatccttgaattcttttaaaaaggtaagattgagcagtgcataccaaagcacttgtaccccttgagcatcaggaggttccagcatgaccggataagcctacatctctaatccacttgtttctttgttctggtgtaataagtgttgcattaaagtttcaagaacaggcacatgagacggagttggcatagaagtgacaggaaaagtatgtgcagataagagaaactgaggttgaggaggtcagactggtatgagagtgtgagaaaggggcattgggggagcacaagaggcagaagcatactggtgattattgtcccagtcctgtgcaactagagtggcaggagtgtccttgcatgaagaagcgtatagagaagcaggctgagtggatggcaaagtgactgattgagggaccaaaatgacaggagggtgaggagctgtggtggatgggggagggcctacagaattacaggtaaattatagtttggtcctggagccattaggggtctccggaggcaaagcctgcaaacgtttgaagagggaagagttagcatagatatggtcctggctgtccaagttggggccacgggagctacaagtaccggctcttcatgaaaagaaataagatcatcaggggagatgttaagccaaagtcactggagttagatattgaattctcaacattgtcaggtcagggaggagtaggcaaagggagaggctgagcagataatgaaggccgagtgggagaggaaagctgaggaagaggtagagggttgccagatttagaaaattgtggtaactgcaggggacacgggattggtatgtcattaggacaccaggtaccaagtcccaatcaccccaaacagtgatggcaacataatttcctgtcaggaccagttcccagaattttgcaccaacatgatcccatagttccacatctaacgttcccttttcaggaaaccaaggacagtattcttccactgccctgaatagggtgaccatattttccttgggcaccagaactccaccaagttttaacaggagtttaatatagcagagataagcaaaatgtttagactccatgtgacccatagttaccgcagacaatacacagacaactcaccaatcgtcagggagtcaaacaagcatttctgtggactggaccaatgaacattcctccacacctaccaaagggaatcaggttcccacatgcacttaggaaaaagaaaacaacattggcacaccagttattggggaaaaccacccccaatacttcaacatatgttctttctattttccataagtgtcggccggctgagaaataaagagaaagagtacaaagagaggaattttacagctgggacaccaggggtgacatcatatatcagtaggaccgtgatgcccacctgagccttaaaaccagcaagtttttattaaggattttaaaaggagagggggtgtatgaacagggagtaggtcgcatgcttcaaggggcaaaaagcagaacaaagatcacatgtttctaagggaacaggacaagggcaaaatcagaactcctgataagggtctatgttctgtagtgcatgtattttcttgataaacatcttaacagaaaacaggatttgagagcagagaaccggtctgaccaaaaatttaccagggtgtagtttcccaatcctagtaatcctgagggtactgtgggagatcagagcatatctcagtccttatctcaactgcataggacagacattcccaaagaggccatttatagacctccccccaggaatgaattcctttcccagagtattaatatcagtattccttgctaggaaaagaatttagtgatatcttccctacttgcacatccgtttataggctctctgcaagaagaaaaatatggctctttttgcccaaccccacaggcagtcagaccttatggttgtctttccttgttccctaaaaaccacgttattctgttctttttcaaggtgcactgattgcatattgttcaaacacacatgttttacaatcaatttgtactgttaacacaattatcatactggtcctggggtgatgtacagcctcagctaatgaagataacaggattaagagattaaaataaagctaggcataagaaattatggaggtattatttgggaagtgataaatgtccatattaaaatgaaatcttcacagtttatgttcctgtgctgcaactccagccggtccctccatttggggtccctgacttcccccaacgctatgttagtgagttttttcagggtaggttacttttttttttgttttgagataaagtctcgctctgtcacccaggctaaagtttactggcacaatctcaaatcactgcaacctctgccttccgagttcaacccattcttctgcctcagcctccaaagtagctgagaatacagatgcatgcaagcccagctaatttgtgcattattattgtagcaggacaagctgcagacaaaacccttcagacaccaagttagagaagaaagggctttattcggccaggagctttggcaagactcacgtctccaacaactgagctccccaagtgaggaattcctgtcccttttaagggcttgcaactctaatggggtccatgtgagagggctgtgatcaattgagcaagcaggggtatgtgactggaggctgcatgcactggtgattagaatggaacagaataggacagggatcttcacagtgcttttcttgtacaaataactgattaggtcagggttgtctgcttatggatttcatttctgctttttagtttttactgctttctttggaggcagaaattgggcataagacaatatgaggggtggtctcctccctattccccccctttgagaatctcagtagtgggagttctcactttcattctggctacccgtgtcttcttacaaggcagatcgatagtgattcaaatagtacacttgtgctgaaacattttggtgaactaaggtagcagtgaagctttttatcatttgaaaaagtacaggtagcaaacaagggagcagtaagcaggttcctattactattataactcttattataacagttttaaatgctcctagcactggaaaccattttctaaacttggcaccaggatcaaatccatgccacatttgcacaggcacatgtgccagttttgtcatatctctaactatgtcttcaattacttgcccttggtcatctatgtgtagacctcaattagtaaggttaaatttcccacagacccctccttcagctgctagtaagtagtcgagagccaatctatcttgataggtaggatttctcatctgagtttcttgccaggccagaatagtcaaggctctgccagttttattagtggttatttctaagacagcttgtaaccatatcatttggttgagcatgtaaatggggttgtagtatccccacgagccgtattgtgcccaagtagcaggcccataatattgtgtgattctctcagggagccattcatcatcttgccaattccctatggctatgcttctcttttcatgagaagcatagacagggaagccaggagttcacctgtctttatgggcaataggaagaaagattgtttaatagtgccaataacacaactacctgcccactggttgggtaatttggcataagctctatgcccacatatccagtataatccagtgggggctgtccagtcctggtgggactctgggtgggtctacacggtttgcaactttgggaatttactaaatggattcctttctgtgtgatttgaactgtaccaagtgactgtttttgtggtaccattatacaatttatgtcccagacaaataagttgtcctatgggatgagtgaattattttccttctctagctatgcaatattgtccaataattgaggcttttagggcccagaaattatcagggtgattcttttgagccaggaattcaacaggaactgggtctataggtactaatccttgggcttcccatggccaatgatctcccattacagttcctccacacacataacatgaagtgttattgagagactgggctatgtgctcagataattgcaaaaacaaatttcttgtttttctgggaatttttggtactggtacatttagttcatcataggaagtttgaaacactgtctcaggagagcgtttgtaaacttctcctcaaactaagatatttacttgaggatcccatccagacccgtcaattcctaaggtcacacactcctcttttttccagtgaggatcaaggggatttgttattactagctctgtggggttacattttcccttaatacaggaaaggctattttttccttcctgaaagtggactggatccttttcattttttatccaagttgcccaagtgacacaagaccaatatccacattcattgccacacaatcctaattcatgacaaatgtactttttttcagtcatatagcctttttcccaactaaaagagcgaccttgccttcctaacttattgctattaatgacagcactggcatcaaatctcaagattatgcgtttgggcacccctttttattctgttgtggtcaatactttacttgtatcatttatgagtccccaccagacttcagtccttaatctttgttaaaaaactgtggacatgggaggctcagaacggtcataacacacatctggccagtcttttcctgggctacataccttgtactgagtgccattatataagcatgttccttttaaagtccctagacattcatagtaactatagaacagaaagattgttttaacttgttgccctacctcggtaacctgatgtatacactgagagcagtcctccatgtggggaaaatcagtggaagtttttactatacaagcccaaattataaggaagatgagtcccacgatgatcctcctcatgctttggccgtgcatagaccagtcagcttctgggtgtgactggagcagggcttgtcgtcctcctcagagtcactttgtagggggtgtccgggctcggttttgcctcccaggtttcagcggctgcaggtttcacacagctgtggtggatccaggctgggattccttctacctttacagctgtgggggtggtcaggatgacggtctgaggtcctttccaccgtggcctcaaaggggctatgttgcagtctttgatccaaatgcaatcacctggagagaaaaggtgaactggggagaataagctgatgggacatctctcatttacccaagttgagattgtttgtgtaatttttcctaaagcctgtagctgtcactgtaattcaatttcacctaactctcagggaatgcctggaagcccccatagtataggaggaggtctatgatacagtatttcataaggggagtatcctgttttcttagaaggagtgcatctaattttaaacaataccataggaagggcctgtatccactttaatcctgcttcctgacatactttccctaaactatttttaatagtccgaatcattggctcgacctttccggaactctgaggtcggtaggtggcatgtagcttccaagtgattcctaatgcctttgctgtcttctgtaccaagtcagccacaaacactggcccattatctgagccgattcataagggcagtccaaacctaggaataagatctcagagaagcacacaggttaccttgggggccttttcagttctttttggataagcctccacccacccagagtaagtacacacaggaaccagcaaatacttgttacctgcacatttctgtgaaatccacctgaggatcctgaaaaggagctgctacataagcttgtatgccaggcagaacagtgagacattgcctcatattgtgctgtcggcaagtaacgcactgtttggtactgctttggcaagggctgggaagcgtgagatgtagaagtaccagcctaacaatttttcaaatgactcttgacctagatgagtggtttcatgcatggccaatacaattgtggctcccagcaactgcagcacagctactctcccatctggcagtctgatccatcctccttttattacttgcccccttctgtgtggaagaagtctttttctttcttaggtaggtaccaggtcaggtatttgagggagtaagggggctgctactgatgcctagtatggggtagatgctgcttttcgagcttctgagtcagctcgggagtttcctaaggccactgaggtggagcctcactggtattccctgcagtgcatgactgccaccttctgaggtttccacactgcctccaataattgtagaatttcttgttgatattttatgtcctttcccccagagtttaacaggcccttttccttatataatgctccatgcacttggagggttagaaaggcatgtctagagtcaatgtagatatttacagtcttaccttcactgagttctagagctcgagttaaagcagtgagctcagccttctgggctgaagtgccctgtggcaatggtttggtttcaatgacagcatccaaagttaccaccgcatattctgcacatctttctccttgtgggttgatgaagctactcccgtccaaatataactccaagtctactgatgcccatggctggtccctaaggtcaggtctgctagaataaactgagtccaacacctctacacagttatgctcgactgggctctctgatactgggagcagggtggtgggatttagggtgttacagacttcaatgtttatgtggggattttcacatagcaagctttggtacttggttaatctagcatttgttagccaatggtgtcctttggtgttcatcaaagttaccacagcatgggggcttttatattcagatttggcccaagggttagtttatctgcttcttgtgctaacagggctgttgctgccagggcccttacacatggtggccagcctttggagaccccatctagttgttttgagagataggccactggccttggccaggaccccacagtctgggttaaaactccaactgccattgtttctctttctgacacatagagtgcaaaaggctttgtcaaatctggtagtcccagggctgggaccaatgtaagtttttcctttaacttacaaaaggcttgctgttgtagaggcccccattcaaaaggctcccagttgcccccctttgtaatgccgtacaaaggtttggctagcactgcaaagtttggaatccataatgtgcaaaaccccacagctcccaggaattcccttacttgccttctggttttaggttccggtaggctgcagatgacctgctttctttctgaccacaggctgtgctcccctttccaaatagtgaatcccaggtagcgtacctgctgtctgcagatctgagatttcttcttgggcaccttatacccacagtcctccaggtgctgaaacagggcatcaacccttttgagcacccaactgccatggagtgtcccagcagaaggtcatccacgtacaggagcaagacatagcttaggtctttagcaggaaacttttgcaagtctcaagtcagagcctccccgaagatagtaagggagttcttgaacccttggggaagccagttccaagtgtactgagtagtgacacctgactgtagatcttcccaccgaaacgcaaacagcttctggctctcaggagctattctgatgctacagatggcatcttttaagtccagatgggtaaaccagatgtcctcagccggcagcagccctaacaacgtgtaagggttaggaactgttgggtgcagagtcactgtagcttggttgaccaagcgcaagtcctgtactggttggtagtccttggtccctggcttagggactggcaggaggggggtgttccatggacactggcaaagaactataattccataggctttgaagcacctgagatgaacccggattccttcgagagcttccctgggaagggatactgctttcatctaatcagttgggcccaggcttaacttctatgagtatgggggcttggttggccgccagtcctggaggattatcctctgtccattctcaagaccaacgctcagctagagctggttgtatctcttcccattcttcttcccaggggactgtaaggacaatgataactcctgttcccagtaactttagctgtaaagagccgtgttttgtaaaggagatggtggctgtcagcttgctaagcaagtctcttcccagcaagggcaaggaacagccaggcatgtacaagaactggtgaactacttcatgtcttgccaccgagtaggtccgtggcagacagtaagtctacttagtagaaactcctgttgctcggattatatcaatggttttcttggacaagggggtgaccggggtggtcaataccaaatgttcaacacctgtatcaaccaaaaacttaatatctttgcccccaattgtaatcctgaccgtgggctccttgggggtgattgagcccagtccccttcagtccaatagcccttcagccagattgaataaagctccctcatctttatctgaggtcttttgttctgaatcatgttgcttttccttcagttggggacacttatttttccaatgtcccattttcttacaataggcgcattggttacattgcaagcgtgggtgattagacagggtattattcccagaacccccctttccctctccttttgggggaattcccctgatggccacagccagtaagttggcgtttcgcctggcctggctttcaccttccttacggctttctctgtggcttgttgcatctctattcaaacacttgattggctatttccagtaactgtgagatattcatacacttaagcccagcctgtttctgcagttttctcctgatatcttccacgctttgactaactaaggccatgttgatcatgtgctgattttcagggctatctggatcaaaatgagtgtacatactgtaagcctcacaccgtctttcatagaattgcgctggactctcctctttttcttggatgacctcagagatcttatttacacttgtagccttttaagcccctttctttagaccttctattcatgcatcatggtactgtcttagcctctccatgtctggtcactagttcaggtcccattgggggtctgttcctggcagctgaattcttatatattcttggggattttggtaatccactgggatgtgctcctctggccacttagttgccacccggagcacccttagcctttcatcaaagaggtacatgaacagctggtggcaatcagcccaagtaggattatgagtgtgtataatagtttggagcaagtcaattaaagcttgaggcttttcagtgtaagcagcagtattatttttccaattgatgaggtcagcagaggtgaaaggttgatacacaaagtcacgcctttccaccatgtgtccatcctcatctaccccagtatatcactgctgtctcaggggcatttggattccagtcttgggccgtaagtgagctgccaagggaggagtttctcccgtggcttcacttcctcttttgtctactctgggtggtctaggagtgtggctatctggtggaggtgtgggtgctgtgggctcaggagtgggaagcccttcctcttgcaattctgaccatgattcttctggtattgggtcagacagggcttttggtgccggcttccctcagcaggtggagtgagaaccttccttaactaactgtccctttgctactagtactgctgctgcctgtcctcttaactactgtggggggtccaaaactagctctaaccgagaatctttatacaggaactgatcggggtgccctggcttgtaggttacactgtgccataccttcaatacaagggacctgttcaggcttccttctgatggccaacccacctttaatgctggccagtctaactcacacaaagttctaagttttcttggtgtcatagtaactccatagtctcccttaaatccctttttgaaatttttcaacatagctcctagtggggtgggcctactttgtgcctgacccatgtttcctcgagacaaaacactgcgcttacaccacatgcacaccacaaaacaaaaacaggtaaaaagggcacacacacactttttcagtttacaccaaaccagaatcagaaccaaaatcagagtatcaagaaatccaagccaggtcaaaaccaaaacctaagtatcaagcaattcaactcaactcaaaaacaaaaaacctaagtgctggtatgggcacgtcatgggtgatcaggccacgcttccactcaaatggagtaggcaagttccaaagactagtcttaccaagtttcagatgtctggattccaagtgccagttccttcctgatgttcagccactgcagtgatcctccatgggggcctgccacacactgctctggtgaggcattccactggcgcagttgcctacccgggagcactctcaggatccgcgttgctcaagctggccagagtcccctgcagggatgcttcacagggcaggcctaagctgcctaagtggctgtctcaatggtcctttaatcacctgcttcccagtcagggaaccaagaaatgtagcaggacaagctgcagacaaaacccctcagacaccaagttaaagaaggaagggctttattaggccgggagctttggcaagactcacatctccaacaaccaagctccccaagtgagcaattcctgtcccttttaaggggtcacaactctaagggggtctgcatgagagggtcatgatcaattgaacaagcagggggtacatgactgggggctgcatgcactggtaattagaacagaacagaacaagacagggatcttcacagtgcttttcttatacaaataaccaattaggtcaggggtcgatctttaactaccaggcccaggttttggtgccaggctgtctgcttgtggatttcatttctgccttttagtttttacttcttctttctttggaagcagaaattgggcataagataatatgaggggtggtctcctcccttattattagagaccacatttcaccatattggccaggctggtcttgaactcctgtcctcggtgatctgcctgccttggcctcctaaagtgctgggagcacagtcttaagccaccgagcccagcctcagtgtaggtttcttaacatcagtttattgtgtttattgggtttacttacgtattataaatttagacaattttcaattctgcttgtactctttaagtcaacttgagtttcaactgaaaaataaataatgcatgtgtatcccaatcagattacatgtgtatgcattgtcacacatgtccatgtgaagagaccaccatacaggctttgtgtgagcaataaagctttttaatcacctgggtgcaggctggctgagtccgaaaagagagtcagcaaagggagataggggtggggccattttgtaggatttgggtaggtaatggaaaattacagtcaaagggggttgttctctggtgggcaggggtgggggtcacaaggtgctcagtgggggagctgctgagccaggagaaggaatttcacaaggtaatctcattagttaaggcagaaacaggccattttcacttcttttgtgattcttcagttacttcaggccatctgggtgtatatgtgcaggtcacagggtatatgatcgcttagcttcagctcagaggcctgagattcttgtcttcttatattaataagaaaaataacataaaatagtgttgaagtgttggggcagtgaaaattttggtggggtggtatggagagataatgggggatgtttctcagggccgcttcaagcaggattaggggtggcgtgggaacctagagtgggagatattaagctgaaagaagattttgtagtaagggcaatattgtggggctattaaaaagagcatttgtcatatagaatgattggtgatggcctggatgcagttttgtatgaattgagaaactaaaccaaagacacaaggtctgaataagagaaggagcaaaacaggtattaaaggactaagaattgggaggacccaggacatccaattagagagggtccaagggggttcagagtaattacttgtttggttggtgagttttggggctctattcttgacagagtcctttttgttaagttggaggctgagcttgctgaggtatgttctgaaaagaccattaatccattctacctttcctgaagattgaggacagtaaggggtatgaggtttcaatgaataccaagagcctgagaaactgcttgggtgatttgactagtaaaggctagtccattattagactgtatagaggtgggaaggccaaactgaggaattatgtctgacagaagggaagaaataacaatggtggccttctcagaccctgtcgggaaggcctctacccatccagtgaaagtgtccacccataccaaggagtgttttcatttcctgactcggggcatgtgagtaaagtcactttgccagtcctgggcaggggtaaatccccgagcttgatgtgtagggaagggagtgggcttgaataatccctgaggagtagtagaatagtagatggaacactgagaagtgatttccttggggatagatttccatgatggaaaggaaatgagaggttctaagaggcagtctagtggcttgtaacctacatggaagaagttatgaaatgactacagaatggaatgggtctgtgaggctggaatgagatattttccttggtccaagaatcatttgccttgtgtgggaagagattgataggtgaaagtttcagtgggggagtaggtgggagtgaccagataagaaggagaaaaactgccatgagggatagaagttggaatgctagctgctttttagctaccttatcagcataagcattgtcctaagtgatgggatctgatgccttttgatggctggttttttagctaccttatcagcataagcattgtcttaagcgatggggtctgatgccttttggtggcctttgcagtgaatgactccatcttcctttggaagtaaagccgccttgacaagagtttttattaaagaggcattaataatggaggacacttgtatagtgagaaaacatttttcagcctatataacagcatgggggtgcaggatatggaaagcatgtttagagtcagtataaatattgatgcatagtccctttgcaagattgagggcctgagttaaggcaacaagtttggcttgctgagaggtagcacagaggggcagagcggtagcctcaatgatagacatggaagatactatagcatagcctgcctttgctggtgagtggcaattaggcctggtggaactgccatcaataaaccaagtgtgatcagggttaggaacaggaaagaaggaaatatgaggaaatggagtgaatgtcaggtggatcagagcgatacagtcatgtgggccagttgtggtatcaggaataatgtgggggccagcctaaaacagtaaggtcaagttgtttggacagaaaggctacacagtgcagtcccagctcttgtgtaagaattttgaccacacagccctgtacttcggctgcatgtaatgaaaagggttgcgatgagttaaggagagctagtgtgggagtagcttctagggctgcttttaaggaatggaaagaggagtggtgaaaggatttaggatctgtggggtcagctaggtttgctttttgagtttatacaatggtttagtcaggatggtaaaactagatatccaaaggcagaagtacctaaccatgactaggagggaaaggagttgttgttttctagaaggggttggggtttgggagattagctggacacaatcggtagggagagcacatgtgttttcatgaagaattatgccgagataggtaatggatgagaaagaaatttgggcttgactgaggtaatgggagctgtctgtgaagccttgcagcagtacagcccaggtaatttgctgagcctaatgggtgtcagcatcagtccaagtgaaagagaagagaggctgggatgaagggtgcgaagaaatagtaaagaaagcatgtttgagattcagaacagactaatgggttatggaggggttgtggagggaggtattgaggataggaaagtatatggttttgacaccaatgggtggataggcaagacaattggttgataaggtacagatcctgaaataacctgtaagtcttgtctgggttttggacaggtaaaatgggggaattgtaaggagagtttataggctttaaaaggccatgctgtaacaggcaggtgataacgggctttaatcctttggggtaagggtgattaggttttaatgggatggtaagaggtgcatgaattgtcaccaaggagggagtagaggtgtcctatacttgtggattaaaatggggagatacaaggggaggatgtgaaggaggctttgaactggggaaaaggatggcaatgaggtgtggctgtagcctaggaatagtcagggaagcagataatttagttaaaatgtcttgacctaataagggagctgggcaggtggggataactaaaaaggagtgcgtaaaagaatgtggtccaagctggcatcagagttggggagttttaagaggtttagaagcctggctgtcaatatccacaacagttatggaggcaagagaaacacgcccttgaaaagaaggtaatgtggggtgggtagcctccgtattgattaagaagggtatggactcactttccactgtaagagttacctaaagcatctgtgatggtccaggaggcttctgaggtgattaggcagtgtcagtcttcagccgctaagccaagaatatctgggaaggagtcagtcagagagccttgggctagagttccaggggctctaggagtggctgccaggcgagctggacagtctgattcccagtggggtcccgcacagatgggacatggcttaggaggaatcctgggctgcaggcattccttggcccagtggccagatttctggcacttgaagcaagatcctgagggaggcggtcctgtaggaatgcctgaccactgtggcttaggcattttgaagttcttgtgtgctggaggtgtggctgggttttgtctcatagcagaggcaagtaatttttactcttctctattattgtacaccttgaaggcaaggttaattaagtcctattgtggggtttgagggcaagaatctaatttttggagcttttctaatgttgggagtgggttgggtaataaaatacatattgagaataagacggccttctgccctttctgggtctagggcggtaaaccatctaaagttgttgccaaatgggccatgaactgggttgagtttctatatttgatgaaaaagagcctaaatgctaactgatttgggaaaggtcagataaagaaaaaggagtgttaaccttggctatggcttcagctccagccacctttttaagaggaaattgttgggcaagtgggagagggctagtcatggaatgaaactgtaagccagaccgggtgtgaggaggggaggtgataaaaggattatagggtgggggaacggaggctgatgaagaactgggacctggcttggcctggcgaggagcagcttggggaggagaggacaggtgggtctgtagaaaaggaagattgaaaagactcagtgatgcttggggttgggactgaagggacaggtgggagggaaagaaggaggatttgtgatgagtcgcattgggaacagagattagggagggaccaatgtgtaaaagaatgcctggacatcaggcatctcacaccatttgtcttttttgacaaaaatcatccaggtcttgtaaaatggaggaatcaaaagtgccattttctggctatttagaaccattatagagtttgtattggggccaagtggtgttgcagaagaaaataagatgcttaggttttaggtcaggtgagagttgaagaggttttaagtttttaagaacacaggctaagggagaagatgcaggaatggaggtcagaatgttgcccatagtgaaggatgtaagtttaaggagaaaggtagagacatggagaagagggtggtgagcagccctgggctgcaatatgggtgagcatccaaagcaggtgtccccgcaattaacttgccaccaagggaatgtgggtgaatgaccaaggcagatgtccccacggtgatcagacgccaatgaaatgtgggtgaataatcaggcaggcatccccacagtgattaaacaccaagggaaaactgtcttcctgagtctaagactggcaccggagttttgggtccacggataaaatgtgtctcctttgtctgtactagagaggaaaaagaactggagttggaaggacagggagattgaagggtagcaagagaggctggagaagagagtgaaaagaccgcttacccgatttgaaattggtgagatgttccttggactggttggtctgaggacccgaggtcataggtagatttcctcacggagtgagggcggggacaggcctcccgaaggattacctctgtcctgggtttttggcaccaaatgtcatgcgtgtccatgtgaagagcccaccaaacaggcttcgtgtgaacaataaagctttttaattacctgggtgcaggcaggctgagtccaaaaagagagcgaagggaaataggggtggggccattttataagatttgggtaggtaatggaaaattaccgtcaaagggggttgttctctggtgggcaggggcgggggtcacaagatgctcagtgggggagcttctgagccagaaggaatttcacaaggtaatgtcatcagttaaggcaggaacaggccattttcacttcttttgtgattcttcagttacttcaggccatctggatgtatacatgcaagtcacagtggatatgatcgcttagcttgggctcagaggcctgacatgcgtgtttatctataaatacgatgccaattttacttatggcttatctcatattctttgttagctgattttcgatggtagttttatcttgtctaagtgagtagtcgtggagatagtcattatcacgatgtgtttaatgatgaatatatattttctttttgtgagagaaacacttttgtgatttgaagttaatttttaaaaagatttaccattctgtatttttgtcagtttttccttgaaaacgttgttttaaaaacacataacataaaatttaccatcttaaatttattgaagtgtatatttcacagccagctgtggttgtggctctcatctgtaatcccagaattttgggaggtcaagacaggaggatatctggagctgaaaagtttgagaccagcctggggaatacatggagacccctctccataaaaaaaaacttaatagtagccaggtatggtggtgtgcagctgtggtcccagctacatgggagattgaggaggagtcaaaattgtgcctctacactccagcttgggtgacagagtgagaccctgtctcaaaaaaaaaaaaaaaaaaatgctgttcacttcaggcatgttaagtatattcacattgttgtgcaaaagatttctagaaactttacatattgcaaaactaaaactcagtaaccattaagtaacaacatctcattttaccctctctccagcttttggcagacaaaacttccactttttgtttttatgattttgactacttaagatatctcatataagtggaatcatacggtatccataattttgttactggattaattcaactgacataatattctcaatgttcatcttaaaatgtgacaagattgttctttttaaggtggaataatattccatcgcatgtatatgttacattttttgatacgtttataaatcaaggaacatctaggttgcttcagacttttggcttttgtgaatactggtataataaagatgaattttcaaatatgcctcccaggtccagtgttgcattttttttttttttttttttcccgcagacggagtattgctttgtcgcctaggctggagtgcagtggtgtgatcttggttaactgcaacttctgcctcctgggttcaatcgattctcctgcttcagcctttcgagtagctgggattatagatacccaccaccacacccagctaattttttgtacttttagtagagatggggccaggctggtctcaaactcctgacctcaggtgatctgccccctcagcctcctaaattactaggattataggcttgagccactgtgcctggccttcgttacatattttggatatagatttataaatgaggaacatttataatttttaaaataatggctgcatctttgttttccaccaacattcaatatggatttcatttttattgtatcatcaacagatttggtgttttaaaaaaatttatcatggccatattaatgggtatgaggtgattttgtttgtcattgtggtttttttttcatttctttacaaattagtaattttatgtgtcctttcaaatgctttttctcatttgtgtacttttctaatgaaaatgttgtttgtccgtttctaaatcaagttattcaaccttattttttagttttaagagttgtttatatattttgaatattaacttctttcatgtttaatttgcaaatgttttcacctattttctaagggatgtcattactcttgaattgttttttggtatgaagaaattttgaagcctattgtagttaaaacttttctgttatttcatttgctgctcatgtatttaattttgtatctaagaaaatggtgccaaggccaatgtcatgtctttttcctgtagtttttctaaaagatttgttagtttttttatgtctcagcattttatttaaaatatatttttgtatcattctaggaaataatccaacttaattttatcagtgctgatattcagttttcaacatcatttttttgaagagattatttctattttgtgctcatggcaacttcgtggaagatcatttgatcatatacagaaggattcatttctgagctctctattctgttctttcatctgttcatctttgtttctgtatcacattgtttatattctttagcttttaactgtaggttgtattgacatctttgaaaaataacattttttgacccctgagcaagaatatgttgatgaagagtgtgtttcatattcacaaggttttgaatttgccagtttgacttttgcttttaattcctagtttcattcagcttttgttggaaaacacacagtgtataattttagtgtttttaaagtgatttgttgttgttgttttgagacaagatcttactgtcaccaggctgcaatgctgtggcataactttggctcactgtagcctcagtctcctgggcttgaatgatgctttcacctcacttttctgagtggctaggactacagtcatgcactaccatgtctggctaattgtttgcttctttgtagtgttaggatctcactatgttgcccaggctggtctcatacttctggcaccaatggatcctcttaccttggtctctcaaagtgttaggattataggcaagagccactgcacccagtcagtattttaaaatttaataaaacttgctatgtgtcctaacggaatacaccagatgcaaatagaaatattgcatattatcttggttttgactggagagttttgtgtgtgtctgtgaagcctagttggtctataatatggtttggatgtccatgttctccaaacctcatgctgcaaaataaatcctcaatgttggttgtgagacctggtgggacatgtttttgtatgagggcatatttctcatgaatggcttggtacatcctcttggtaaacaaaaagtttacactccattaattcaaatgagagctggttcattaaaagaacctggcttcttcacctcacacttgctctgtctcttaccatataatatgtccagttactttttaccttctaccatgattttaagcttcttgatatcctcaccagaagcagatgctgacacacacttcttatacagtctgccaaactgtgagccaaataaacattttcctttataaattatgcactcccatgtgttcctctatatgcaaaataactaatatagtctataatgttgtctcagttttctgtttcttattttttatctgaattctctatttatttcttcaaatggggccttgatgtctgcaattattatgtcgctatgtatgtcttgcttcacttttgtcaatatttgctttatatattttaaagcccttatgttatttacacatatacatatagatagataaatactataaattcctgctaaatcaactcactttaccataatataatatcaatcattgtctcatggtagtacttaaagcatattctgcccaatataattatgaccacctcactcacttgtggttactatattcatggaatatacatttttttattctgttactttcagcctatttgactcaatgattaaattagtctcttgtaggcagcatactgtatgctttataaaaaaccactcaggcattctatatctttttctttatataattttatatatatatatatacacacacacacatatatatatatacacaagtgtatgtatatatatatatgtgtgtgtgtatgtatatttttttccagatggagtttcactcttgttgcttagactggagtgcaatggtgtgaccccagttcactgcaacctctgcctctcaggttcaagcaattttcctgcctcagcctcccaagtaggtgggagtacaggcgcctgcaaccacacccaggtaattttttctattttaagtagaaatggggtttgaccatgatggccaggctggtcttgaattcctgatctcaggtggtctacctgcctcggcatcacaaagtgctggtattacaggcatgagccaccacatccagccttgtgtattttggagatagtgtctcactctgtcaaccaggctgatttgctcggttcactgctgcctgaatctcccaaactcagatgatcctctcatatcagcctctcaagtagctgcattacaagtatgtaacatcacacccagccaacttttttttttgtattctttgtcgagacagattattgccatgttgccgattctggtcttgaactcctgggatcaagtgatcagcctatcttggccttccaaagtcctgagattatatttcattttattaagtagtttaatacgtttaaatttaaaatgattccttaaagaaatgaagttgttatttccagatatattgttattgtttcatgtgtttctagtagtatatttttctcatttccttttttactctctttaattttgtactggcatgctttgattattttttgttttattttagatactttctttaaacagaatctttgcaatcatcttgaaaactgtagattacatacatcttacagttaaagcaatatattttaatctcatgacaacttcaattgaatacaaaaactgtgcctctatattttccagtttgttgttgatttttttttattaaaatgtgcatcattcttttatttttatttatttattttttattgatcattcttgggtgtttctcgcagagggggatttggcagggtcataggacaacagcggagggaaggtcagcaaacaaacaagtgaacaaaggtctctggttttcctaggcagagtgtttgtgtccctgggtacttgagattggggagtggtgatgactctcaacgagcatgctgccttcaagcatctgtttaacaaagcacatcttgcaccgcccttaatccatttaaccctgagtggacacagcacatgtttcagagagcacagggttggggttaaggtcatagatcaacaggatcccaaggcagaagaacttttcttagtacagaacaaaatgaaatgtctcccatgtctactactttctacacagacacagcaaccatccgatttctcaatcttttccccaccttgcccccttttctattccacaaaaccgccgttgtcatcatggcccgttctcaatgagctgttgggtacctcctcccagacggggtggtggccgggcagaggggctcctcacttcccagtaggggcggctgggcagaggcgcccctcacctcctggacagggcagctggccaggcggggggctgagccccccacctccctcccggacggggcggctggccgggccgggggctgagccccccacctccctcccggatggggcggctggccgggcgggagggctgagcccccccacctccctcccagacggggcggctggccgggcggggggctgaccccccccacctccctcccggacggggcggctggccgggcagaggggctcctcacttcccagtaggggcggccgggcagaggcacccctcacctcccggatggggcagctgaccgggcggggggctgacccccccacctccctcccagacagggcggctggccgggcagggggctgacccccccacctccctcccggacggggcggctggccgggcggggggctgacccccccacctccctcccggacgtggcggctggccgggcggggggctgacccccccacctccctcccggacggggcggctggccgggcagaggggctcctcacttcccagtaggggcagccgggcagaggcgcccctcacctcctggacggggcggctggccgggcggggggctgagccccccacctccctcccggatggggcagctggccgggcggggggctgaccccccacctccctcccggacggggcagctggccgggcggggggctgaccccccacctccctcccggacggggcgactggcctgacgggggctgaccccccacctccctcctgggcggggtggctgccgggcggagacgctcctcacttcccagatggggtggcagccgggtggaggggctcctcacttctcagatggggcggttgccaggcggagggtctcctcacttctcagatggggcggccgggcagagacgctcctcacctcccagacggggtcgtggccgggccgaggtgctcctcacatcccagacggggcggcggggcagaggcgctccccacatctcagacgatgggcagccgggcagagatgctcctcacttcctagatgggatggcggccgggcagagaccctcctcactttccagactgggcagccaggcagaggggctcctcacatcccagatgatgggcggccaggcagagatgctcctcacttcccagacggggtggcggccgggcagaggctgcaatctctgcactttggggggccaaggcaggcggctgggaggtggaggttgtagcgagccgagatcacaccactgcactccagcctgggcaccattgagcactgagttaacgagactccgtctgcaatcctggcacctcaggatgctgaggctggcggatcactcgcggttaggagctggagactagcccggccaacacagcaaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagcacagtccagctttggcttggcatgagagggagaccgtggaaaggggaggagagaggggagaggggagacgggagaggggagaggggaggggagaggggaggggagccggagtcactcttgttcgaacgcctccaacactatgactaagtaaaggagaatttctgttgttgattttaaaattattctatatggtgtatctattaacatttatgcggatttccatatttttatattctataaaagtactttaaaggttttgtgtaccatcattttgttagtttgttttgttttgttttgaatcgagtcttgccctattgcttaggacggagtgtatagatgtgatcttagctcactgaaacctcggcctcccaggttcaacaattatcctgcctctgcctccctagtagctgggattacagatgcctgccaccaagcctggctaatttcttgtattttttagtaaagataggctttcactatgttggacaggctggtcttgaactgctgacctcaggtgatccacctgcctcagcctctcaaagtgctgggcttacaggtgtgagccacagcacccagctggaaattactttttatctcactattcatagcatttcatatcaatacaaagattgacacatctagatataaatatacatagggagataaatactcacatagagaattctataaatatttctatctaaacatttatgtatacaaaacatgttccccaaaagacatttttaatcttttagcatgcactgaagatgctgatgtagaattacttcttttttcttttgctaaataacatgtcagaatggaacatagttatacaattttgtttatgtaaatatcaacaaagctctatcttcaaaggcaggccacagaaataagctgaaaagaaagtcatgtaacacatctgtccaggacagtatttcagcactctgcatgtctcctcattctgtgcatgttgtgttcacacctaccatttggggcctgtctcgacaaagccacagtcaccatttagataatttgataattgtatacacctgggctgagctacttggctggttgggatcacctgggctgtgcaaactggctgattgcaatcacctggtttctgctaatttgcttaatttatctcagcttcaggggtagaatacggagatgtcatctgacctactttatttctgaggttttttttaagggtcatatgcagaaataaacatttcatagacatacccatgtgactcattttgtgtgtatatgtttatcgagccacctattttgtatctatatgtacagaaagaagcctataaaataaacttgatctgaggctatttccattttctttacctacaggttaggtaaatcagtcagctactgagctcagtgaagatttattcaaaccaagccacacaccatattacattttttcataaatgtaaaaatatctttaataacctggaacctgggtgtttttaattctcatcccattaaaccagccccatgaggttctgttcgtctatctaggaactgccagaaatgcttgacatcagtgggctgagccttcctcacaaagcagatttgacctggcaaataagagccacctgtggcacttcagtgaatgttcactatcacccatttgaaatgtggccaagtaccatgtaccattatatttgcttccatcatcatcatcatctatcttctaaaaagagacctagacttctttttcattaccataaatacctgacttctgcctcaaagacaaaaagacaagagtgtgattttacatcacacactcttggaaataaatacagttcttgtcttgatgaaagttctaaagagaaagaataagtattctcatatttaggttaggacctttggactggggctggttcatctctgaccctacatacaacaataaaagaaaagtcaatcctgacatggcagtaaataactccaaaggccttagtaagtattcatcttccagaagcgcacaacaaagcccagtgcttcctttgaatatattaagtgcagcaggatgtatatcagagcattcctctatttctgtactattctagatatagtattctatagggaaaagatttttatacatgtatgaaaggtttttgtattactgtttgtagcaatagctatcaatacttccacattcaatgtctttattctgtatgaatatatataaagattgttccagcttcatatatatatacttatacatattaggtatgtatatgaatatacatacatggtagatacataaacacaaacatatgaatgtgtctttgtaaatattaatgtatacatataatattctcccactttttaaattatagagcgtatactaaggatgcaggtgtagaattaattgccttctgttttgctcagtagcatgtcagaataaaacatagccatacaatgttgtttatagaaacataaaggttcagcttcaggtttcaggccttgtaaagctgtgtggtatatactgtccaggtgagcaaataaggccctgcatttctttttggtgtgcatgggctatttacatttaccattttgggcatacctgaatgaatctgtagccactagttagataattagctgatcgggatcacctgggctgagctaattggctaattgaattcacctggactgatcagttggttgattggaatcacttgggctgagctaattcactgattgaaatcacctggactgagtgaatggtggttcaaaatcacctgtgctaaactaatgggctcatcagttgagctaactggctgattggtatcacctagaataagatagttggctgttagaaatcacctgggctaatcagccgggctgagctaatttgctgattggattctcctgggatgtgctaatgggctgcttggaatcccctaattggctgatttaaattatctaagctgagttaattgattcagaaaagttgaacactgagctgggccggtggctcatgtctgtaatcccagcaatttgggaggccgagtcaggcagatcatttgatgtcaggaatttgagaccagtctggccaatacagtgaaaccctatctctactaaaaatacataaattagccaggcttggttgtgggtgcctgtaataccaggtactggggaggctgaagcagcagaatcgctttaaccagggatgtggaggttgcagtgagccaagattgtgccattgcactccagcctgagcaagagtgaaactctgtctcaaaaaaagaaaaaatatctatctatctatctatctatctatctatctatctactgtcagaggatgataacttgaagtattttagagatgttaagaatctgaaattatttttacttttagtttttataaatgtttcttaagcatttttaatttccaaaaaacttgtaaataatgttgtcagtttaatttttctgaagaatttaaatagagtcaaattatacatatcaaaaaatctacttttctggtagtagatcagcttaattttcagaacaaatgtgttaaacttcacgagattttatgctgaccaatttgatcagtagcctctttcatacaactgggagagatgacaccaagatgtagcattcatgttgggtgagagactaaatgactaccagtagctagataatttctgttttactaataaatgtttattttcatttctatattgtctcaagttatgttaacaataaagtaataacctttatccaggaaattttgaaaacttattttttaatcagccataacagtaagcaaagacagagaaatgaaggtttttaccagtcataatttatatattaaaattaaaatacttctagaaataaagaaggaaaggaagaaagaaatatacaaacaaatgaaaagcagcctggtcaacatggtgaaagcctgcctctactaaaaatacaaaaattagcctggtgtggtggcatacacttgtaatctcagctactcaggaggcttaggcatgagaatcacttgaacctggtaggcagagtttgcagtgagctgagattgtaccactgcactccagcttgggtgacagaatgagactccatctcaaacaaaacaaaacaacaacaaaataaaagagaaggaaggaagttgattactcacaatagctaaggtttgaaatcaacctaagtgttcaccaataggtgaatggagaaagaaaatatggtatatatacacaatgaaatgctattcagcccttaaaaataagaaagtcttgctatttgcaacaacattcatgaacctgaaagatattatgttaagtaaaataagtcagcacagaaaaaaaacaaaatcctcgttttttttttttttgagatggaattttgcttttgtcacccaagctggagtgcagtggcaccatctccactcactgcaacctccagctcccaggttcaagagattctcctgcctcagcctcctcaggacctgggattacaggcatgtgccaccacacccagcaaatttttatatttttagtagagataggatttcccccatgttggccaggctagtctcaaactcctgacctcaactgatccacccacctcagcccctccaagtgttgggattacaggcgtcagtccctgtgcccagcccacataatcctatttctatgtaaagtgtaaaaaaaaaaaaaaaattaaactcatagaagcagatggtacaataataaaacaaacaaaaaatcccctataaggttttttgtctggttaagagagcttcttcaggatttttcaggggttatattttcttttattttccacattttcctgttcttcagccaatggatgaaaaaagatacagagaagacacatttaccttttatccgcttcacttccattcactattattcaatgtggatacagatgagagtagcagttttctagtaggacagccacttctctgcaataaacaaaaaactgaaaaaaaattagcatatgcatcagtaacccttctagtaaaataaagattaattttgttgatttctattgagttcctgtaatatttgatcaaaagctagcaaaagcacagtagaaaaggaaaattgttctaaataagaatattgtgaatggttattttgtcaatataagtaaaaatatgacctcacactaatagtctcacctatagttgtacaacatcaaatgctaatttttatttaaaattttatttcatataagtattcaatttatatcacctgcctctgctatttcaatgcctccttcactttatatcagtgaaaaacaggccagcaggtcctaggaaagcacgtcgtgctattgctactttaacaataaacaggtcaagcatggtggctcatgcctgtaatccagcactttgagaggccgaggtgggtagatcacagggtcaggagctcgagaccagcctggccaatatggtgaaacaccgtctctactaaaaatacaaaaattcccaggtgtggtggctcacgcctgtaatcccagcactttgggaggctgaggctggtggattgcttgaggtcatcagttcaagaccagcctgggcaacatggctaaacctcttctctactaaaaacacaaaaaattagctgtgcatggtggtgggtgcctgtaatcccagctacgcaggaggttgaggcaggagaatctcttgaacctgtgaggccaaggttgcagtgagccaggatcatgccactgtactagaccctaggcaacaaagtaagactcctctcaaaacaataaaatcagctgggcgtggtggcgggtgcctgtagtcccagctactagggaggctgaggcaggagaatcgcttaaacccgaaagccagaggttgcagtgatctgagatcataacactgcactccagcctgggtgacatagcgagactctgtctcaaaaaacaaaaaacaaaaactgatcatgaatagcacttttttggttgctacacacgtgtcaaacactgttatttggcttaaggtactggtttttttttttttctttttcttttttgagatggagttttgctcttgttgcccaggctggagtacaatggcacaatctcatctcactgcagcctctgcccacaaggttcacacaactcttctgcctcagcctccccagtagctgggattacaggcacctgcaaccacacctggctaatttcttgtatttttagtagagatggggtttcaccatgttggtcaggctggtctcgaactccagacctcaggtgatccacccgcctcggcctcccaaaatgctgacattacaggcgcgagccaccacattcagcctggttttctattttttttttttttttttttttttgagacagagtctcatctgtcgcccaggctggagtgcaatggcatgatctcggctcactgcagtctcttcctcctgggttcaagtgattcttctgcctcagcctcccaagtagctgggactacaggtgcatgccactatgcccggctaatttttgtatttttagtagagatggggtttcaccatgttggccaggctggtctcgaactcctgacctcttgatccacccacctcggcctcccaaagtgctgggattacaggcatgagccaccgcacccagccctattttttttctaaatttactggtaatataaaattcttcgctaagaagacatgatcttattcaaatgttttatgagatttcattgatgtctgaattatctggaatattaaaatttttcatgaactcaaatcaagtactatacataatcttttagtaaaagcttttctgaggcagagtaagatttataacattttattatcatatggaagaagtgtattaaccatgttttcagtaatcactctgaacacagcattctcagttcacagtgtaaaaagtgaagtagaggttcctcttcaaagacttttctacctaattatgaatagtaacttctcttagaagcaaagtttattcaaagacctgtgctaacattcttaaatatctgctaagcacaattaaaaaatcaatgtactttatgttcttagctcccacaatttagcctaaatatttgccctggcatgcttatactaatccaagcaagcattaggtcatagcctgttcctcctccttatttgaaggtatttttacctttctcagcattccacaagttacttcctccttcctttgttctcctctgcctttgtctcttttaaaaagttctaagttgctaaacaattgggacatacagaatgtgaggtcccattccagccaatgaaaaccagacacagcagtagggtggacacgtcaagttataaatgactctgtctcctctgttcagtgtactcgtggcaaaactgctttctgcaaaaagtaaaaatggccttgctaagaaaaattaaatttattttcaagtgctatttctttacagctccagagaacaaacatttctaaaaccattatggaccctgagtaattcagggggaattggtatctctgtaaagagacagtaaggaaatgctgagtggaggcaccacactgcacatcaatgctttccacatgcacccaatagagtcttaatttaattgggctgttatttgcatagctagataattaccaactttagtcatactattttttagcaactaatggcatctgttacccattaattttatacatttgcttttttgaaaaacaaatcttttgttaattcactctaaattgagactacatttacaatcttcagtttttcagtgttaaagcaaatcagagaagagcaatgtgtgtacataatgtgcattttcctgcctaccaaaattattctggctgggaaaagtggctcatgcctgtaatcccagcactctgggaggctgaggtggatggatcacctgaggtcaggagttcaagacaagcctggctaacatgatgaaatcccatctctactacaaaaattatccgggcataatggcgggtgcctgttatcccagctactcaggaggctgaggcggaagaatcacttgaaccagggaggtggaggttgcagtgagctgagcacgtaccattgcagtgcagcgtgagtgacagagtgagaatccttctaaaaaaaaaaaaaagaaattctttcttcaattacttggaaaccctgggaagcccctataaaatactccctttgaatactttagccaggatttcagatttcaaaaggtcaaaaacaatcattgagcaaagcttaaatcttgcctttgtttcttgttagtcatctggccatttctgtaagtacggcaattatgcgaagccattgaaaaaatgtggtcttggtaaattttattccatttcaaatgttttctctaatgttaccttggtcatgtgaatctaaaagaaactatctacataactaatcatggattcaaaaaatattcatattaatgtgtttacagtttaatcttgtattacagtatagtagaatcctctataattagaagttaattatttataaattcattgtttttaaggtttttcaaatatgaaaacagacaattaggtatactttttgaagtaagttcaattttaggacattacccactggtcttcatggcatttctgtaataaatagtgtaaacctgtgtcaccagaatggtgcagacatgctgattgaattagaatgagttcagccttgttggtagactattggtatcccagaggctgatcattcactacagcttactaaatactgttccataatgccagtgagcacttttacccaggttacctttttcctcccattaatgtggacctgttgtggtctcctgtttctcttaagctatcccagatgagaggtgattatttcttgaatgaatgagattcccttttttttccctctgccatagaatcctcttatgttccttactggaagcaacatggaggaggcagaaatgatggcaagatacaaacatttttcccgccatgtggccaccataagcagcttacaacatgttctacctagaagtcacttactttcaggccagcaggggtgtttttctgtgatgtgtctctttctcttaaaagcacctctgattaagtttagcacaatcaggataatctccattttgataaacacaaagtctacggatgagtaacctaatttcataagtgatttcccaccacagtcacacattttttttacactcaagaggaaagtatgacacagcacgtgtgcaacagactggtaatccagggtattatcttagaatgttgcctacccacctaaataaatgtttaaaatcatcttttgctgggcacggtggctcatgattctaataccagcaccgtgggaggctgaagcaggcagatcatgaggccaggagtttgggaccagcctggccaacatgatgaaaccctgtctctactaaaaatacaaaaattagtcagacgtggtggtgcatgcctgtaatcccagctacttaggaggctgaggcaggagaattgcttgaacccaggaggtggaggttgccatgagctgagatcacgccactgctctccagcctggaagacagagcaacactccatcatggaaaaaaaaaaagagtctttctgctgcttttgttatctacataaacaaagatatcaactggatataataattaactactttttagttttattcattacaaataactatttttctggcttaaattattttttatgcaccatttatacattcacacacacatagaacaataaaaatatatccaattattcaattttggttgaatgttcattcaaataagtgttaaaaatgatttttttttcctgttttaagagggcttttattattgtactcaagagagttgtttctggagacaaagttgcctgtgctttaataggcagactctggggagaatccgaatcacaggccagaacattttatattaataaattcaatacaaagcagaaagtatagatttgctttcaccattttaaaagtgtttagttttgttaatcacctaaataacataatttgttttgttgcagtaattgcttttattctgaaaatatgtacaaacctatactcacacaaaaacactcaattcataattttcttacacctcaggtttatcttcagagtaatatgtgtatatttaactctatgtaaattaaaactaaaagtctatgtgtttgcaggcagagaccacatgttcaaggaaaactatattacaagtatttataatttttcaggactcagaaatgtatggattttatttttattttattttttgagatggagactcactctgtcagccaggctggagtgcagtggcatgatctcagctcactgcaacctctgcctcctgggctcaaacgattctcctgcctcagcctcctggcatgtgccaccatgcctaatttttgtgtttttagtagagacaaggtttcaccacgttggccaggctggccttgaactcctaacctcaagcattccacctgtctcggcctcccaaagtgctggaattacagatgtgagccactgtgcctggccgtattttatttacatttttgtataattattatgatcatagaaataattctgtagtcaataacaatttaattgtacattttaaaatgaataaaagcatataattacactattggtaatacaaaagataaatgctagaggtgatggataccttatttaccataatgtaattactacatattgtaggcctgagtcaaaagatgccatataaggcataaatatatacacatattatatacccacgaatacaaataaaaaatttaaataataaagagtcaaaatttaatctatgggaacaatatttaactcatttgcagtttaaagccactgacagtgattactaaagatgttattttacaatgtatgaaatagtatattcctacaatattgtacctacacccttgagtaaagtgggatacagttagtggcacaataatggttcattaaacgcacggtagtcttaccatggtaaaaataaaataaaattaagttcacaaataatctaacaaacttttttttttttgagacagagttttgctcttgttgcccagactggagtgcaatcgcacaatcttgccccactgcaacctctgcctcccaggttcaagtgtttctcctgcctcagcctcctgagtagctgagattacaggcatgcaccaccatgcctggctaattttttttgtatttttagtagagactgggtttctccatgttggtcaggctggtctcgaactcctgacctcaggtgatctgcccaccttggcctcccaaagtgctgaaattacaggcatgagccatcaagcccggccctaacagttttaaaatgcactgcattttattacataaaagtacaagtagtaaagtaatatactcatttattttaatatacttttaattatttctttgtgtcactataataaagtattgctctgaacatttacgttatacattacttaatagaattttactacaaacagcttctccacttgtattttcattatgcgtcttacattttaatgttcttactattt

SEQ ID NO: 658 - DNA, 24329 bp, Homo sapiens
tgttgattagtgtctagactcagtaaagttagataataatttgtgtaagaatctcctttgtaataactggtctggcatcacagacaagcctgaaagaaatttgccagttttgtatccaatttcccaacataattgcaacatccttccagcccccccaccccccagaatatccactgctccttctttcagccatctctatttttctgctgctttcatcattaatgagttcaataacacctttgacatctgctcaccctgtttttgtatgagtcatgtttgtttgttctttgagacagggtctcattctgtcacccaggctggaggacagtggcacaatcatggctcactgcatcatggacctcctaggctcaagcagtcctcctgcctcagcctcatgagtagctgagaccacaggtcgtgccaccacacccagctgtttttgaatttttggtggagatggagtttcaccatattgcccaggcgggtcttgaactcctgaactcaagtgatctgccttcctcagactcgtaaagttctgggattactggcatgagccaccacgcccagcctggggacatttttttttttttttgagacagcgtcttgctctgtcgcccaggctggagtgcagtggtgggatctcggttcactgcaagctccgcctcccgggttcatgccgttctcctgcctcagcctcccgagtagctgggaatacaggcgcccgccaccacacccggctaattttttttttgtatttttagtggagacggggtttcaccgtgttagccaggatggtctcgatctcctctcctcgtgatctgcccgcctcggcctcccaaagtgctgggattacaggcgtgagacactgcgcctggccttttttttttttttttttttgagacagagtctcgccctgttgcccaggctggagtgcagtggtgggatctcggctcactgcaacctccacctcccgggtccaagcgattctcctgcctcagcttcctgagtagctgggattacaggtgcccaccgccacgcctggctaacttttgtaatttaagtagagacggggtttcaccatcttggccaggatggtctcaatttcctgacctcctgatctgcctgcctcggcctcccaaagtgttgggattacaggcatgagccactgtgcctgaccagggacacattttaaaagttaaaaacatgactcttagccaggtgcgatggctcatgcctgtaatcccagctacttgggaggctgaggcaccagaatcacttgaacccaggaagtggaggttgcagtgagccgaaatagtaccactgcactccagcctgagtgacagagcaagactctgtctcaaaaaaacagaaaatgtatacgtgtgtgtgtgtgtgtatatatatacacacacacacacacacacacacacatatccctgttttatttcatttttattatggggtttttgttgttttctgtttttgtttttgtttttgtttttgttttgagacagtcttgctctgtggcccaggctggatcggctcactgcaacctccacatcccacttccaagtgattctcctacctcaacctcctgagtaactgggactataggtgcccactgccacacctggctaatttttgtatttctagtagacagggtttcaacatgttggccaggctggtctggaactcctgacctcaggtaatccgcccacctcagcctcgggctattttttattgaagaataacatacgtacagaaaaagcatataatcacaggtacgcagcttgacacatttacgcaaagtgaatattctatgtaaccagcagctaaatcaagaaacagaaaattataagcagagcagagtccccgtcctgttcccatgtagtcactggtccttctaaagcaatcaccattctaacttctagctacatacataaatattctcttaatttgtcttaattttctcataaaaatggaatccataatatgtactcttttgtgtctggcttctttcattccacattatgtttgtggcatgtagttatatttcattcattctcatttctctatagtattccacagtgtgactaaactaggtattacatgattatgtggaatgattggaatgctctgacaccgctgcaactttaaataaccactttgcgctgtgtacagtggctcatgcttgtaaccccagcattttgggaggccgaggcagaaagattgcttgagcctagaggtttgagaccagtagggcaacatagtgagtccctgtctctacaaagaataaaaaaattaacaaaccatggtggctcacgtcagcagtcccagctacttgggaggttgagggaggaggatcacttgagtccaggaggtggaggttgcagtgagctggaaaacaaaacaaaacaaaacaaaacaaaaaacagaaaagaaaagaaatagcccctaagtggccagatgcggaatcccagcgctttgggaggccaaggagggcggatcatttgaggtcaggagttcgagaccagcttgacctacatgtcagaccctgtctctactaaaatacaaaaattagctggacgtggtggtgggcacctataatcccagctcctcgggaggctgaggcaggagaatcgcttgaatccaggaggcggaggttgcagtcagccaagattgtgccactgcactctagcctgggtgacacagccagattccttatcaaaaacaaacaaacaaacaaaaaatgcccctaactgggaactgcttaaatgtccataataaaagaagacaggggccaggcacggtggctggtggctcatgcctgtaatcccagtactttgggattcctaggtgggcagatcacttgaggtcaggagttcgagaccagcctgaccaacatggtgaatatccatttctactaaaaatacaaaaaatttagctgggcgtcatggggcatgcctgtaatcccagctactcgggaggctgaggcgtgagaatcgcttgaacctgggaggtggagattgcagtgagctgaaattgtgccactgcactccagcctgggagacagagtgagactctgccttaaaaaaaaaaaaaaaaaagaacagtgtattgtactgcacgcacatattttgtgcatctgctgggttataagacctaaatggtagagtcatttgcaccacatcctggacaggctagagaatctcctcttgctctgggctccaccggccttacagttcacttcgctgatgagtgagagcaggtctcccggccatgatacaagctgcccccaaaattccaaagggctttttcttaccaccttttccatcaaaggatgggggtataggggatgaaagtttcagtagcttgccctgtgtttagggaaaaaacaaaattctaacaaaactcttctcccggacctccaaaatatctctgggctggcaggtctctgtattttttttttttttattgaacttccttaaatgcacataagtcagctaatacttccatggtacctgtttctttctgctcttggtacatcgatattattattattataattatttaattattatgaaacaaggtcttgctctgtcgcccaggctggagtacagtggcacaatcacagatcactgcagcctccacctccttggctcaagtgatcctccagccttagcctcctaagtagctgagaccacaggtgcacaccaccatgcctgataattttttttttttttttttttggagacggagttgccctctgttgcccaggctggagtgcagtggtgtgatctcagctcactgcaagctccgcgttccgggttcacaccattctcctgcctcagcctcctgagtagctgggattacaggcacccgccaccactcccggccaattttctttcttttttttttttttttgtattttagtagagacggggtttcaccatgttagccaggatggtctcgatctcctgacctcatgatccacctgcctcagcctcccaaagtgctgggattacaggtgtgagccaccgcgcctggcccaatacccggctaattttgtgtgtgtgtgtgacgcagtctcgctctgtcgcccaggctggagtgcagtggcgctatctctgcttgctgcaagctctgccttctggcttcatgccattctcctgcctcagcctcccgagtagctgggactacaggcacccgccaccacgcccggctaatttttttttttgtaattttagtagagacggggtttcaccgtgttagccacgatggtctcaatctcctgaccttgtgatccgcctgcctcggcttcccaaagtgctgggattacaggcctgagccaccgcgcccggccaattttgtatttttagtagagatggggtttcaccatattgtccaggctggtctcaaactcctgacctcgtgatccgcctgcctcggactcccaaagtgctgggattacaggcatgagccaccacgcccagccagaattttttcttttttctagagaagggggtctccgtatgttgcccagtctggtcttgaccacctgaccttcattgattttcctacgtcggcctcccaaagtggtgggattacaggtgtgagccactgccaccggccagtaattatgctgatgaaagacctgttttttctccagttcctgggatggctctagggagggttatttacactgtgagtgaggaggcattcacagagaagttcctccagagtgtggaagaagcactaccatttggcaccaacgcctggagaacaaaggaggagaccattggccaaagagaggcatttccattttgttggaacctgctgaccaccaacccatagcattttttccctttcttccttgctaatccaatcgcagattcattgaggaggtgagaggtcctgagatccaggctggaagaggagtgattggtctacctggttctcaagggataatgttgccccctagaggacattttggaaattattaaggaaaattaacgactggttttttggttgtcatctggttctcaagggaacagtattgcttccttgggagaatttggaaacttaccttttttcatcgtcacaatggtgaagggtttgttactgggattagaggacaaggaccagacatgccaagatgttctacaatatagcattcctaattaataatcacctaatgaataaagctcagatagcacttaaaaagtggggaaaggactgtttatactaaattatgctaagctgtaacactgaactattccagttcttttgaaattgtttacatagcaaaatcatagttgactcctggccatttaagacttatgccaccactcttgggatagtgaaaatgttttgcaactagattgaggtggtgattgtataatatggtgaaagtactaaaagccactaaattgtgcacttcaaaatgctgcctaattttatattatgtgaatttcacctcaataaaaatgtctttttttttttttttttgagagggagtcttgacctgttgccaggctggagtgcagtggcgcaatctcagctcactgcaacctccacctctcaggttcaacccattctcctgcctcagcctcgcaagtagctgggactacaggtatgcgccaccacacccagctaatttttttgtatttttagtagagacagggtttcaccatgttgaccagcatggtctcaatctcctgaccttgtgatccacctgcctcggcctcccaaagtgctgggattataggtgtgagcccccgggcccagccaataaaaatgtttttttaaaaggatgcatatttccaaacatgagactataccatcacatttaatttttcccagaaactataaaaagtagaagtgaagagaggaaagggagacacttttagaccttcaatgagtctgcaagtacaggagaaaataatttatgcagcaattagctttattttcagggctctttttcttttcttttttttttgttgagacggagtctcgctcttttgcccaggccggagtgcagtggcgctatcttggctcagtgcaagctctgcctcctgggttcataccattttcctgcctcagcctcccgagtagctgggactacaggcacccgccaccatgcccagctaattttttgtatttttagtagacacggggtttcaccgtgttagccaggatggtctcgatctcctgacctcatgatccgcccgcctctgcctcccaaagtgctgggattacacgcgtgagccaccgcgcctggccaacaaagtgatcattttacaagagttatggcatagtcacaggtaagaacctgggtcactgggtcactccctaaccaattacgaattactatatgccatggaccttcaggattactttcttttttgttttgtttttgtttttttttttgagacagagtctcgctctgtcacccagaccggggtgcagtggcgcgatctcagctcactgcaacctctgcctcccggattcaagcaattctcctgcctcagcctcccgagtagctgggattacaggcatgtgccaccacgcctggctaatttttttgtatttttagtagagaccgggtttcaccatattggccaggctggtctcgaactcctgaccttgtgatccacccaccttgacctcccaaagtcctgggattacaggcgtgagccaccgcgcccagcccaggattactttctttctttcttttgagacagagttttgctcttgttgcccaggctggagtgcaatggcacaatctcggatcactgcaacctccacctctcaggttcaagcgattctcctgcctcagcctcccaagtagctgggattacaggcatgcggcaccatgcctaaaattttgtatttttagtagagatggggtttctccactttggtcaggatggtctcgaactcccgacctcaggtgatccgcccgcctcggcctcccaaagtgctggtattacaggcatgagccaccgtgcctggcctctatttttctttctataatccatgtacattttcctttaataatataaggcaactaaacagcactttattttcagaggcttatctaaaagatacttgacacagccctttgcagctgggtcattctctgaattctaaatgtcgtttcctgcacaaagtggttatttgatcttgtaactggcattttccccggagattaggaagtggcacaccaaagtgcaaaaaactttggaatcagaactttaatttttaatctttattttatttatttatttatttttgtgacagagtctcgctctgttgcccaggctagagtgcaatggcaagatctccactcactacaaactccacctcccgggttcaagtgattctccgccttcagcctcctgggtagctgggatcacaggcgcacaccaccacactcggctaatttttgtattttgagtagagatggggtttcaccatgttggccaggctggtctctaactcctgacctcaggtgatcctcccgtccatgcctcccaaagtgctgggattacaggtatgagtcactgtgcccggcctaatttttatatttttttgtagagacggggtctggctgtgtttgacagcctcaaactcctggcctcaagtgatcctctcaaagtgttgggattacagacatgagccacagtgcctggcctattgaaagcttttccatcataataggtccttccccccaatgcttgcagcaagtcaatagtaggagaccccaggttgcagcagagaaagaggtttaatcataggggccactgaaaaccaagagaggagatggaaggaaccacgaatccacttccccagggagttcggggctttttaagggttttggagtgggttgaagtgtggaggtcattggttggttgaagtgtgcagggtgaagtaatgaaacagggagttgaagaaactctattctcctgtcgatttggttcctctgcggggtcttcacactggttggtatcagctgttttgctggaattcaggatctgaaaaatatcttaagcttttttttttttttttttttttttgagacaaggtctgttgtccaggctggagtgcagtggtgccatcatagctcattgcagcctctaacgcctgggctcaaaggatccttccaccttagcctcccaagtagctgggattacaggcacgcaccaccacacccagctaattaaaaaatttttttttttgtagagacaggggtcttgtcatgttgcccaggctggtcatgaactcctgacttcaagtgattttcctatctcagtctcctaaagcgcatggattacaggcatgagccaccatgccgggcgctaagcaattcttattatttatttatttatttatttatttatttttttctgagacggagtcttgctctgttgcccaggctggagtgcagtggcgcgaactcggctcactgcaagctccatctcccaggttcatgctattctcttgcctcagcctcctcagtagctgggactacatgcgcctgccaccacgcccggctaattttttgtagttttagtagagacaaggtttcaccatgttagccaggctgatctcgaactcctgacctcgtgatccgcccacctctgcctcccaaaatgctgggattacaggcgtgagccaccacctccggcctaagcaattcttaaataaaaatctatgattccgccaggcatggtggctcacacctgtaatccgtgcactttgggaggccgaggcgggtggatcacaagttcaggagttcgagaccagcctggccaacatggtgcaatccctgtctctactaaaaatacaaaagttaggtgggcatggtggcttttttttttttttttttagacgggagtctctgtcatccatgctggagtgcagtggcaggatcttggctcactgcaacctctgcctcccaggttcaagcgattctccggcctcagcctcccaattggctgagactacaggcgtgtgccaccacgcccggctaattttttagtattagtagagatgggggtttcaccatcttggccgggctggtctcgaactcctgacttcgtgatctgccctccctggcgtcccaaagtgctgggattacaggcatgagccactgtgccctgccaaaaagcctatgattctaacatcagaaatccttccacctcagcctcccacgtagctgggactatagactcagtaccaccacaccaagctaatttttgtatttttaatagagatagcgtttccctatattgaccacctggggccatccctggttttttttttttttcccttccttccttcctttccctctctctttccctccctccttccttcctttctttctttctttcttttttttttttttttacagagtcttgctctgttacccaggttggagtgcagaggcatgatcttggcttactacaacctccgcctcccggattcaagcaattatcctacctcagccttccaagtagctgggactacaagtgtgagccaccatgccctgctaatttttttatttttactaaagacgggatttcaccacattagccaggctggtctccaactcctgatttaaagtaatctgcctgccttggccttccgaagtgctgagattacaggtgcgagtcaccgtgcctggcctattcctgttttcttaacgctcctctctcccactgggccgtgactgcctctaaggcagagatgtgttcatttttattattattgtatgtccagggctgggcacaaagtgcaacacatagtagggacatgaaaggctgggcacagtggctcatggttgtaatcccagcactttgggaggcagaggcgggaggatggcttgaggccaggagttggagaccagcctaggcaacagagggaccccatctctatgaaaaaaaaaaaaaaaaattgacagttcaatgtcacctctgataagccttccctgaccacccctgttactctgtagccccatgtcctgctttatttttctccaaagcatttatcatcgctgggtttatatttatttctcttcgggcttttctcactggatcgtaaactccatgaggacagggctttgtcgatttcactcaataccgttattttacaacatccctattgctgggatctcagtatgcactccttaaatatttgcagaatttaagtgccacataagtgaccacgtgggcaacgccctcggggccttaagccgcgccatttttggggctaggattggttggaccctccgtcacgtgacatgcagtcgccggatcgcctttgagtctcgtgaggtacttttggtcccaggctccgcggacgaggtactgcgcaggcgtgggagggtctgcgcatgcgcagaagcactccgggcgtgctgccggcggcggtaggtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggtcagggccggcgcggcttgaggccgctagggtctggagggggcgtctattctgaggcgtttgcggcccggaaggagcgggaaggtgtgatttgaagggaggaggcgggaattctgtgctctgggatcgtctctctcttggggggactggaggagttgattggggatgtttctggaaggtctgggaagtggttgggagggccgttccgaaggatgggagctctgaagggggcgttggggagtcctgagagagcgggagaattcaaactcaggaaatccgaggcccgaaagcggtgattgtggggtttgatcgcggttaggggataagaggggctggggatacgtggaaagggtgaggtgagggacgcagttcattcattcgagggtatgggacctggttccgtgctgcacacaggggagactggactggccaaccggacagacgggagcttacactcttgtgggagctcacgggcgggccagtctgagagaatgcgggttttgaggagttttggagcaagttatctcaaatgggaatcttgagaggctcggagaggctggagggggacggccgtaggctcccgaaaaggttgcttgtgtttggtatggggctgtgtcttgataggacaggagacgtagtttgggcattgtggagtagcttagggaattctttttttttttttttttttttttgagatagtctctctctgtcgcccaggctggagggcagtggcgcgatctcggctcactgcaacctctgcctcccggattcaagcgattctcctaactcagcctcccgagtagctgggattataggggcccgccagcacgcccggctaatttttgtatttttagtagacacggggtttcgccatattgacgagactggtctcgatctccttacctcaagtgatccacccgcctcggcctcctgaagtgctgggattacaggagtgagccaccgcgccaggacgtcttttgttttgtgcagttgggtgacctcggttcactgcagcctctggcctcccgggttcaagacttcctctcacctcagtcttctgagtagctgggattacaggctcgcgccaccatgcctggctaatttttgtatttttagtagacatgggttttcaccatgttggccaggctggtctcaaactccggacctcaagtgatctgcccgccacagcctcccaaagtggttggattacagacgtgagccactgtgcccagcttgttttttttttttttctttctctgtggcccagtggagtgcagtggtgggatcacagctcactgtagcctcaacctccaaggctcaagggatattccctcttcagcctcccaagtagctgggactacaggcgtgccccaccacatcatccgactaatttttgtttttttttttttttgtaggatggggttttgccatgttgcccagactggtcttgaactcccaagctcaagcgatcctcggcctcaagagatctccccccatctcagactcctaaaatgctgggattacaggcatgagctaccatgcctggcctcattgatcaatatttttacttagcctggacgcagtgactcacacctgtaatcccagcactttgggaagctgagttggggggaggggacctcttgagcccaggagtttgagactagcctgggtaatgttgccaaacccagtctctacaaaaaaatacaaaaattagccaggcatggtgacataagtttatagtcccagcttgtcaggagactgaggtgggagcatcacctgagcccctgggaggtggaggttgcagtgagccatgatcacaccactacaccccagcctgggtgacagagtgaggccccgtctcaaaaaaaaaaaaaaaatccacaagcgtgtgtatatgtgtcagttattaaaggatggtgaagtgagagggttgttttgataggttggccagggaagggctctgaagaggtaacattgagcctcagacttatatgggaaagagccctgtggtcatctgggagaactttcctagctaagagaacagcaagtgcaaattcccagaggcccaggcatgattgtcaaattagagaaataaggtggcaggaaccaaatgatttgaggagtagcttttattctaagtgtgtgggaaaacctgttggagtgttttgagtgtgggagtaacatgatctgttttttgtttgttttttgagacggagtcttgctctgtggcccaggctggagtgcaatggcacgatctcggctcactgccattgcagtgaatccgcctcccaggttcaagcgattctcctgcctcaccttcctgagtagctgggactatcggcatgtgccacaacacccggctaatcttgagtatttttagtagagacggggtttcaccatgttagacaggatagtctcgatctcctgacctcgtgatccgcctgccttgggctcccaaagtgctgtgattacaggcgtgagccactgcggcctggcctggtttgtgttttaaaatgatcgctccagaataggttaaagtggtcagaaatggaagtaaagattctggctggactgttgcagtaatccagttgagataaaaatattggtggcttgaaactcaagagaaggggtcaaataaatatattctggatatattttgaaggtagaagagggaacagaatttggggcagaagtccaggatgacaccactgtttttggcttgagcacctacctggaacgatggaattgccattttgaaagatatggagagctgtaggtttggtggggtcggggaagagtcagttctcttttaggtttcagatttgttttttttgtttgttttttttttttttgagacggagtctcactctgtcgcccaggctggagtgcagtggcatggtctcggctcactgcaacctctgcctcccaggttcaagcaattctcctgcctcagcctcccgagtagctgggattacaggcgcccgccaccatgcccagctaatttttgtatttttagtagagacggagtttcaccgtgttggtcaggctggtgttgaacccctgacctcgtgatccacctgcctcggcctcccaaagtgctgggattacaggtgtgagccaccatgcccggcctcagatttgtttttttatacaactaagtagaaatatgtgaggggttgagttcagaggtaaaatttgggtgatggtgggtattgtgtgagtacagagtatagaattaatggaggggttggggaggcagacacgtcaggagaatttagtttgagggggtgggagctttcagaaggttttagagggtgcagtggtgggatgggaattacctcaggctcatttcagatctgtggggtcttctttgatggggtggggggatgtcatcatgaggcattaacattggtgggagggttgaaggcacctggaatagattgggaattaagtgatgagaatgtgcctctggacataggtggactgcattgattttagggactgctattttctggatggagtggaaagaggatttatgtgagttggaggaaactttgaggaagcttggtgtgttctgagatcctaaagggttggggaggggattctaaggtactggaagggttaatcgaaggggtttgcggcagcagatagctttgtttgaagtggggcaaagttggtgaggtttaaactggaatgtagttagggaactttcagagggatggggatgatttttctgagaagcagtgaagaatggatgggggcctctgagtgggagatgacctaagggacaagtcagggtcagggcatggaatttgtgggaggtaggaattattctgagggagtggagctgtaccaaatttggtggagaacatgaaaaggattggctgggggttgcaggagggagggaagaggttgtttgtaatttgtactctatttttagacagtcttagagagtttattaaagtgttttttgtccattttcagccgaggtttttagaaattaaaaatttttttgtgtgagtacatagtaggtgtatacattttgggggtatgtgagatactttgatacaggcatacaatgggtaataatcacatcagggtaaatggggtatccaccaccttaagcacttatcctttgtgttacaaacaatccaattatattcttttagttgctttgaaatgtacaacaaattattgttgactgtagtcaccctgttatgctatcaaatactgtatcttattcattgtatttaattatatttttgtatccattagtcatccctccttcccctccaccccccactacccttcctagcctctggtaaccctcagtctactatctgcatgagttcaattgttttaatttttttagttcccacaaataagtgacagcgtgcaaagttttctttctgtgcctgatttatttcacttaacataataacatccagtgccctccctgttgttgtaaatgacaggatctcattcccttttttttgtagacagggtctctctgtcgcgcagactagagtgcagtggtgtgatcacaactcacttcagccttgacttcttgggctcaggtgatcctcccacctcagcctcccggtagttgtgactatagcacgtgtcacaagcccagctaatattttagtacaggtggggtttcaccaggctagtctccaactcctgggctcaaataatcctcctgcctccctgcaaagtgctgggattagaggcgtgaacagcaatgcccagcctttgtaccacaatttctatttttttttttgaaacggagtctcgccgtgtcgcctaggctggagtaggctggagtgcagtggcgcagtcttggttcactgcaagctccgcctcccaggttcacgccattctcctgcctcagcctccctagtagctgggactacaggtgcccgccaccacgcccggctaatttctgtatttttagtagagacggggtttcaccttgttggccaggatggtctcaatctcctgacctcgtgtaccacaatttctttatccatttgtctgttgatagacatatgggttgctttcaaatcttggctattgtgaagagtgctgcaataaacatgggatttattgcagttttttttcttttgagaccgagcctcgctctgttgcccaggctagaggacagtggcacgatctcagcccagtacaatctccacctcccaggttcaagcgattctcctgcctaagcctcccaagtagctgagattacaggcacctgccaccacgcccggctaatctttgtattttttagtagagatggggttgctgtgttggccaggctggtctcaaactcctggcttcaggtgattggccctccttggccccccaaagtgttgcaattacaggcgtgagccaccacacccagcctgatttattttcatttgggtatatacctagcagtgggattgcatttttacccgagtcttttttttttttttttttgagacggagtttcgctcttgttacccagactggagtatggtggcgtgatctcagctcaccgcaacccttgcctcccaggttcaagcaattcttctggttcagcctcccaagtagctgggattacaggcgtgtgccaccatgcccggctaattttgtattttagtagagacgggattcctccatgttggtcaggctgtgaactcctgacctcaggtgatccgcccgccttggcctcccaaagtgctgggattacaggcatgagccacagcccccggccttcacctgagtcttatagcagctctctggagtcggaagggcagtgatttccttctctgttcagatgaggaaggaggctccacagagcaaattgacttgcctctaagagggctctaggtgggataggagggttctaggtgggataggagaactctggagactggagttcctttatgaaacagaagccctggaaatgggcaggctgataaaatgtacaaattgtggggcattttataagacagttatcctacttctcttccaaaagtcagtttcatgggaaaaataagtgaagggactgttgtggattaaaagagagtaaaggccgtcacagtgactcagcctgtaatcccaggactttgagaggccgaggtgggtggatcacctgaggtcaggagttcgagactagcctggccaacatggtgaccgtctctactaaaaatacaaaaaaaattagccaggtgtggtggtgggtgcttgtaatcccaactacttgggaggctgaggcaggagaattgtttgaatccaggaggcagaggttttagtgagccaaggtcacactatcgcactccagcctgggtgacaagagcgaaactctgtctcaaaaataaataaataaaataaaataaagtaaagaagcagcttcctagagcagatttggttgcttaaattgaggccaagtttctggagtttttattgatagttgacaattacaactaaaatttttttttctcgctctgttacccaggctggagtgcagtgacgcagtgacgtgatcttcagctcactgcaacctccacctcccgggttcaagggattctcccgcctcagcccccaagtagctgggaccacaggcgtatgccatatcactcagctaattttgtgtgtgcatggcgtatgccgtaacactcagctgattgtgtgtgtgtgtgtgtgtgtgtgttgttttttttttttttttgtgatggactctcactctgtcgcccaggctggagtgcagtggcacaatcttggctcactgcaacctccgcctcctgagttcaagcgattctcctgccttagcctctggagtagctcggattacaggcgcgtgccaccacacctggctgatttttatatttttagtagagacggggttttaccatgttggccaggctggtctcaaactcctcacttcaagtgatctgcccacctcggcctcccaaagtgctgggattacaggcgtgagccactacacccggcctatgtgtgtgtattttatttttttatttttttgagacggaatttctctcttgttgcccaggctggagtgcaatggcgtgatctagactcactgcaacctctgcctcccgggttcaggcaattctcctgcctcagcctcctaagtagctgggattacaggcgcctgctaccgcgcccagctaatgtttgtatttttagtagagaccaggtttcgccatgttggccagggtggtcttgaactcctgacctcaggtgatctacccgcctcagcctccttaagtgctgggattacaggcatgagccactgcgcctggccagaagttaccttctttgtgcctgttttctcagctgcaaaagaggggtaacaaagtgccagcccattagattgtcatgggaattaaatgacataatacatacaaagagcttagtagaacagtgcttggcacatagtaagtgttagataaatgttggccattattattttattatgtaccagatttctataattctgctgatggacacaggtttgttttggtgtgtctattaattcacagccatttgagtaacagtatgtcctaaatgccaaggaagttactggttctagtgatacagtggtttctggagtttacattctaatggaggagggggcagtaaacatataaacaagtagtgtagcttagcacagtggtgtgtggctgtgatcccagctactggggaggctgaggttggaggatcacttgagccaggcaattgagactagcttgggcaacttagtgaggccccatttcaatcaaaacagtgggcaacacagaccccatcttaatcaaaacaaaaacaagtagcataattcgagatagaagaggatgtggacctattttaaattaggtggccagtatggacttctctaaggaggtgacaattgagctgagacctaaagaatgtgtcccttaagaagttgagggaagaagcaatgggaagcactaatgccaaggtcctaaggtgggagcaaggatgggagcaaggatgatgttctctaggatcagcctcccgagtagctgggactacaggcacgtgccaccacgcctggctaatttttgtattttgagtagagatggagtttcaccatattggccaggctggtctcgaactcctgacctcaagtgatccgaccgcctcggctaattttgtgtatttttagtagagacggggtttcaccgtgttagccacgatggtctccatctcctgaactcatggtcctcccaccttggcctcccaaagtgctgggattacaggcgtgagtcgccgcgcctggcacacccagctaatttttttttgttttgtacagatggagtcttactttgttgcccaggctggtttcgaactcatgggctcaagtgatcctcatgccttgccctcctaaagtgctgggattacaggtgtgacccactgcgtccagcctgctgtagttttgtcggagagaaacgatggtggctcagactagagtggtgtttgtggaacttgagggaagtagatggacaatgctgctgtgaatgtgtatctttttttttttttttttttgagacagagtctcactcttgtcacccaggctggagtgcagtggcgcgatctcggctcactgcaagctacaccttccgggttcacaccattctcctgtctcagcctcccgagtagctgggactacaggcacccgccaccactcccggccaatttttttttttttttttttgtatttttagtagaaacggggttttaccatgttagccaggatgatctcaatctcctgacctcgtgatctgcccgccttggcctcccaaagtgttgggattataggcgtgaggcaccgtgccctgctgaatgtgtatcatttttgtgcccacttgggtatttctttttttttttttttttttgagacggagtctcgctctttcgtccaggctgaagtgcaatggtgcggtctcggctcactgcaacctccgcctcccgggttcaagcgattctcctgcctcagcttcccgagtagctgagattacaggcgcctgccaccactcccggctaattttttttttttttctttttgaaacagacccttgttctgttgcccaggatggaatgcagtggcgccatctcggctcactgcaaactccacctcccgggttcacgccattctcttgccttagcctcccgagtagctgggactacaggcgcccgccaccatgcccagctaattttttatatttttagtagagatagggtttcaccttgttagccaggatggtctcggtcttctgacctcgtgatctgcctgtctcggcctcccaaagtgctgggattacaggtgtgagccaccgtgcccagcccacgcccggctaatttttgtaattttagtagagatggggtttcaccatgttggccaggctggtctcgaactcctgacttcaggtgatctacccaccttggcctcccaaagtgatgggatttgtaaacccagcactttgagggaggcagaggcaggaagattgcttgagcccaggagctggagatgagcctgggcaacatagtgagaccctgtgtctacaaaaaaaaaaaaaaacccataaatcagccaggtgcagtggtgtgcacctatagtcccaggactcaataggccgaggtggcgggatcacttgaacctgggaggttgaggctgcagcgagccctgatcttgccactgcccttcaatctgggttcacagaatgagaccctgtttcaataaaacaaaacgtaaacatggtatttggtgttgatggcagttgagtatttaatttaatttaatttaattttttttgagacggagtctgtcacctgggatggagtgcagcggcacagtcttggctcattgaaacctctgcctctcaggttcaagcgattctcctgcctcagcctcccaaatagctaggattacaggtgcccgccaccaacatgcccagctaattttttttttttaaacagagtctcgctgtgtcacccagactggcatgatctccgcttactgcaacctccgcctcccaggtttgagtgattctcctgcctcactgtcccgagtaactgggactacaggcgcctgccaccacgcctggctaatttttgtattttctgtagagacacggttttgccatgttagccaggctggtctcgaacccctggactcaagtgatctgcccgccttggcctcccaaagtgctgggattacaggcgtgagcccccacgcctggccataattttttttgtatttttagtagagagggtgtttcaccatgttggacaggctggtctcgaactcctgacctcaggtgatccacccatctcagcctcccaaagtgctgggattacaggcatgagtcaccgggcccggctgaataatgaattttaaacaactgcagagcagtctgtagagctatgtaggaatgtaggtcgtggagagcagatttattgtcagggactttttatatgtagctgttgctggaagagttcggggagggggagtgcttgctggtattgactcagccatgataaaaaagcctttttttgaggaaatggcattggagttgggttttgaaggggaaaggcgtaggtaggcattgagaggaagaaatggtgcattttgcgagggtggaatgttgtgattaaattttatttaatttttaattaaattaatagcaaactcttaccagcagaacttaaattgtgtgaaaattattcttagttattactaaatccttttcagtatgaataatacatttgctgcagaattattaatgagtttggttacatgatgcagcccaagatcttgatgagttgtttcataatacatgatgtaaagtctgtatttcctttttgaaatctgaaaaaattgtgactctgaaatacttctggttcaagagatttcagataagatatagttgacctattctgcttcctactgacctcagagaagtcttgggatggcctgacctctgattgccttttttcagcctcatcttctgtcactttacagatttaaaaagctaaaaacaaggctgggcacggtggctcatgcctgtaatcccagcactttgggaggctgaggcaggtggatcacttgaggtcaggggttcgagaccagcctgaacaacatggtgaaactccgtctgtaccaaaaatacaaaaactagccaggcgtgacagtaggcgcctgtaatcccagctactcgggaggctgaggcaggagaattgcttggacctgggaggcggaggttgtagtgagctgagatcacgccactgcactccagcctgggcaacagagcgagactctgtctttaaaaaaaaaaaaaaaaaggtaaaagcaattcctgtgtacatgctcttttcatgccaccatgtgttttgcttgtgtgttatacttaactagtgcctcttctcagcacctcttctgctgtcatgctagtttgagccaccatcatcctccctcaccttaactgtgacatcttcctacccccatggctttccatcatgcctcgaagaaaatccagaatccttccattgcatgtaagagccttcatgatgtggccccttgttccaacttttcagcctctctgtcattcctgtccctagaacatgccaagcactcctgcttcagggcttttgcatttgctgttttctctatctggaatgttctgctgccaaatatctgtgtgtttgtcctttatttcattttgatttttgctcatatggcatctcctcagaaaggcttgtatgatttctgtctcaaatagcgttctccatcattcttgattcttgtcacacttgattttcatcactttttcacatattatgtatctatttgtttatctgtctcctactttttcatgagggcagggactatgtctgattcaccgccttatttccacaccatagaaggatgcctggcatagttggtactcaataaatatttgttgaatgaattgttttgtgcagtatggattagagcctgtctctttcctagattcgaggtgtgatgcctcaatgcagttagaaccaaaatgatttttttttttttgagacggagtctcactcttgttgcccaagttgaagtgcagtggcatgatctcggctcactgcaacctccgcctcatggtttcaagtgattctcctgcctcagcctcccaagtagctgagattacaggcgcctgccactacgcccagctagtttttgtattttagtagagacggggtttcaccgtgttggtcaggctggtctcgaactcctgacctcaagtgatccgcctatctcagcctcctaaagtgctgggattacaggcatgagccaccgtgcctggcaaaccaaaatgatttgtgtattttttgttcttctgtgattctgcaagctcactgttctgtatcatcaggttaacaatgtttgtcttacaggctgcgggcctctcgggtgcttcttgtcggcttgaaaggacttggggctgaaattgccaagaatctcatcttggcaggagtgaaaggactgaccatgctggatcacgaacaggtgcgctgttgtgagctcattcctcccctgctctggctcccctttccagcatgaagatctgcagattttgtgagttcctccttgtgccttaagggctgtgaaaggagggctaacattaataaaccattgcctctggagactgaaggtgctattgttgggtttgaattctagctccaccacatctagctggatgagcagtagagactcacaccccctcattgagcttgcctgcctgtaaaatggggttagtaatatctcccttggtggttgcttgtgaggaggtgtagagaagtgtttttccaatttgtgcctaaaaatgacctgagtgactaactgaaaatgcagagtggcctggaggcttcgtggtgccctagctttcacccctagtgattctcatttaggtctgaggcgagctcaggagtatgtgcatttaaaaggtgttttagggctggacgcagtggctcatgcctgtaatcccaacactttggaaggctgaggcaggcggatcatctgaggtcaggagtttgagactagcctggccaacatggcaaaactctgtctgtactcagtatacaaaaattagccaggcatgttggtgtgcacctgtaatcccagctactcgggaggctgaggcacaagaatcgcttgaatctgggaggtggagtttgcagtgagctgagatggcaccactgcactccagcctgggcaacagagtgagactttgccttaaaaagaaataaattaatgaaaggtgtttcaggagattatgatttagatggtccacagacatcactttaaaaaacactggatcaggccaggcacagtggctcatgcctgtaatcccagcactttgggaggctgaggcgggcagatcatgaggtcaggagatcgagaccatcctggctagcacggtgaaaccccatcactactaaagacacaaaaaattagcagggcttggtggcgggcgcctgtggtcccagctactcgggaggctgaggcaagagaatggcgtgaacctgggaggcggagcttgcaacgagccgagatcatgccactgcactccagccttggcaacagagtgagactccgtttcaacaacaacaacaacaaaaacaaacaaaaacaaacaacactggatcagagagaatgt

SEQ ID NO: 659 - DNA, 50459 bp, Homo sapiens
tgttgattagtgtctagactcagtaaagttagataataatttgtgtaagaatctcctttgtaataactggtctggcatcacagacaagcctgaaagaaatttgccagttttgtatccaatttcccaacataattgcaacatccttccagcccccccaccccccagaatatccactgctccttctttcagccatctctatttttctgctgctttcatcattaatgagttcaataacacctttgacatctgctcaccctgtttttgtatgagtcatgtttgtttgttctttgagacagggtctcattctgtcacccaggctggaggacagtggcacaatcatggctcactgcatcatggacctcctaggctcaagcagtcctcctgcctcagcctcatgagtagctgagaccacaggtcgtgccaccacacccagctgtttttgaatttttggtggagatggagtttcaccatattgcccaggcgggtcttgaactcctgaactcaagtgatctgccttcctcagactcgtaaagttctgggattactggcatgagccaccacgcccagcctggggacatttttttttttttttgagacagcgtcttgctctgtcgcccaggctggagtgcagtggtgggatctcggttcactgcaagctccgcctcccgggttcatgccgttctcctgcctcagcctcccgagtagctgggaatacaggcgcccgccaccacacccggctaattttttttttgtatttttagtggagacggggtttcaccgtgttagccaggatggtctcgatctcctctcctcgtgatctgcccgcctcggcctcccaaagtgctgggattacaggcgtgagacactgcgcctggccttttttttttttttttttttgagacagagtctcgccctgttgcccaggctggagtgcagtggtgggatctcggctcactgcaacctccacctcccgggtccaagcgattctcctgcctcagcttcctgagtagctgggattacaggtgcccaccgccacgcctggctaacttttgtaatttaagtagagacggggtttcaccatcttggccaggatggtctcaatttcctgacctcctgatctgcctgcctcggcctcccaaagtgttgggattacaggcatgagccactgtgcctgaccagggacacattttaaaagttaaaaacatgactcttagccaggtgcgatggctcatgcctgtaatcccagctacttgggaggctgaggcaccagaatcacttgaacccaggaagtggaggttgcagtgagccgaaatagtaccactgcactccagcctgagtgacagagcaagactctgtctcaaaaaaacagaaaatgtatacgtgtgtgtgtgtgtgtatatatatacacacacacacacacacacacacacatatccctgttttatttcatttttattatggggtttttgttgttttctgtttttgtttttgtttttgtttttgttttgagacagtcttgctctgtggcccaggctggatcggctcactgcaacctccacatcccacttccaagtgattctcctacctcaacctcctgagtaactgggactataggtgcccactgccacacctggctaatttttgtatttctagtagacagggtttcaacatgttggccaggctggtctggaactcctgacctcaggtaatccgcccacctcagcctcgggctattttttattgaagaataacatacgtacagaaaaagcatataatcacaggtacgcagcttgacacatttacgcaaagtgaatattctatgtaaccagcagctaaatcaagaaacagaaaattataagcagagcagagtccccgtcctgttcccatgtagtcactggtccttctaaagcaatcaccattctaacttctagctacatacataaatattctcttaatttgtcttaattttctcataaaaatggaatccataatatgtactcttttgtgtctggcttctttcattccacattatgtttgtggcatgtagttatatttcattcattctcatttctctatagtattccacagtgtgactaaactaggtattacatgattatgtggaatgattggaatgctctgacaccgctgcaactttaaataaccactttgcgctgtgtacagtggctcatgcttgtaaccccagcattttgggaggccgaggcagaaagattgcttgagcctagaggtttgagaccagtagggcaacatagtgagtccctgtctctacaaagaataaaaaaattaacaaaccatggtggctcacgtcagcagtcccagctacttgggaggttgagggaggaggatcacttgagtccaggaggtggaggttgcagtgagctggaaaacaaaacaaaacaaaacaaaacaaaaaacagaaaagaaaagaaatagcccctaagtggccagatgcggaatcccagcgctttgggaggccaaggagggcggatcatttgaggtcaggagttcgagaccagcttgacctacatgtcagaccctgtctctactaaaatacaaaaattagctggacgtggtggtgggcacctataatcccagctcctcgggaggctgaggcaggagaatcgcttgaatccaggaggcggaggttgcagtcagccaagattgtgccactgcactctagcctgggtgacacagccagattccttatcaaaaacaaacaaacaaacaaaaaatgcccctaactgggaactgcttaaatgtccataataaaagaagacaggggccaggcacggtggctggtggctcatgcctgtaatcccagtactttgggattcctaggtgggcagatcacttgaggtcaggagttcgagaccagcctgaccaacatggtgaatatccatttctactaaaaatacaaaaaatttagctgggcgtcatggggcatgcctgtaatcccagctactcgggaggctgaggcgtgagaatcgcttgaacctgggaggtggagattgcagtgagctgaaattgtgccactgcactccagcctgggagacagagtgagactctgccttaaaaaaaaaaaaaaaaaagaacagtgtattgtactgcacgcacatattttgtgcatctgctgggttataagacctaaatggtagagtcatttgcaccacatcctggacaggctagagaatctcctcttgctctgggctccaccggccttacagttcacttcgctgatgagtgagagcaggtctcccggccatgatacaagctgcccccaaaattccaaagggctttttcttaccaccttttccatcaaaggatgggggtataggggatgaaagtttcagtagcttgccctgtgtttagggaaaaaacaaaattctaacaaaactcttctcccggacctccaaaatatctctgggctggcaggtctctgtattttttttttttttattgaacttccttaaatgcacataagtcagctaatacttccatggtacctgtttctttctgctcttggtacatcgatattattattattataattatttaattattatgaaacaaggtcttgctctgtcgcccaggctggagtacagtggcacaatcacagatcactgcagcctccacctccttggctcaagtgatcctccagccttagcctcctaagtagctgagaccacaggtgcacaccaccatgcctgataattttttttttttttttttttggagacggagttgccctctgttgcccaggctggagtgcagtggtgtgatctcagctcactgcaagctccgcgttccgggttcacaccattctcctgcctcagcctcctgagtagctgggattacaggcacccgccaccactcccggccaattttctttcttttttttttttttttgtattttagtagagacggggtttcaccatgttagccaggatggtctcgatctcctgacctcatgatccacctgcctcagcctcccaaagtgctgggattacaggtgtgagccaccgcgcctggcccaatacccggctaattttgtgtgtgtgtgtgacgcagtctcgctctgtcgcccaggctggagtgcagtggcgctatctctgcttgctgcaagctctgccttctggcttcatgccattctcctgcctcagcctcccgagtagctgggactacaggcacccgccaccacgcccggctaatttttttttttgtaattttagtagagacggggtttcaccgtgttagccacgatggtctcaatctcctgaccttgtgatccgcctgcctcggcttcccaaagtgctgggattacaggcctgagccaccgcgcccggccaattttgtatttttagtagagatggggtttcaccatattgtccaggctggtctcaaactcctgacctcgtgatccgcctgcctcggactcccaaagtgctgggattacaggcatgagccaccacgcccagccagaattttttcttttttctagagaagggggtctccgtatgttgcccagtctggtcttgaccacctgaccttcattgattttcctacgtcggcctcccaaagtggtgggattacaggtgtgagccactgccaccggccagtaattatgctgatgaaagacctgttttttctccagttcctgggatggctctagggagggttatttacactgtgagtgaggaggcattcacagagaagttcctccagagtgtggaagaagcactaccatttggcaccaacgcctggagaacaaaggaggagaccattggccaaagagaggcatttccattttgttggaacctgctgaccaccaacccatagcattttttccctttcttccttgctaatccaatcgcagattcattgaggaggtgagaggtcctgagatccaggctggaagaggagtgattggtctacctggttctcaagggataatgttgccccctagaggacattttggaaattattaaggaaaattaacgactggttttttggttgtcatctggttctcaagggaacagtattgcttccttgggagaatttggaaacttaccttttttcatcgtcacaatggtgaagggtttgttactgggattagaggacaaggaccagacatgccaagatgttctacaatatagcattcctaattaataatcacctaatgaataaagctcagatagcacttaaaaagtggggaaaggactgtttatactaaattatgctaagctgtaacactgaactattccagttcttttgaaattgtttacatagcaaaatcatagttgactcctggccatttaagacttatgccaccactcttgggatagtgaaaatgttttgcaactagattgaggtggtgattgtataatatggtgaaagtactaaaagccactaaattgtgcacttcaaaatgctgcctaattttatattatgtgaatttcacctcaataaaaatgtctttttttttttttttttgagagggagtcttgacctgttgccaggctggagtgcagtggcgcaatctcagctcactgcaacctccacctctcaggttcaacccattctcctgcctcagcctcgcaagtagctgggactacaggtatgcgccaccacacccagctaatttttttgtatttttagtagagacagggtttcaccatgttgaccagcatggtctcaatctcctgaccttgtgatccacctgcctcggcctcccaaagtgctgggattataggtgtgagcccccgggcccagccaataaaaatgtttttttaaaaggatgcatatttccaaacatgagactataccatcacatttaatttttcccagaaactataaaaagtagaagtgaagagaggaaagggagacacttttagaccttcaatgagtctgcaagtacaggagaaaataatttatgcagcaattagctttattttcagggctctttttcttttcttttttttttgttgagacggagtctcgctcttttgcccaggccggagtgcagtggcgctatcttggctcagtgcaagctctgcctcctgggttcataccattttcctgcctcagcctcccgagtagctgggactacaggcacccgccaccatgcccagctaattttttgtatttttagtagacacggggtttcaccgtgttagccaggatggtctcgatctcctgacctcatgatccgcccgcctctgcctcccaaagtgctgggattacacgcgtgagccaccgcgcctggccaacaaagtgatcattttacaagagttatggcatagtcacaggtaagaacctgggtcactgggtcactccctaaccaattacgaattactatatgccatggaccttcaggattactttcttttttgttttgtttttgtttttttttttgagacagagtctcgctctgtcacccagaccggggtgcagtggcgcgatctcagctcactgcaacctctgcctcccggattcaagcaattctcctgcctcagcctcccgagtagctgggattacaggcatgtgccaccacgcctggctaatttttttgtatttttagtagagaccgggtttcaccatattggccaggctggtctcgaactcctgaccttgtgatccacccaccttgacctcccaaagtcctgggattacaggcgtgagccaccgcgcccagcccaggattactttctttctttcttttgagacagagttttgctcttgttgcccaggctggagtgcaatggcacaatctcggatcactgcaacctccacctctcaggttcaagcgattctcctgcctcagcctcccaagtagctgggattacaggcatgcggcaccatgcctaaaattttgtatttttagtagagatggggtttctccactttggtcaggatggtctcgaactcccgacctcaggtgatccgcccgcctcggcctcccaaagtgctggtattacaggcatgagccaccgtgcctggcctctatttttctttctataatccatgtacattttcctttaataatataaggcaactaaacagcactttattttcagaggcttatctaaaagatacttgacacagccctttgcagctgggtcattctctgaattctaaatgtcgtttcctgcacaaagtggttatttgatcttgtaactggcattttccccggagattaggaagtggcacaccaaagtgcaaaaaactttggaatcagaactttaatttttaatctttattttatttatttatttatttttgtgacagagtctcgctctgttgcccaggctagagtgcaatggcaagatctccactcactacaaactccacctcccgggttcaagtgattctccgccttcagcctcctgggtagctgggatcacaggcgcacaccaccacactcggctaatttttgtattttgagtagagatggggtttcaccatgttggccaggctggtctctaactcctgacctcaggtgatcctcccgtccatgcctcccaaagtgctgggattacaggtatgagtcactgtgcccggcctaatttttatatttttttgtagagacggggtctggctgtgtttgacagcctcaaactcctggcctcaagtgatcctctcaaagtgttgggattacagacatgagccacagtgcctggcctattgaaagcttttccatcataataggtccttccccccaatgcttgcagcaagtcaatagtaggagaccccaggttgcagcagagaaagaggtttaatcataggggccactgaaaaccaagagaggagatggaaggaaccacgaatccacttccccagggagttcggggctttttaagggttttggagtgggttgaagtgtggaggtcattggttggttgaagtgtgcagggtgaagtaatgaaacagggagttgaagaaactctattctcctgtcgatttggttcctctgcggggtcttcacactggttggtatcagctgttttgctggaattcaggatctgaaaaatatcttaagcttttttttttttttttttttttttgagacaaggtctgttgtccaggctggagtgcagtggtgccatcatagctcattgcagcctctaacgcctgggctcaaaggatccttccaccttagcctcccaagtagctgggattacaggcacgcaccaccacacccagctaattaaaaaatttttttttttgtagagacaggggtcttgtcatgttgcccaggctggtcatgaactcctgacttcaagtgattttcctatctcagtctcctaaagcgcatggattacaggcatgagccaccatgccgggcgctaagcaattcttattatttatttatttatttatttatttatttttttctgagacggagtcttgctctgttgcccaggctggagtgcagtggcgcgaactcggctcactgcaagctccatctcccaggttcatgctattctcttgcctcagcctcctcagtagctgggactacatgcgcctgccaccacgcccggctaattttttgtagttttagtagagacaaggtttcaccatgttagccaggctgatctcgaactcctgacctcgtgatccgcccacctctgcctcccaaaatgctgggattacaggcgtgagccaccacctccggcctaagcaattcttaaataaaaatctatgattccgccaggcatggtggctcacacctgtaatccgtgcactttgggaggccgaggcgggtggatcacaagttcaggagttcgagaccagcctggccaacatggtgcaatccctgtctctactaaaaatacaaaagttaggtgggcatggtggcttttttttttttttttttagacgggagtctctgtcatccatgctggagtgcagtggcaggatcttggctcactgcaacctctgcctcccaggttcaagcgattctccggcctcagcctcccaattggctgagactacaggcgtgtgccaccacgcccggctaattttttagtattagtagagatgggggtttcaccatcttggccgggctggtctcgaactcctgacttcgtgatctgccctccctggcgtcccaaagtgctgggattacaggcatgagccactgtgccctgccaaaaagcctatgattctaacatcagaaatccttccacctcagcctcccacgtagctgggactatagactcagtaccaccacaccaagctaatttttgtatttttaatagagatagcgtttccctatattgaccacctggggccatccctggttttttttttttttcccttccttccttcctttccctctctctttccctccctccttccttcctttctttctttctttcttttttttttttttttacagagtcttgctctgttacccaggttggagtgcagaggcatgatcttggcttactacaacctccgcctcccggattcaagcaattatcctacctcagccttccaagtagctgggactacaagtgtgagccaccatgccctgctaatttttttatttttactaaagacgggatttcaccacattagccaggctggtctccaactcctgatttaaagtaatctgcctgccttggccttccgaagtgctgagattacaggtgcgagtcaccgtgcctggcctattcctgttttcttaacgctcctctctcccactgggccgtgactgcctctaaggcagagatgtgttcatttttattattattgtatgtccagggctgggcacaaagtgcaacacatagtagggacatgaaaggctgggcacagtggctcatggttgtaatcccagcactttgggaggcagaggcgggaggatggcttgaggccaggagttggagaccagcctaggcaacagagggaccccatctctatgaaaaaaaaaaaaaaaaattgacagttcaatgtcacctctgataagccttccctgaccacccctgttactctgtagccccatgtcctgctttatttttctccaaagcatttatcatcgctgggtttatatttatttctcttcgggcttttctcactggatcgtaaactccatgaggacagggctttgtcgatttcactcaataccgttattttacaacatccctattgctgggatctcagtatgcactccttaaatatttgcagaatttaagtgccacataagtgaccacgtgggcaacgccctcggggccttaagccgcgccatttttggggctaggattggttggaccctccgtcacgtgacatgcagtcgccggatcgcctttgagtctcgtgaggtacttttggtcccaggctccgcggacgaggtactgcgcaggcgtgggagggtctgcgcatgcgcagaagcactccgggcgtgctgccggcggcggtaggtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggtcagggccggcgcggcttgaggccgctagggtctggagggggcgtctattctgaggcgtttgcggcccggaaggagcgggaaggtgtgatttgaagggaggaggcgggaattctgtgctctgggatcgtctctctcttggggggactggaggagttgattggggatgtttctggaaggtctgggaagtggttgggagggccgttccgaaggatgggagctctgaagggggcgttggggagtcctgagagagcgggagaattcaaactcaggaaatccgaggcccgaaagcggtgattgtggggtttgatcgcggttaggggataagaggggctggggatacgtggaaagggtgaggtgagggacgcagttcattcattcgagggtatgggacctggttccgtgctgcacacaggggagactggactggccaaccggacagacgggagcttacactcttgtgggagctcacgggcgggccagtctgagagaatgcgggttttgaggagttttggagcaagttatctcaaatgggaatcttgagaggctcggagaggctggagggggacggccgtaggctcccgaaaaggttgcttgtgtttggtatggggctgtgtcttgataggacaggagacgtagtttgggcattgtggagtagcttagggaattctttttttttttttttttttttttgagatagtctctctctgtcgcccaggctggagggcagtggcgcgatctcggctcactgcaacctctgcctcccggattcaagcgattctcctaactcagcctcccgagtagctgggattataggggcccgccagcacgcccggctaatttttgtatttttagtagacacggggtttcgccatattgacgagactggtctcgatctccttacctcaagtgatccacccgcctcggcctcctgaagtgctgggattacaggagtgagccaccgcgccaggacgtcttttgttttgtgcagttgggtgacctcggttcactgcagcctctggcctcccgggttcaagacttcctctcacctcagtcttctgagtagctgggattacaggctcgcgccaccatgcctggctaatttttgtatttttagtagacatgggttttcaccatgttggccaggctggtctcaaactccggacctcaagtgatctgcccgccacagcctcccaaagtggttggattacagacgtgagccactgtgcccagcttgttttttttttttttctttctctgtggcccagtggagtgcagtggtgggatcacagctcactgtagcctcaacctccaaggctcaagggatattccctcttcagcctcccaagtagctgggactacaggcgtgccccaccacatcatccgactaatttttgtttttttttttttttgtaggatggggttttgccatgttgcccagactggtcttgaactcccaagctcaagcgatcctcggcctcaagagatctccccccatctcagactcctaaaatgctgggattacaggcatgagctaccatgcctggcctcattgatcaatatttttacttagcctggacgcagtgactcacacctgtaatcccagcactttgggaagctgagttggggggaggggacctcttgagcccaggagtttgagactagcctgggtaatgttgccaaacccagtctctacaaaaaaatacaaaaattagccaggcatggtgacataagtttatagtcccagcttgtcaggagactgaggtgggagcatcacctgagcccctgggaggtggaggttgcagtgagccatgatcacaccactacaccccagcctgggtgacagagtgaggccccgtctcaaaaaaaaaaaaaaaatccacaagcgtgtgtatatgtgtcagttattaaaggatggtgaagtgagagggttgttttgataggttggccagggaagggctctgaagaggtaacattgagcctcagacttatatgggaaagagccctgtggtcatctgggagaactttcctagctaagagaacagcaagtgcaaattcccagaggcccaggcatgattgtcaaattagagaaataaggtggcaggaaccaaatgatttgaggagtagcttttattctaagtgtgtgggaaaacctgttggagtgttttgagtgtgggagtaacatgatctgttttttgtttgttttttgagacggagtcttgctctgtggcccaggctggagtgcaatggcacgatctcggctcactgccattgcagtgaatccgcctcccaggttcaagcgattctcctgcctcaccttcctgagtagctgggactatcggcatgtgccacaacacccggctaatcttgagtatttttagtagagacggggtttcaccatgttagacaggatagtctcgatctcctgacctcgtgatccgcctgccttgggctcccaaagtgctgtgattacaggcgtgagccactgcggcctggcctggtttgtgttttaaaatgatcgctccagaataggttaaagtggtcagaaatggaagtaaagattctggctggactgttgcagtaatccagttgagataaaaatattggtggcttgaaactcaagagaaggggtcaaataaatatattctggatatattttgaaggtagaagagggaacagaatttggggcagaagtccaggatgacaccactgtttttggcttgagcacctacctggaacgatggaattgccattttgaaagatatggagagctgtaggtttggtggggtcggggaagagtcagttctcttttaggtttcagatttgttttttttgtttgttttttttttttttgagacggagtctcactctgtcgcccaggctggagtgcagtggcatggtctcggctcactgcaacctctgcctcccaggttcaagcaattctcctgcctcagcctcccgagtagctgggattacaggcgcccgccaccatgcccagctaatttttgtatttttagtagagacggagtttcaccgtgttggtcaggctggtgttgaacccctgacctcgtgatccacctgcctcggcctcccaaagtgctgggattacaggtgtgagccaccatgcccggcctcagatttgtttttttatacaactaagtagaaatatgtgaggggttgagttcagaggtaaaatttgggtgatggtgggtattgtgtgagtacagagtatagaattaatggaggggttggggaggcagacacgtcaggagaatttagtttgagggggtgggagctttcagaaggttttagagggtgcagtggtgggatgggaattacctcaggctcatttcagatctgtggggtcttctttgatggggtggggggatgtcatcatgaggcattaacattggtgggagggttgaaggcacctggaatagattgggaattaagtgatgagaatgtgcctctggacataggtggactgcattgattttagggactgctattttctggatggagtggaaagaggatttatgtgagttggaggaaactttgaggaagcttggtgtgttctgagatcctaaagggttggggaggggattctaaggtactggaagggttaatcgaaggggtttgcggcagcagatagctttgtttgaagtggggcaaagttggtgaggtttaaactggaatgtagttagggaactttcagagggatggggatgatttttctgagaagcagtgaagaatggatgggggcctctgagtgggagatgacctaagggacaagtcagggtcagggcatggaatttgtgggaggtaggaattattctgagggagtggagctgtaccaaatttggtggagaacatgaaaaggattggctgggggttgcaggagggagggaagaggttgtttgtaatttgtactctatttttagacagtcttagagagtttattaaagtgttttttgtccattttcagccgaggtttttagaaattaaaaatttttttgtgtgagtacatagtaggtgtatacattttgggggtatgtgagatactttgatacaggcatacaatgggtaataatcacatcagggtaaatggggtatccaccaccttaagcacttatcctttgtgttacaaacaatccaattatattcttttagttgctttgaaatgtacaacaaattattgttgactgtagtcaccctgttatgctatcaaatactgtatcttattcattgtatttaattatatttttgtatccattagtcatccctccttcccctccaccccccactacccttcctagcctctggtaaccctcagtctactatctgcatgagttcaattgttttaatttttttagttcccacaaataagtgacagcgtgcaaagttttctttctgtgcctgatttatttcacttaacataataacatccagtgccctccctgttgttgtaaatgacaggatctcattcccttttttttgtagacagggtctctctgtcgcgcagactagagtgcagtggtgtgatcacaactcacttcagccttgacttcttgggctcaggtgatcctcccacctcagcctcccggtagttgtgactatagcacgtgtcacaagcccagctaatattttagtacaggtggggtttcaccaggctagtctccaactcctgggctcaaataatcctcctgcctccctgcaaagtgctgggattagaggcgtgaacagcaatgcccagcctttgtaccacaatttctatttttttttttgaaacggagtctcgccgtgtcgcctaggctggagtaggctggagtgcagtggcgcagtcttggttcactgcaagctccgcctcccaggttcacgccattctcctgcctcagcctccctagtagctgggactacaggtgcccgccaccacgcccggctaatttctgtatttttagtagagacggggtttcaccttgttggccaggatggtctcaatctcctgacctcgtgtaccacaatttctttatccatttgtctgttgatagacatatgggttgctttcaaatcttggctattgtgaagagtgctgcaataaacatgggatttattgcagttttttttcttttgagaccgagcctcgctctgttgcccaggctagaggacagtggcacgatctcagcccagtacaatctccacctcccaggttcaagcgattctcctgcctaagcctcccaagtagctgagattacaggcacctgccaccacgcccggctaatctttgtattttttagtagagatggggttgctgtgttggccaggctggtctcaaactcctggcttcaggtgattggccctccttggccccccaaagtgttgcaattacaggcgtgagccaccacacccagcctgatttattttcatttgggtatatacctagcagtgggattgcatttttacccgagtcttttttttttttttttttgagacggagtttcgctcttgttacccagactggagtatggtggcgtgatctcagctcaccgcaacccttgcctcccaggttcaagcaattcttctggttcagcctcccaagtagctgggattacaggcgtgtgccaccatgcccggctaattttgtattttagtagagacgggattcctccatgttggtcaggctgtgaactcctgacctcaggtgatccgcccgccttggcctcccaaagtgctgggattacaggcatgagccacagcccccggccttcacctgagtcttatagcagctctctggagtcggaagggcagtgatttccttctctgttcagatgaggaaggaggctccacagagcaaattgacttgcctctaagagggctctaggtgggataggagggttctaggtgggataggagaactctggagactggagttcctttatgaaacagaagccctggaaatgggcaggctgataaaatgtacaaattgtggggcattttataagacagttatcctacttctcttccaaaagtcagtttcatgggaaaaataagtgaagggactgttgtggattaaaagagagtaaaggccgtcacagtgactcagcctgtaatcccaggactttgagaggccgaggtgggtggatcacctgaggtcaggagttcgagactagcctggccaacatggtgaccgtctctactaaaaatacaaaaaaaattagccaggtgtggtggtgggtgcttgtaatcccaactacttgggaggctgaggcaggagaattgtttgaatccaggaggcagaggttttagtgagccaaggtcacactatcgcactccagcctgggtgacaagagcgaaactctgtctcaaaaataaataaataaaataaaataaagtaaagaagcagcttcctagagcagatttggttgcttaaattgaggccaagtttctggagtttttattgatagttgacaattacaactaaaatttttttttctcgctctgttacccaggctggagtgcagtgacgcagtgacgtgatcttcagctcactgcaacctccacctcccgggttcaagggattctcccgcctcagcccccaagtagctgggaccacaggcgtatgccatatcactcagctaattttgtgtgtgcatggcgtatgccgtaacactcagctgattgtgtgtgtgtgtgtgtgtgtgtgttgttttttttttttttttgtgatggactctcactctgtcgcccaggctggagtgcagtggcacaatcttggctcactgcaacctccgcctcctgagttcaagcgattctcctgccttagcctctggagtagctcggattacaggcgcgtgccaccacacctggctgatttttatatttttagtagagacggggttttaccatgttggccaggctggtctcaaactcctcacttcaagtgatctgcccacctcggcctcccaaagtgctgggattacaggcgtgagccactacacccggcctatgtgtgtgtattttatttttttatttttttgagacggaatttctctcttgttgcccaggctggagtgcaatggcgtgatctagactcactgcaacctctgcctcccgggttcaggcaattctcctgcctcagcctcctaagtagctgggattacaggcgcctgctaccgcgcccagctaatgtttgtatttttagtagagaccaggtttcgccatgttggccagggtggtcttgaactcctgacctcaggtgatctacccgcctcagcctccttaagtgctgggattacaggcatgagccactgcgcctggccagaagttaccttctttgtgcctgttttctcagctgcaaaagaggggtaacaaagtgccagcccattagattgtcatgggaattaaatgacataatacatacaaagagcttagtagaacagtgcttggcacatagtaagtgttagataaatgttggccattattattttattatgtaccagatttctataattctgctgatggacacaggtttgttttggtgtgtctattaattcacagccatttgagtaacagtatgtcctaaatgccaaggaagttactggttctagtgatacagtggtttctggagtttacattctaatggaggagggggcagtaaacatataaacaagtagtgtagcttagcacagtggtgtgtggctgtgatcccagctactggggaggctgaggttggaggatcacttgagccaggcaattgagactagcttgggcaacttagtgaggccccatttcaatcaaaacagtgggcaacacagaccccatcttaatcaaaacaaaaacaagtagcataattcgagatagaagaggatgtggacctattttaaattaggtggccagtatggacttctctaaggaggtgacaattgagctgagacctaaagaatgtgtcccttaagaagttgagggaagaagcaatgggaagcactaatgccaaggtcctaaggtgggagcaaggatgggagcaaggatgatgttctctaggatcagcctcccgagtagctgggactacaggcacgtgccaccacgcctggctaatttttgtattttgagtagagatggagtttcaccatattggccaggctggtctcgaactcctgacctcaagtgatccgaccgcctcggctaattttgtgtatttttagtagagacggggtttcaccgtgttagccacgatggtctccatctcctgaactcatggtcctcccaccttggcctcccaaagtgctgggattacaggcgtgagtcgccgcgcctggcacacccagctaatttttttttgttttgtacagatggagtcttactttgttgcccaggctggtttcgaactcatgggctcaagtgatcctcatgccttgccctcctaaagtgctgggattacaggtgtgacccactgcgtccagcctgctgtagttttgtcggagagaaacgatggtggctcagactagagtggtgtttgtggaacttgagggaagtagatggacaatgctgctgtgaatgtgtatctttttttttttttttttttgagacagagtctcactcttgtcacccaggctggagtgcagtggcgcgatctcggctcactgcaagctacaccttccgggttcacaccattctcctgtctcagcctcccgagtagctgggactacaggcacccgccaccactcccggccaatttttttttttttttttttgtatttttagtagaaacggggttttaccatgttagccaggatgatctcaatctcctgacctcgtgatctgcccgccttggcctcccaaagtgttgggattataggcgtgaggcaccgtgccctgctgaatgtgtatcatttttgtgcccacttgggtatttctttttttttttttttttttgagacggagtctcgctctttcgtccaggctgaagtgcaatggtgcggtctcggctcactgcaacctccgcctcccgggttcaagcgattctcctgcctcagcttcccgagtagctgagattacaggcgcctgccaccactcccggctaattttttttttttttctttttgaaacagacccttgttctgttgcccaggatggaatgcagtggcgccatctcggctcactgcaaactccacctcccgggttcacgccattctcttgccttagcctcccgagtagctgggactacaggcgcccgccaccatgcccagctaattttttatatttttagtagagatagggtttcaccttgttagccaggatggtctcggtcttctgacctcgtgatctgcctgtctcggcctcccaaagtgctgggattacaggtgtgagccaccgtgcccagcccacgcccggctaatttttgtaattttagtagagatggggtttcaccatgttggccaggctggtctcgaactcctgacttcaggtgatctacccaccttggcctcccaaagtgatgggatttgtaaacccagcactttgagggaggcagaggcaggaagattgcttgagcccaggagctggagatgagcctgggcaacatagtgagaccctgtgtctacaaaaaaaaaaaaaaacccataaatcagccaggtgcagtggtgtgcacctatagtcccaggactcaataggccgaggtggcgggatcacttgaacctgggaggttgaggctgcagcgagccctgatcttgccactgcccttcaatctgggttcacagaatgagaccctgtttcaataaaacaaaacgtaaacatggtatttggtgttgatggcagttgagtatttaatttaatttaatttaattttttttgagacggagtctgtcacctgggatggagtgcagcggcacagtcttggctcattgaaacctctgcctctcaggttcaagcgattctcctgcctcagcctcccaaatagctaggattacaggtgcccgccaccaacatgcccagctaattttttttttttaaacagagtctcgctgtgtcacccagactggcatgatctccgcttactgcaacctccgcctcccaggtttgagtgattctcctgcctcactgtcccgagtaactgggactacaggcgcctgccaccacgcctggctaatttttgtattttctgtagagacacggttttgccatgttagccaggctggtctcgaacccctggactcaagtgatctgcccgccttggcctcccaaagtgctgggattacaggcgtgagcccccacgcctggccataattttttttgtatttttagtagagagggtgtttcaccatgttggacaggctggtctcgaactcctgacctcaggtgatccacccatctcagcctcccaaagtgctgggattacaggcatgagtcaccgggcccggctgaataatgaattttaaacaactgcagagcagtctgtagagctatgtaggaatgtaggtcgtggagagcagatttattgtcagggactttttatatgtagctgttgctggaagagttcggggagggggagtgcttgctggtattgactcagccatgataaaaaagcctttttttgaggaaatggcattggagttgggttttgaaggggaaaggcgtaggtaggcattgagaggaagaaatggtgcattttgcgagggtggaatgttgtgattaaattttatttaatttttaattaaattaatagcaaactcttaccagcagaacttaaattgtgtgaaaattattcttagttattactaaatccttttcagtatgaataatacatttgctgcagaattattaatgagtttggttacatgatgcagcccaagatcttgatgagttgtttcataatacatgatgtaaagtctgtatttcctttttgaaatctgaaaaaattgtgactctgaaatacttctggttcaagagatttcagataagatatagttgacctattctgcttcctactgacctcagagaagtcttgggatggcctgacctctgattgccttttttcagcctcatcttctgtcactttacagatttaaaaagctaaaaacaaggctgggcacggtggctcatgcctgtaatcccagcactttgggaggctgaggcaggtggatcacttgaggtcaggggttcgagaccagcctgaacaacatggtgaaactccgtctgtaccaaaaatacaaaaactagccaggcgtgacagtaggcgcctgtaatcccagctactcgggaggctgaggcaggagaattgcttggacctgggaggcggaggttgtagtgagctgagatcacgccactgcactccagcctgggcaacagagcgagactctgtctttaaaaaaaaaaaaaaaaaggtaaaagcaattcctgtgtacatgctcttttcatgccaccatgtgttttgcttgtgtgttatacttaactagtgcctcttctcagcacctcttctgctgtcatgctagtttgagccaccatcatcctccctcaccttaactgtgacatcttcctacccccatggctttccatcatgcctcgaagaaaatccagaatccttccattgcatgtaagagccttcatgatgtggccccttgttccaacttttcagcctctctgtcattcctgtccctagaacatgccaagcactcctgcttcagggcttttgcatttgctgttttctctatctggaatgttctgctgccaaatatctgtgtgtttgtcctttatttcattttgatttttgctcatatggcatctcctcagaaaggcttgtatgatttctgtctcaaatagcgttctccatcattcttgattcttgtcacacttgattttcatcactttttcacatattatgtatctatttgtttatctgtctcctactttttcatgagggcagggactatgtctgattcaccgccttatttccacaccatagaaggatgcctggcatagttggtactcaataaatatttgttgaatgaattgttttgtgcagtatggattagagcctgtctctttcctagattcgaggtgtgatgcctcaatgcagttagaaccaaaatgatttttttttttttgagacggagtctcactcttgttgcccaagttgaagtgcagtggcatgatctcggctcactgcaacctccgcctcatggtttcaagtgattctcctgcctcagcctcccaagtagctgagattacaggcgcctgccactacgcccagctagtttttgtattttagtagagacggggtttcaccgtgttggtcaggctggtctcgaactcctgacctcaagtgatccgcctatctcagcctcctaaagtgctgggattacaggcatgagccaccgtgcctggcaaaccaaaatgatttgtgtattttttgttcttctgtgattctgcaagctcactgttctgtatcatcaggttaacaatgtttgtcttacaggctgcgggcctctcgggtgcttcttgtcggcttgaaaggacttggggctgaaattgccaagaatctcatcttggcaggagtgaaaggactgaccatgctggatcacgaacaggtgcgctgttgtgagctcattcctcccctgctctggctcccctttccagcatgaagatctgcagattttgtgagttcctccttgtgccttaagggctgtgaaaggagggctaacattaataaaccattgcctctggagactgaaggtgctattgttgggtttgaattctagctccaccacatctagctggatgagcagtagagactcacaccccctcattgagcttgcctgcctgtaaaatggggttagtaatatctcccttggtggttgcttgtgaggaggtgtagagaagtgtttttccaatttgtgcctaaaaatgacctgagtgactaactgaaaatgcagagtggcctggaggcttcgtggtgccctagctttcacccctagtgattctcatttaggtctgaggcgagctcaggagtatgtgcatttaaaaggtgttttagggctggacgcagtggctcatgcctgtaatcccaacactttggaaggctgaggcaggcggatcatctgaggtcaggagtttgagactagcctggccaacatggcaaaactctgtctgtactcagtatacaaaaattagccaggcatgttggtgtgcacctgtaatcccagctactcgggaggctgaggcacaagaatcgcttgaatctgggaggtggagtttgcagtgagctgagatggcaccactgcactccagcctgggcaacagagtgagactttgccttaaaaagaaataaattaatgaaaggtgtttcaggagattatgatttagatggtccacagacatcactttaaaaaacactggatcaggccaggcacagtggctcatgcctgtaatcccagcactttgggaggctgaggcgggcagatcatgaggtcaggagatcgagaccatcctggctagcacggtgaaaccccatcactactaaagacacaaaaaattagcagggcttggtggcgggcgcctgtggtcccagctactcgggaggctgaggcaagagaatggcgtgaacctgggaggcggagcttgcaacgagccgagatcatgccactgcactccagccttggcaacagagtgagactccgtttcaacaacaacaacaacaaaaacaaacaaaaacaaacaacactggatcagagagaatgtgggcagactgctttgtatagtgcttgaacctaacaagtatccagtaattaggaataatgatctgacatgctgtttgtttgtttgtgtgtttttgcgagacgagtcttgctgtgatgcccagactggagtgcaatggcgcaatctccgcacactgcaacctccgcttcccgggctcaagtgattctcctgcctcagcctctgaagtagctgggattacaggcacgcaccaccacgcctggctaagttttgttttgttttttttttgagacggagtttagctcttgttgcccaggctggagtgcaatggcgtgatcttggctcactgcaacctctgcctcccaggttcaagcaattctcctgcctcaatctcccgagtagctgggattacaggcatgcaacaccatgcctggctaatttaacgtttttagtagagaccgggtttctccatgttggtcaagctggtcttgaactccgacctcaggtgatcctcccacctcggcctcccaaagtgctgggattgcaggcgtgagccaccgcacccggccatgcctggctaagttttgttatttttagtagagatggggtttcaccatattggccaggttggtctcgaactcctgacctcaggtgatccgctggcctcggcctcccaaagtgcggtgattacaggtgtgagctaccatcccctgctgacataatgctgtttgattaatattataatggtagagcccaactccaatgtagctttctctgaccaggctcatcttcaaggtgaaaataagtgctgctctctctacattcccatgcctcagtgacattttatttattttatttatttattttgagacaaagacttactctgtcgcccaggctggagtacagtgacacaacctcagctcactgcaacctctgcctcccgggttcaagcacttctcctgcctcagcttccctagtagctgggattacataattacttcatctggttgtaagaatccaacattggaggccaatcacagaacagtgcgattctgacaccacaggtgtgaggccactgcacccatcttagagcgtattatgtagtttacattcaacaagcatctgagagcacctactgggtgccctgaagtctgctaggtgctggtgatagaaagatgctcacggtttggttcccattctcaaggtttttttttttttttttttccggaaaccatagcaggctccctgactgaggttgtggtacatgaaagatttcctggagtcctgatctgagctaagtcttaaagaacaaggagggttgtcaagataagagcctgtgttttaggcaggggacatagcagtgtcacaaaggcaccctacagtgtggtagaaatggaagctaaaagtagtttggtgtttttagagtgtgagacccaaagtggtgggtagggacaggttgctggtgaagtccaagtcaggaggggctcctaggaagccccactgtaagcttttacttaatcctctgggtggtgcagactcactgaagagtttcaaatgacaggaagggtgacatggttagctttgggctttatgtgtagatcagtaattactgtataaactatggttggcacaaaatacagggcagaagaccacttagaaggcagtttttagtagtttaggtgagaggtgaaagtggccttgctgatagggatggcaggaagcacacagatgtgagaaatagatttaggtggtagaattgggaggtctgtgtatgggagcttaaggaaagccaggaataaccagagcagctgacactgaaggggctaggcactgttctcagagctgcagttgtattatctcattgagtcctcacaacacatctgagatcaaggacccattaccatccctgttttacagatgggaaaactgagtaaaaggaagaaaagtactggcccatccaaggccccagtagttagtggtacggccgggacccaggcatctgactccagagcccatgttctcagccacctcactatggaccactctcatggaaatagcaaggatatgaagatgaggcttctggcttgagtgactgggtgggtggctggtggactccggagacagcacacagaagcaggcagacatgtagggtttatggatatctgagagaaaacggctggtgggcagtacagtagagaagactcaggtggatcaggaagaaatctgcaccagaaagagtgatttgaaaaataacagcagattttggtagaaactgaaagaggcattgagttggtttatggagctatacagagtggaaagataagtaattctgagatggaagcttggggacagccacacctaagagggcccaaattgagactagaatgtgtagcacgagaggagagcaaagcaaggaaggtgtgatctgtggactgatagtgatgaaatgataattgtatgtgtatgggttttttttttttttttttttttttttttgaggcagtctcactgttacccttgccggaatgcagtgggcatgatcatggctcactgtagccttaacttcctgggctcagggtattctcccacttaagcctcccagtagttgggactacaggtgcacgccaccacacctggctaattttttgtattttttgtagagactgggtttcatgattgttgctcaggctggtcttgaactttctgggctcaattatatgttttttttgtttgtttttttgagatggagtctcacttgtcgcccaggccggagtgcagtggtgagatcttggctcactgcaacctccgcctcctgggttcaagtgattctcctgtctcagcctcccaagtagctaggattacaggcgtgtgccaccacacccggctaatttttgtatttttagtagagatggggtttcaccatgttggctaggctggtctcgaacttctgacctcaagtgatccacccacctcagcctcccaagctgctgggtttacaggtgtgagccaccgtgcccagcctcaactgtatttttttttttttttgagacagagtctcgctctgttgcccaggctggagtgcagtggcgcgatcttggctcactgcaagctctgcctcccgggttcacaccattctcctgcctcagcctccctagtagctgggactacaggcgcccaccaccacgcctggctaatttttttgtattttttagtagagatggggtttcaccgtattagccaggatggtctcgatctcctgacctcgtgatctgcctgccttggcctcccaaagtgctgggattacaggcgtgagccaccacgcgtggccctcaactgtacgtttttatccatgtcctcgttttatatgggattcccacattcttgctgaggttcacacagttgttgagccaggatttgaatcaaagattgaatccagcctgaattatttcagagccttactgttaaccattgtgtggtacagcttctcagcacataatgagatccctgaagaagcaggatggaatgggtcaaggatacagggttagcctagaatgggaagtgggccagctcattttcttggaggagaaggtagtaagatagagagtgtgctgtggatggttggtaggaggtgttgaggggagattacttctgttgtacctagtcttggtgaaggtggcaaggttatttgcagagattaatggttaaattagatgtttgatgtgtgaagaaatactttgagagcagtatggaatctgtaatcttactggtggctattaggggattatattatcctgtctttgaggctctgctctgctgatgttcagccttaggggtgaaataattcctctgttccagtccccactcatctctccacctctctgagttctttttttttttttttgagacagagtctcactctgttgcccaggctggagtgcagtggcacgacctgggctcaatgcagcgtctgcctcccaggttcaagcgattctcctgcctcagcctcccgagtagctggaattacaggcgtgtgccaccacgtccggctaattttgtatttttagtagagatggggtttcaccatgttggtcaggctggttttgaactctggacctcaggtgatctgcctgcctcggcctcccaaagtgctgggattacaagcgtgagccaccgcacctggccatagtctatctatgttttttaaaagttcatttcaagcattcttaattgtgtctgatttttgcacaagtttgattttttttttaagttttctcatgaggttgcaatttttgttgttttttgagagagggcctctctgtgttgtccaggctagtcttgagctcctggcctcaagcagtgatcctcctgctttggcgtcccaaattgctgggattacagatgtgagctactgtgccaggctgcactggtctactttttttttttttttttttttttttgagacggagtcttgctctgttgcccaggctggagtacagtggtgcaatcgcagctcactgcaacctccgcctcccctgttgaagtgattctcctgcctcagcctcctgggtagctgggattacaggcacacaccaccacacctggcttatttttgtatttttagtagagatggcatttcaccatgttggccaggttggtctcaaactcctgacctcaggtgatcctcctgcctcggcctcccaaagtgctgggattacaggtgtgagccaccgtgccctgcccacactggtctagttttaaaccactggaagacagagatttaatcctttaaactacttgtgtatttccccaaatgcttatagttgggcacatgctaagtatttagtcaattcttgccactgttaatcagtcatttgttagcagttacaaatttgcatagaagaagaaagcatggatttttttgttgacagtgaattttctttataaacacaagggggtgctctttaaccatcaatgaccagtttaaaaaaagtttaaagtcattttaaagccttagaaggaagcctgcataaggcaaattgctacaggaacagtaatacattttagggctgtgcacagtgtttcatgcctgtaatctcagcactttgggaggctgaggcaggcggatcacgaggtcaagagattgagaccatcctggcaaacgtggtgaaaccctgtctctactaaaaatacaaaaattagctgttgtggtggtgcgtgcttgtagtcccagctacttgggaggctgaggcaggaggagaatcatttgaacccaggaggcggaggttgcaatgagccgagatcatgccactgcactccagcctggtgacagagcaagactgtctcaaaaaaaaaaaaaaaaaaaaatttaggtggtaggtattttagctatcctttaaaatttaaagattctttttaagatttattttccctaaaaatacaagacttaaaaaaatatgtgtattattcctaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtaagtttcttattataaaatctgctgtgggaattaaacaaattaaggtgctagttgtatatactttcaaatcccaaagcaatctgagagcattcaaatatcaaattctgagctttttcccaagaaaatgtataagctgttctattgtttaggcttagtatattgtgtgaatgtgttgctagagaggtccagtctgttgcatctgctgtagttgttggtgacttgctgtctgctggcttcttctctgggcatatgttccctcagccaggtttcgtctttggtgttttgtcttccttccagaatctttgcacataactttaatccatgttattgcaaatgttttcttccgaaaacttaacaagttggtgattaatttctgtggcagcggcatttttttgttagaaatatcaaactacagcttgtgttttgtcttaagaaaagcacacctgatcttgatctatgtctgtctgtctgtttctcacagtcacattgaccatgttgccatggataactagagaaaaatcactgtagtcgtaagtcaaatgaggcatatccagcctcatttagtttcactgccaaatctatgcggaggtgaaaggataaattctttgtcaatatctgcaacctttcagacatagttccctgcattctggaaaagcttaacaaatcttgataaatgtgaaatagtcatagatgagctactagttttttaaatgaaaggccccagtatgttacatgagaggttagaatttgggttgggtagttttttttttttgcacctttttttatttgagatggagttttgctcttgtcgcccaggctggagtgcaattgtgcgatcttggctcatggcaacctctgcctcctgggttcaagtgattctcctgcctcagcctcccaagtagctaggattacaggcactcaccaccatgctgggctaattttttgtatttttagtagagatggggtttcaccatgttggtcaggctggtcttgaacccctgacctcaggtaatccacctgcctcggcctcccaaagtggtgggattacaggtgtgagccactgcacctggcctgttttttacacttttctttctttctttctttcttttttgagatggagtctcactctgtcgcccaggctggagtgcagtggcatgatcttggctcactgcaacctccgcctccctggtttaagcagttttctgcctcagcctcccgtttttacacttttctatttcatatgtgcatctgttcaaatatgggcttggaaggatggatcatctgtgcatttgtcctgttttctttttcctagtcccttctattttttaacttgaggtattgggacactttccatttggacataagtcttcattttcttatctgtagtaaccacatttattttatgccaggtgtcccttgaacttgtagagttagagggtttgttaaaactgaagtgtgaggccagttgattgtgtaatgcgtgtgcatggggccatgttgaccgccttgcaggccgtgtttggctggtccttgcaggttttatagttactttagactctgcagggttccatttgatcaattggttgcatgttcacctgtggatttcttactttttagatgggatttttccttgggtggctgcattctttgaaacaccaaaggaacacatttctctgtgagtgttatttcggtattcaggctgctagacaacagcaaagagggtctatcaagtgaaaatgtccttttgttcaggagaaagcatgtgcaatttggaagttgtcttttgaccatgatcacaaagcttctcccgaaaagatggtattttgtgcagtagaacttagccatttccaatacctcaacttactggaatacaacctggaggccccagagcaacactgataattccactgagtggatcaccagttcattgtctaagcctgaatggaaggtcacttggtctgtaaccttttcttttgtccttaaattcagataaagtttcacaccgcaatctgtggaaaaatgatctcaacaggacttgtttatcttctttatcttaacatatcaatcaaaaggaggggggtaaaaagcccttgtatttaaacatgacctttgggtcaatttaaaaaactggttttgcttgtccctgtagcttatttggattttaatagatttagcagtatagaaacaacttgctaagttattttttttatgagaactatgaaatgtgtatatgttcgtggattacagaaaacatttgttgaatggcttttactttttagctaaacacattttattttggctgcagaacgtgacggtctcataacttatattttctacacattgaaacctgcaacttttcttttgtcttctagccatagggcccaaagaacctgttgtaccagtttgaaacatgctttgagcatgcccagagagactgttcattaagatttatttagacatcagggcagtgattcacagtttgcaaaactcaaacccagccaatttctttctttctgcaggtgtgtctgacttgctgctccagggatgtcatagttaaagttgaccagatctgtcacaaaaatagcatcaagttctttacaggagatgtttttggctaccatggatacacatttgccaatctaggagagcatgagtttgtagagtaagtgttgggagaggaggggagaacataacattttctcctttttatactttttttttttaaattatgtatttatttatgtgtagagacaggatctatgctatgttgttcaagctggtcttgaactcctgggctcaagtgatcctcccaccttggcctcccaaagtgctgggattataggcatgatccactgcgcctggtctgctgacatgttttcaagttgagagatagtaaaatgattacaaaatagttgggcgattctggaggcatattcaaccaaagtctaccttggaaaaggtgtccaatatccagagagactcctctggtagaacaaacagacctcatcctctcattttgaacactgaggctgcagaacttggtaattcttacatgacaggacttgccgtgttttgactttgtagtctctaggtgaaagatggcagatgatacattattgtaaaactatatgagttaggtattttggctgcagtttctgaccaccccctccaaaaccctccaacttgctaattgagagggaaagacaggctctgtgagataggagcttcctaccaagagactgagaactcttctcttgttcagcctctcaggcaagtcactgaaatttctctggtctccaagtttcttgcctgtaaaatcaagatgggggaaggacagtcatgttccagacatctcctaactctagtgttttatggctttaggataatctagttctttgggcatattattattattattattttattttttgagacggagttttgctgttgttgcccaggctggagtgcaatggcaccatctcagttcagaacaatctctgcctcctgggttcaagccattctcctgcctcagcctccggagtagctgagattacaggcatgcgtcaccatgcctggctaattttgtatttttagtagagacagggtttttccatgttggtcaggctggtcttgaactccggacctcaggtgatccacccacctcggcctcccaaagtgctgggattacacaggcgtgagccaccgcacccggctattattattatttttgagacggagttttgcttttgtcacccaggctggagtgccatggcacgatcttggctcactgcaacctccacctcctggattcaagtggttctcctgcttcagcttcctgagtagctgggactgcaggcacccgccaccatgcccggcaaatttttgtatttttagcagagacggggtttcactatgttggctatgctggtcttgaactcctgacctcaggtggtccacccacctcagcttcacaaagtactaggattacagccaccatgcctggcttctttgggtatattataaagaagttatagtagtgggaagcaatccagattattttaacataagctgcccacagcagaggggcagaattaagtttggcttttttttttttttttttttttttttttttctgagacagactttcactcagttgcccaggctggagtacagtggcgtgatctcagctcattgcaacctcctcctcctggggtcaaccaattctcctgcctcagcctcccaagtagctgggattacaggcgcccaccaccacgcccggctagttttttgtatttttagtagagacggggttttgctatgttggccaggatggtctcaaacccttgacctcaggtgacacgcccgccttggcctcccacagtgctgggattacaggcgtgagccactgcacccagccaagtttggctatttatttcatgattcaagtagagtgtttacaaagtaatcactttgatttattgagagcagctgtgtgcccagcagtgtgctgagcaacttacgctgctctgtttttcccacaataatttcctgagtgcccaacagtgtaccagactcatcatgttatcaatggcagagctcgatttgaaccgagatctgactccaaagcttttgcccttaaccaccatcccgatctgtgacctggagaggctttttttgattccaataacatgattcctagggtaaaattacattctctccccttgtcaccctctagggagaaaactaaagttgccaaagttagccaaggagtagaagatgggcccgacaccaagagagcaaaacttgattcttctgagacaacgatggtcaaaaaggtatgtgtaacgtgggggcagaggtcagaaaccctggggccttggaggggtcaggcaatgacgattgaaaaggataagagcaagcacttcttgaaggggtggggcgggtgcttgtcccatctaaagggaggctgccacagcttagtgtcagccagctgttgctgtgagggaatgtgggcccagtgattccagatgggatttttcaagacaatgagaaatgcaaacttttgtaggctctgtcccaaacttttttttttgtgtgtgtgagatggaattttttcttgtcgctcaggctggagtgcaatggcatgatctcggctcactacagcctccacctcctgggttcaagcaattctcctgcctcatcctcccaagtagcacccctggctaatttttttttgtatttttagtagagacggggtttcaccatgttggccaggctggtctcgaactcctgacctcaggtgatccacccgcctcagcctcccaaagtgctgggattacaggcgtgagccaccatgcccggccccataccctttttttttttttttttgagatggagtcttgctgtgtccaggctggagtggcacaatctcagctcactgcaacctccacgtcccaggttcaagagattttcctgcctcagcctcccaagtagctgggactacaggtgtgtgccaccacacccagctaatttttgtatttttagtagagacggggttccaccatgttggccaggatggtatttatctcttgacctcgtggtccacctgcctcagccccacaaagtgctgggattacaggcatgagccaccatgcccgaccagaaaacttttttttttaaagcagcaaaacaccagccctgggttacagtagcaagaccccgtgtctacaaaaaaaatgtaaaaatttgtctggcgtgatggtgagcacctgtaggcccagctactcataggctgagctgggaggattgtttgagcctgggaggtggaggctgcagtgagccatggtcacaccactgcaccccaacctgggccacctagcaagatcctgtctaaaaaaaaaaaaagcaaaacaaaaaattttttgtattttctctactaacaatacaaaaattagctgggcaaggtggtgcgttgcttgtagtcccagctacttgggaggctgaggcaggagaatagcttgaactggggaggcggatgttgcagtgagccgagacggcaacactgcactccagcctggcgacagaacgagactctgtctccaaaaaaaaaagttttctttgcctgtttttttccttttgccaaataacctttaataagaaaaatccttcaatgttgtcttgctgtgtccaggctggagtggcacaatctcagctcactgcaacctccacgtcccaggttcaagagattttcctgcctcagcctcccaagtagctgggactacaggtgtgtgccaccacacccagctaatttttgtatttttagtagagatggggttccaccatgttggccaggatggtatgaatcctcagattcatatttgttaatgtagtttatattaggggctcagcctctatttggattaggtgcaataattacatttatagaaaggagtggagaagggatcagaagacgatggtttctgtagctagtgctggaatctgagatgggaaccatgcgatggggaaagcaagatgaaggggccagaattggtttcattgaactgagaggaaagacatgaccaagcccatatttactctttgctttgtagatttaaatgttgagaaagaaaaacagctggtcagaatgttgagttaaattacgctaacgaggggattctaaagagtgcagaaaccacaaaagagactgcagaaaaccacaaaagtggaactctcagactctccagcaaggcggcgttggagattttctttctcattttgtgtttgtgttggagtagtttggtgctgtaagtgtgatacagaggaattaagccctaattttagtgtctattcacagaaccataattatccagagtgaaccttggtgttttggccaaaacttgggtgcctttctttctttttgaggcccagtcaagatttatctgaatagctccgtgaatttggtggggggagataaattgttaacaaacggaggagtacaaaagctgctttgtgggtgctgtcagtttataaatcacaccctcttacaagtgtgacacttggccttggtgtgaagggttttatggcttaagggccttctctgattgaggcaggtctttcacattcaaatggagagagtgcctagctttgttagccattcacagctggaagtttccctggagtcagttctgatggtgcccactggggtggatctggaaacctcttttgggaaccactttatctcgctatgaggagaatgtgggcagcccaggcctttgcccaccattccggagggccctacaggcacagaggtttttgtgcagcctcttcctacgtggagctgagctggaaggtatcaaaatattccccagctgacattgttagtcagctgttacacttgaacaatgcaggctcggattccaaccccaagcccttaaggttacgaggcattcagtgcattcctgctgacaatccctgggattccaaaccttgcctttgtgcagcctcaccaagggccctgcggaccgactgggctggactgggttttggccatggctttgtcaccttgcaataacatgcctccttccgttttggcacagatggccctgtgatttcaaggttctcttccaacaccaaagattccttgattcagatgctgcccttttgcctaattgtacagaataactagttgggttgtgctcagagagtgcagggtgggggtggggaagcagctacttcctgtttcctgtgaaaggttttctggttagggttcccttcccctccccgctttccctaggtttaaccaaaggttgtaaagccacttttgcttcaaggtacactttgtgctcctaaattagtaacgttgaaaaacaaaaaggaaaaacagcctgtggttttcacaccctctaggaagctggtgggcctttctagcacctgtgccattctgataaataagggcttaggaaaatgcctagcccagaaataggtgctcagtagtttgtttgcttcctttggtgctcaggagaagatttgagacggatttcgtcacaatcaggtctcgggcacaagcctcacatggacactgacatgcaggagccagaggagacagcaatgaggtggtggtaaggaagtgcccaaaaaggtttcccagaggaagagttgtttgtgttggcatgtgagggacaagctttccaggcaccagagccaagagcagtgctctgtccgaggaagtaggataaaccgaaagacggacgtaggggcagagttgctgtggctgccctcactgccgcagccagctccttccatgagttgcagaatgcctactgtgtgcaaggcactgtgttgagtgcagggaatcacatccagtcttgttgtccccatctatagctgataaagaagctatgagaaattaagtgacctgaccaaggccacacagctgtggaagaaggggcgagagcatagacagtgggtaagggcataggctcaccctatgatttacaaagagggatacccctgaagttgctagggtaacgtgacatattaggaggatggtgggataaaatatgtgaacatcgggatcattctggaaaacctttaggataaaaggccactgtcatgctcccatgttcacgtttctttattgtgagttatctgtgttaggtgctgccagagatgatgagatgcctgacagtggttactctgtaatagctctttaaaaattaaagacaaagtagggtttgttcctgactgtactagaaatacagatttaattttacctctgctcctgaaataggtgactaatttggagtactattaatactcttttcatgaattagttgagaaattccacagttgaggagtgattcattcttttgactccctctttctgagcaatttgttgacagccttctcatcctctcttacacccgtcattaaagaaacagtcgagttctttttctttcatgtggtaccttggtttccactgctggtggcccttaggttgcttgtctctgtctccccgcttccattttaagctccatagggggaaggtagtcttgttcactgctagactcctagtccagtgtgtagcacagtcatatccacggaatatttgttcagtgtactggtggctgttaactgcagcataatccagcaaccctggagattattttcttcctttttttttttttttctttgaagcagggtctgactactctgtcacctaggctgaagtgcagtggttcaaacactgctcactgcagcctcccaagtagctggaattacagacatccactacacctggctaatttttaatttttaaaaattattattatttctgagatggagtcttgctgtgtcacccaggctggagtgcagtggcacaatctcagctcactgcagcctctgcctcctgggttcaagcaattctcctgcctcagcttccggagtagctggaactgccagtgtgtgccaccacactcgactggtttttgtatttttagtagagacggtatttctccatattggccaggctggtctcgaactcctggcctcaagtgatccgcccactttggcctcccaaagtactgggattataggcgtgagccacagcttccagcctgattgtttccattttaaaaaagagtaattgaagtaacctttgttaccaatgaaatgaattaaccttctagtatattaattctcacggtttaggttatttgaactaagctgagagaacagaataccaaagaagacaatagacttgcccagaaatatttagaagtaagtcactcagttgcctggattggaaccctcaggccagagaggttcaaaatcctgcatttttttttttttttttttttttttgagacagagtctcactctatcacccaagctggagtgcaatggtgcgatctcggctcactgcaacctccgcctcccgggtttaagcgattctcctgcgttagccttccgagtagctggaactacaggtgcgcgccaccacgcccagctaattttttttttttttttttttttttgagatggactctcgctctgtcgcccaggctggagtgcagtggtgcgatctcagctcactgcaagctccacctcctgggttcatgccgttctcctgcctcagcctcccgagtagctgggactacagatgcccgccgccatgcccgactaatttttttgtatttctagtagagatggggtttcaccgtgttagccaggatggtctcgatctcctgacctcgtgatccgcccacctcggcctcccaaagtgctgggattacaggcgtgagccaccgtgcccagcctaatttttgtatttttagtagaaacggggtttcaccatgttgaccaggatggtctcaatctcctgaccttgtgatccacccgcctcagcctcccaaagtgctgggattacaggcgtgagccaccactcctggccaatcctgctaattattaatatcagaactacttggttcaaaggagtggaaatagggcaacgaggggtgtaaatttgcagttaggtggaatgctgatagcaagttttccaggtaggagagttagttggggtgggggatgctaatgttagcttatctctgtatatatatttaattttatatgttatttatttttgagatgggatgtaactctgtagcccaggctggagtgcagtggcacaaacacagctcactgcagccttgaactcctgggctaaagggatcctcccacccacctcagtctccaaggtagctgggaccacaggcatgtgccaccatgctctgctaattttttcgggtttttttttttttttgagatctcttgctgtgttgcccaggctgatctcaaactcctggcctcaagtgatcctcttgccttggcctctcaaagtgctgagattataggcatgagccaccgtacccagcctatattttttttattgtgacatttaatgcacaaaagaagatatgcagcatcaatgcagataatggaacaaaacaaacactatccgccttaaaaacacaaatatttttggtacttttgtaccaatctgtatgctgtttctctatcttctacttcttctccctgtaccctcaccaggtaagtaaccccagagctgctggtacatttgtgtggattaaaaaagacacctggaaggggcagatacagccctgcttgacttcctgttttatcacgtgtttataaatctaaacaatgacatggaacttattatacaatattttaggcataaattaagaatgatttcgctcaccatcatagacctaccactcaatttgaagcatcaaacattactggtatggtgaggccctctggctgtccctccaacagaagttaccaccctcctcagttgggtttctcattcctatgcatttcttcttactacttatgtatgtatttccaagcaacacatagaattgctttgcatgctttttatcttcttaaaaattggttttatattgtatgcatggtgccacctgcttttaaggagaagcaacacgtttgtgaggccatctgtttatatgttgttctagggctttgctgtccattttggtagccactagccacagctggctgtttaaattaattaaaatcaaatcaaatcaaatatttagttcctcagtctcactggtcacatttcaagtggccagtaagcacatgtggccattggcatctgtattgcatagcacagattacattctgttccatcatcacagctagttctcttggacagccctgcagggcatttctttttggtttttgttttgtttttatttttgttttttgctagagtctttgttgtgtaaatacattactattttatatccatttttctatttataagcatttgggtatgctcataatttgctgttacaaattgtgctgcataagcattttgtttgtgtgtgtatagatgatctccttgggcaattgtgttaatttctcttgggtatatacctgggagtaaaattaagataagggcattttcagctttaccagaccccgttaagttactctcaagtggttttatcaatttatattctagaaccaacattatgtatcagtaacatttggtaacttcaggcgttttttttccattctgctgagtgtgaaaaatgtgttttgattatggttgtcatttgttagaatactttgttaaagctttttaaagattcttggtccctctaccctccccaccccctaccccaggaattttgattgggtaggacctggggattatattcatctttatatgcagaattatattacttgttactgttaggcctgatttaagaagtaaaataaggctgggtgcagtggctcatgcctgtaatcccagcactttgggaagccaaagtgggcacatcacttgagcccaggagtttgagaccagcctgggcaatgtggctaaaaccccttctctaccaaaaatacaaaaattagctgggcgtggtagcacgtgccagtggtctcagctactggggaagctgaggcgggaggattgcctgagcctggcaagtgtaggcagcagtgagctgagattgtgccactgtagtacatcctgggtgacagagcaacacactgtctcaaaaaaaaatttttttttaagtaaaataagttcataattccaaatgtggaaaatgcagaacaagttaatgaaatgttaatcctactaccaaatgataactataaccttcctttcagtatttttctatgtatatacaacaaaattggggcactgtttaatacagataatatatatagttagctctccttattaatgggcttcacattcatggattcaaccaactgtggatcaaaaatctttagtgtgcttggagtacatccaaaaaaaaaaaaagaaaattgaaattatgttaataataaaatatttgggaaaaaacattgcgtctatctgtaccaaacatgtacagactttttttcttgtcattattccctaagcaatacaatataacaactgtttacatagcaattccattaggtattataagtaatctagagatgatttaaagtatatgggaggccaggcgcagtgcctcacgcctgaaatcccagcactttgggaggccaaggcgggtggatcacttgaggtcaggagttggagaccagcctggccaacatggtgaaaccccatctctaacagaaatacaaaattagctgggcatggtggctcacacctgtaatcccagctactcaggaggctgaggcaggagaatcacttgaacttgggaggcagaggttgcagtgagccaagatcgcaccgttgcactccagcctgggcgacagagcaagactctatctcaaaaataaataaataaataaagtatatgggaggatgcacgtagagtatatgcaagtactgtgccatttatttatttagagacagagtcttgctttattgcccaggctggagcgcagtggcgtgatctccgtctcccaggttcaagtgatcctctggcctcagcctcccgagtagctgggattacaggcttgtgctaccacacccggctaagttttgtattttaagtagagggcgttttcaccttgttcgccaggctggtctcgaactcctgacctcaggtgatccgcccacatcggcctcccaaagttttgggattacaggcgtgagccattgcacctggcttgtatatgtgtatatatatgtacatggttttgtcttttgcttttttcactcaataagcattccccaaatctgctttggagcacatgattttattttatttttatttttttatttttttgagacgaagtctcgatctgtcgcccaggctggagtgcagtggcgcaatctcggctcactgcaagctctgcctcctgggttcacgccattctcctgcctcagcctcccgagtagctgggactacagacacccgccaccacacccggctaattttttgtatttttagtagagacgggtttcaccgtgttagctaggatggtctccatctgctgacctcgtgatccgcccgccttggcctcccaaagtgctgggattacaggcatgagccaccacgtctggcctggagcgcgtgattttaaatgtctgtgtcatttttcctcttcttgcctagccataatctattttaccagtcacctattgtattgaggttattgaggttattgcagtttcctactatgctaaatggctcctgacaacaaatttgatggttgatgggctatgtggagaattcacctttttttttttttttttttttttttttgagacagagtctttctctgtcacccaggcgggagtgcagtggcatgatctcagctcactgcaacctctgcctcccaggttcaagcgattctcctgcctcagcctcctgagtagatggaactacaggcacctgccaccacgcccagctaattttatttttgtatttttagtagagagggggtttcaccgtgttagccaggatggtctcgatctcctgacctcgtgatccgcctgcctcagcctcccaaagtgctgggattacaggcgtgagccacagtgcccggctaatttttgtatttttagtagagacggagtttcaccatattggccaggctggtctcgaactccagaccttgtgatccactcaccttggcctcccaaagtgctgggattacaggcatgagccaagtctttttttttttttttttttttttttgagacggagtcttgctctcttgcccaggctggagtacagtggtttgattgtgatctcggctcactgcaacctcagcctcctgggttcaagcgattctcctgtctcagcctcccaagtagctgggattacaggcacatgccaccatgtccggctaatttttatatttttagtggagacggggtttcaccatgttggccaggctggtctcgaactcctgacctcaggtggtctacccaccttggcctcccaaagtgctgggattataggtgtgagccaccgcacccggccttgttattagtcttaactagattgttgattgaagtccttaagcccagaaatgtatgtgaaggatggtggagaagagtggctcaggcattctaggcagaggtattcttgagctgaggaagtggaggagaggaggtatgtaagttacctgttttcaggggttcattccagtggatagtggatgccactccctggcagacactgtgggtgcctcacctgaaagactcctgattccctgaaggcattgtcgggtgtattttttctttataagcgtaatgccagtggagtgggtaagacaggtaccaccttttgcatctgctgctacagattaggcagcttggttaagttttgttttgtttttaattgttatgagttagtttgaaccaaaaggattgttaagtggagtgtaagaagcactgaataactactgttatctgagaggagtagtaaagaccagggccactgggcaatcccagaggcattaggaatttgtggcctttccctttagagcattgtcattatgtgtatctgcatctctgcattccaactttcacattttcagttcccaggagagagaatctgattggcctggttggggtcctgtgcccacttctggctgtcacctgtggctttcttccctcagttgtagaccacactctggatacctgggacccctgaaatctcctgcccagacaaccccaagcttctcaggactttttgtgggctgcttccctgttctgcctgtgcagtgcaggccttgtcacaatgtctgaatgcttaggccagagacgtgggggtttggtgagaaaggatgagctgggtagctacactcaagtgcagagccaccagtattgtgggacagagccaggcatgggaagagaagtgggcacggatgggggccagctttcccgatgtgccttaatctggcacagaactcctaaggagtgtgaaaatttcaaatttgatccaggccttccaggtggttatgaagaaggcgagtttgtcaagacaggataatacaatatacttcatttaatagcttgttagtgtgatttataactaaatatgtagacatcatatatgggtcttcattcatactcttgccccaggccctgaaagtgttagctaacaggcaagacctgcctgggactgagattctaaaacacaacctccacccccaactccgtttcatcatatagtagcctaacatattagttggttcgttgcttatagtcaggcaaacaacaaagactccgaattgagctcttggtaatttttgaaacctgcctggtaatactgtgtttcctcattctgatggcattcccagaccatattgcaaatgacttgatgtgtattttcagacttgttgagaagggcctggtggtctatatagcaggcataaaatgtcaccaggccgacttcatgacttatcttttgaggtcaaacagacccattgaccaaaagatttgagggcagtgaaaacatcttgtatactatctttaacaatggatttaactcctaaaggaaagccacctaaacatgactgtttaatcttcactagcaatttgaacttttttttttttgagacggcgtctcaccttgttgcccaggctggagtgtagtggtgtgaccttggctcgctgcaacctccacctcctgggtccaagtgattctgctccctcagcttcctgagcagctgggattacaggtgcctgccaccacacccagctaatttttttgtatttttagtagagacagggtttcaccgtgttggccaggctggtctccaattcctgacctctagtgatccacccgccttggcctcccaaaatgctaggattacaggtgtgagccaccacacccggcctgcgcccagataatttttgtattttttttttttttgagagtctcgctctgtcccccaggctggggtgtagtggcacgatgggttcacgccattctcctgcctcagcctcccgagtagctgggactgcaggtgcctgccaccacgcctggctaatttttttgtatttttagtagagacggagtttcgccatgttagccaggatggtctcgatctcctgaccttgtgatctgcccgccttggcctcccaaagtgctgggattacaggtgtgagccactgcgcccagccaacaatttgaacttttatctgtcaaatctatatgcatccttagcaagctttgtaaactgcctggtaactgatagatcttggttcacttagcttcccaaattatgctgttatcatcttgtctctctgttctttaaatatctggttgggagggtatggagagagagggaggaagaaagacacctctgtaagtttgaaattatttgcatcccccccaccgcccaccaccaacctttttaaaatatagagacacagagtctataccacgcctggcctaaaataattttttttagagacgggatctaacagtgttcccccagcttggctatcttaaacttcttaagggtagctagttctaagaactgcttttttctggctaggcacagtggctcacgcctataatcccaacactttgggagaccgaggcaggcagatcacctaaggtcaggagtttgagactagcctgggcaatatagtgaaatcctgtctctactaaaaatacaaaaattagctgggcgtggtggcatgcatctgtaatcccagctactgggggcgctgaggcacgagaattgcttgaacccaggacacggaggttgcagcgagctgagatcatgcactgcactccagcctgggtgacagagggggagactgtctggaaaaaaaaaatgtttaaaacaaaaaactgtttttttgtatgtgtgtttatatgcgaaccatttgtgaaagtggtcccagcatgatgccacatgtgtcatttccaaatatttcagtctgtatttttttctctctctctctgttttttctgtcacccaggctggagtgcagtggtacgatctggctcactgcagcctcgacctcctgtgctaaaacagttctcttgcctcagcctcctgtgaagctggtaccacaggtgcatgccactgcacccagctaacttgtagagattggggtctcactttgttgcccaggctgttatttgactcctggactcaggtgatcatgccactttggcctgccagagtgctgagattacaaaagtgagccaccacactcagccataaatgtgttgttgttgttgtttttgagacagagtttcgctcttgttgctgaggctggagtgcaatggcgcgatctcagctcactgcaacctcccccctcctaggttcaagcgattctcctgcctcagcctcccaggtagttgggattacaggtgcctgccaccacgtccaactaatttttgtatttttaatagagacggggtttcactatgttggtcaggctggtcttgaactcctgacctcaggcgatccacccgcctcggcctcccaaagtgctaggatcacaggcgtgagccactgtgcctggacttgtaaatggtatttcaaagtaaaatatatgtcattgcatttatcaagataatttgattgagctttgtaggtcctagccatccttctgcctattactgggctttttgcaaatgctgttcctgtttccacaacctggagcattgtcccatcccttttattgtttctcttgctgttatttattatgtcatccatcatcattataccattcctctgccaagaaacatttaatttttgtttttgtttactattacaaaaatgttttatagaatattgttagacttacattcttgcccctcattgtggaagtattcctgtagtatgaatacagccagaggttttttagttttgttttggtttttttgaggagtcttactccttcatccagaggctggagtgcagtgacgcgatcttggctcgctgcaaactccacctcctgggttcaagcgattctcctgcctcagcctcccaagtatctgggactacaggcggccgccagcatgcctagctaatttttgtatatttgtagagacgggggtttcaccatgttggccaggctggtctcgaactcctgacctcatgtgatccgcctgcctcggtctccaaagtgttgggattacaggtgtgacccaccgcgcctggcccagtgagagttaaagggccagagtggaagcaggtctttggaagcttggctctgtcttccttcagtgcagggagtttgtgttgtccatccccagcctctacagaagcacacagtgagtgttcaataagcatttcttggatcaaatggcccctgcttcttttaatggtcagtaaactttaaataatgagatttttctgcaatagagaagagcaactgccttgtgattggaagccagcatatgttattcctaagcagttctgccttttttccacagaaggtggtcttctgccctgttaaagaagccctggaggtggactggagcagtgagaaagcaaaggctgctctgaagcgcacgacctccgactactttctccttcaaggtgaggtctcaaagcacaacttaccccgggagagcttttggctctgatttctgcaaatgtggttgcaaggtccagatggttttgtgatgtttgccttgggtggcattcttcattggctagttctcagtgatcacttgagaaaggggtggtcacttgaagggggtgaggtctaccattgagctctgggttctaatgacttctcctttttttacttgttgaaatgacctccctgtcaagttgaccttatggtaatagtgttacaggtcacagattgagaaacctctttttttttcttttttctttttttgagacagagtcttgctctgtcacccagactggagtgcagtggggtgcaatcttggctcactgcaacctccacctcctgggttgaagcgattctggtgtcttagtgtccccagaagctgggatgacaggcatgcaccactgcgcccggctaatttttgtattttgagtagagatggggtttcaccatgatgcccaggccctgaagttctgagattataggcatgagccaccatgtgaagcctgatcaaccaacttctcttcaccgccccccgcctttttttttttttttttttttgagacagagtcttgctctgtcacccaggctggaatgcagtagcgctatcatggttcactgtagcctctacttcctgggcttaagtgctccccatgcctcaggctcctgagtagctggtactacaagcacacgccactgtgcccagctagtttttgtatttttttgtagaagcgaagtttctccatgtagccaggctggacttgaactcctgagctctagtgaaatccccgcgttggccttccaaagtgctggagttaaaggcgtaagccaccagtgcttgttcccctcttcagaattctttctctgcctcaaaaccatcctcacgcttatgaaaggtggggttgtttttcctcttgctatt

SEQ ID NO: 660 - DNA, 4173 bp, Homo sapiens
ctagggaaaaaaacttctggaattagggtttgcttcacccacaactacgaagactggggtggggggcgagtctcagcacactggactcccttggggcagggctgaggtgcagcccagacagcaaaggccgccgcgggtcctcggtcgcatccctcccttcagcctcctgcactcagccaagcctctgctccccaccccttacctacccgagtggaagccaagcttcggttttccggcctgtaaaatggtatcatagctcccatctcgccccctgcgctgggagaaatgggcgtcttgtcttcgctgcgcattgcatgcggaggagcagatgtctcagcccaggccctagccttgcatcgagccctgaggaatcagaccctgcgacccctagccgcgcctcaccttcctgatccacgcaagggagctcccagtcaggcctcctatcgcgcgggtgtggaggtgcggccggcagggggagcgaggaggaagggaaccgcggccgggccaggtgagggagggaggaacacttgccgcgggccgtgctgaggcgctgcgttcgcgtgcggaacccgcgtgtgccgggctagggccatccgacgggcgcgctccctccgggctgcgggagggcacgacgggtggggtggcggcaggtgaagaggagtgtgggcgggtggcggggtggcggggcggcggagcgcggcggggcggtgccctaggcgggagggagggtcggaggagccctatcctgctgcgcgatggaggcggtggaggcggcggctccggctggaggctgggacggcctcgcgcttcgagggcttccgggcccctttagccgagggctcctggagggtcccagcgttgagcaacggggtccgggggtccgaaatcaagcgagtgagtataggcagccggtggggtagggtcggccaacagagccggctgggtggggcccctcacctcttcccgtcgcccttctggttgaccagggtttcctccaccctgacggcctcttctctgctgtggcaagctggccgcccctgcctgcctgcaggtcctgctcaggcacgaaggggttaatgggggctggaagggctctgctcctccctacaaacctcaggcacagaggtctggggacctctggaccgatccttgagcggctgacccagagtctccaggaggccccagggtttttcactttcacttctccctcctcaatgttggcctcacccacaggccccacatctggccagtgccctgaggtgtgtgcagatgtacacaggacacaagcttgggcataccctcaggctggggcacatgcaggagccccacccccatgcccccaccgactggcccaggcctctctgggtgcagactgccaacacaggcacgtctcctgcaacactaccaaatctgcggccaccagcatccctaccacccgcctccacgggactgtccttcctgcaggagcagctcctggggacaatggctggtcctgctcagagaggaaggaaaggggcctggaaccagctggtccatccccacacagcactcctcactggacttgtccctgggtcccctcagtgacactgagagacataagtcattgtcactgtcatggcccagaatgactactcagggcaagaaaaatgcactaaggacagcttcccttttctgacatggcccacaaagctccagctgcaggcggcaggggttgtggggggcaggacatgaggcaccccatacaggcagcaacacacaccacatcccagacaggcagcactattcgtatactcacccactgcggccctggactcacatgcgttcctgaacctcaggcccagggccagcctccccactggcgcccagccccccagcccgttactgggccttcccagttcccagccagcatcctctccagcccagggtctgaggtcctgagatcctaaaaaccctgggagaggttgcctgcctcccactcccatcctgagcatgcacaagcgaaggctgcaatgaggttgtatacagagaggccttgcaaacagtggccctgaccaccagcaccagggaggctccagcaaggcacagaggctccagcaaggcacagaggcacagagctgaggttgacacccagctggagaggccctgtacaggaaagccatgggtgcgctgaactggttagaggagaccctggagacagtaggtggggaaacgcacaggccaagtcaggccttggcgtctgggatgcctgggcctagaaaccaggcagagcggcgggcctcggcctcactctgcccagcctggtcgggccatagagcttctcccggcaggcaggctggctgctgggtgccggggggcagcatacgacccagtggcctgaagttctccaacatgtcctcgtgtcctcggctccctcggctggccaggctccgcccccggccctccctgcgcccggccggtgcgcagggaggtcggaggagcgggcactgcccaccctccggatgtataagcgtcctggccagaggcgggcggtgcgcgcaagtgcgcgtgacgctcgggctcgcgggctgcgcagcctgggcagcgtccctctgctggggtctccagcgacgatagtgagccaacttcagggggctgttgggcatttactgggctgggtcctgtcctgctgcgccaaggaacagaggacgctgcggccctggggctcctgtcagtggccggtgcgagagcccaagctgccctctcctcacccaggtgcaggggcagccagggaggaggtggaggcgggaggggccaagggcaggggcagggctgggctccggcagccactcgctgcttcatgggtgccctgccacctcgggctagggctgggtgctgctggcatagacacctctcctcggggggctgtagaagctgacggtggcttcgctgcacagagaaaggccgtgccttggcaggagcaacgggatgttcaaggggcgttggtcatggaggtccctgggaatggaggaagggggcagggagcttggaaagcaagagggccctgcacttccagggtgctccacccgtctgggcccctcggctgctaccagccccaagtggggggcccatgacgccataatcctctgggccaggggcccctggcagtgagtggcaccacaggcccccgcccccggactccgtgggctgggctgggctgggcgcggtgcggctgggcacacgcagtcggaggcggcgccggccaggccgccgggcgcctatggacgcgcggagcccgctgtctccccgagccagtgcgttcagcatcgcctctctggttgcagcggaggcggcggagcgcaccgcccaccagggctcagggtcctccgaccgggtgaagcttcgctggctgccaggatccccggcagggatgcacttcagcaccgtcaccagggacatggaaggtgagcctccaggccgtgtctacactggcccgcccgccagaccccctgcctcagctgctgtggggcccgggtgcaaagtaggtggaggcagctcttggtagcgtgggctccaggcttctggctgcgattctggggcagagaggaagagccggcatcccgcccacagcctgtcccctcaccagcctgggggcccagcttggagatgggcactcaggtatacacaggcccggaagagggcgagtgaggctgggaaggagagcagaggtggccgtgagcctggagaggggggaggaaagttaataagagaggagagagcgggagagtttcacagaaggagagaaagcctcgaggaagccgtggagacgaaattgagcaaaggggagaaaacacaaaaaacccaaagaagaaggtaggggagaaacagaaggacacgaaaaggcaataaaaagcaagagcgaaagagaagagagaaaacgaagggaaaatttaagacagaaagcgaagtcataaaaaagaaaaaaaggaaagactttagtttttttttttttaaaaagaaaaacataaaaaacaaaggacatacaaaaataagaggaaaggcaccgactaaaagaaagacaaagaatgattaaaaataaagtgaaaaggaaggcgaggatggaggaaaaggggaagaggcggaaagtaaaacagaaataaagagaaactacagagataggggaagaaaaaagatgat

SEQ ID NO: 661 - DNA, 163709 bp, Homo sapiens
aaaatgaggtgagatcgttatcacaagtccaagtttgaatttgaattaagtttccccatcccatcactcaggaactgatatggttttctttctaggtgtgtatatagggtgaaaacagcaggaaagggtggaaaaatcaaataagagtaataaaagaaatccaaataaaaaaaagaaagtaaaattatctctcttcactgacaatataattctatacctagaaaacccaaaatattttgccaaacattcctatatcttatgaatgacttcaccaaatctctgggtataaaataaacattaaaaaatcggtagcatttttctataccaataacattcaagctggttaccatatcaagaatgtaattccatgtaaaatacctaggaatgcatctgaccaaagaggttaaacatctgtataggaagaactataaaacacagctgaaagaaatcacacatgatacaaagaaatggaaaagcatgtcaggcttatggattggaagaatcaatatcatgaaaatgttcatattacacaaagcaagctacaaattcaatatgagttctatcaaattatgtcaattattcacaaaataaaaaaatctaaaattaatacagaagcaaaaacaagcctgaatagcttaggcaatcataagcaaaaagagtaaagccagaggcatcaacttcaaactgtactacaagggtacagtaatatatatatatatatgtgtgtgtgtatatatatatgtgtgtgtgtatatatatatatggacacagaggtcaatggaagggaattcatacctctgaaataaagtcatacacctacaaccaactgatctttgacaaagttggcaaaagtaaacaatggggaaagaaaatcctattcaataaatggttctgggaaaaatggctaaccaaatgcagaagaatgaaaccgaatccctccctctcacaatatacaagaattaacaaaagatgaattaaagacttaaatgtaagtcttcaatctataaaaattctagaataaaatataggaaatactcttctagacattggtctaagtaatgaatttacaatgaagacaacaaaagcaaatgcagctaaataaaaaatacacaaacaggactttattaaactaaagagcttctgctcagcaaaagaaacaactaatgtgataagcaaaaaacctacagattaggggaatatatttgcaaactatgcatttgacaaaagactaatatccagaatctataaggaacttaaatcagaaagaaaaagcaaatacctcttttaaaaagtgggcaatgaagatgaatagagacttctttttctctcaggttctctgtaaactttattagatgctctttttattatcatccattatgaaaaaattcaaatgaaaacagtacagagaatactataaagaactaataacccaatttcaaaaattaccaacatacaacccattttgttccaacaatatttcttatgctcctctcccactatagatactgaagcagacatcagatggtatattattttatctgttaaaattcagatagtcctttctgtgaaaaataaggactatttttgacttcatcattcctctcaatttaacaatcattccttaatatcaccaactatccatttagagcctacatttctctgattatctcataaatatctgcttacagttggtatcatttgaaaaattaattaacatttaaaatatgttaacagcatacaagtgcaagttccttacattcatatattgtgtagtgatgaagtatgggcttttagtgtatccatcacctcaatactgagcactgtatccaatgggtaaagtttaacccccacttataagtgagaacatgcagtatttgactgtttgtttctgagttaattcactgaggataatggcctctagtgccatcaattggtatcattttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaattggtatcattttgaatcatgtcctaaacaagatccgtattgcttagtatgctttttcatagacctaaagagcacattatgacttttttaactttaaaaatgttatgcgtgatagcaatataggccttaaagtgtaagattaaatatataatagtgcaagggcatattaatcaaatagtaaaagcagtgaaaattactaaaatgtttggagtgcaaggaacttttttatgtacattatctcatttaaatctttttttattattttaagtactgggatacatgtacagaatgtgcaagtttactacataggtatacatgtgccatggtggtttcctgcacctatcaacccatcatccagggtttaatccctgcatgcattaggtatttttcctaatgctctccctccccttgcctcgcaccccctgacaggagtgtgtgatgttcccctccctgtgtccatgtgttctcattgttcatctcccacttataagtgagaacatgcggtgtttgattttctgttcctgtgttagtctgctgagaatgatactttccagcttcatccatgatgatgcaaaagacatgaactcattcttctttatggctgggtagcattccatggtgtatatgtatcacattttctttatccagtacatcatcgatgggcatttgggttggttccaagtctttgctattgtaaatactgctgcaataaacatatgtgtgcatgtgtataatgatttataatcctttgggtatataccgagtaatgggattgctgagtcaagtagtatttctgcttctgtatccttgaggaaacaccacactgtcttccacaatggttgaactaacttacacttccaccaacagtgtaaaagtgttcctatttctccacagcctcaacagcatctgttgttttttgagtttttaataattgccattctaatgggcatgaaatggtatctcattgtggttttgatttgcatttctctaatgaacagtgatgatgagctttatttcatatgtttgttggctgcataagtgccttcttttgagaagtgtctgttcatatcattcacccaaattttgatggtttttttcttgtaaatttgattaagttccttgtagattctggatattagacctttattacatgggtagattgcaaaaattttctcccattctgtaaatttcctgttcacgctaatgatagtttattttgctgatcacaagctctttagtttgattagatccccttcatcaattttggctttagttgcaattgcttttggtgttttatttaagaagtctttgcacatgcctgtgtcctgaatggtattgtctaggttttcttctagggtttttatcattttagatttttacatttaagtctttaatccatcttgagttaatttttgcataaggtgtaaagaaggggtccagtttcagttttctgcatatggctagccagttttcccagcaccatttattaaatagggaatccctttcccattccttcttttggtcaggtttgtcaaagaccagatgattgtagatgtgtggtgttatttctgaggtctctgttctgttccattggtcagtatatctattttggtaatagtaacatgttgccttggttactgtagccttgtagcatattttgaagtcaggtggcatgttgcttccagctttgttctttttgcttagggtagtcttggctatacgggctcttttttggttccatatgaaatttgaagtaattttttctagttctgcaaagaaagccaatggcagcttaatgggaatagcattgaatctataaattactctgggcaatatggccattttcacgatattttttcctcctatccatgagcatggagtttttttctatttgtttgtgtcttctcttatttccttggacagtggtttgtgttctccttgaagaagtccaggtcccttttaagttgtattcctaggtattttattctctttgtagcaattgtgaatgggagttcactcatgatttggctctctggttgtctattgttggggtataaaaatgcttgtgatttttgcattgattttgtatcctgagactttgctgaagatgcctagcagcttaaggagtctttggtctgagatgatggggttttctaaatgtgcaatcatgtcatctgcaaacagaaaatttactttctgtcttcctatttaaatacactttatttctttctcttgcctgattgccctggctggaacttctaatactatgttgaataggagtggtgagagagggcatctttgtcttgtgccagttttcaaagggaatgcttccagcttttgcccattcagtatgatattggctatggttttgtcataaatagctcttactattttgagatatgttccaaatagacgcttttttataaaagacatttgtggctgggcatggtggctcatgcttgtaatcccagcactttgggaggtgtaggttggcagatcatttgagtgcaggagtttgagagaagcctggctaacatagcaaaactctatctctactaagaatacaaaaaaaaaaaaaatagcttgacatggtggcacatgcctgtaatcccagttactgaggaggctaagaaatgagaattatttaaacctgggtgacagaggatgcagtgagctgaagtcacatcatttcactccagtcttggtgtcatttctgtctcaaataaataaataaaaataaagaagacatgtaagtggccaaaaaacatgaaaaaattcttcacatcactaatcattagagacctgcaaataaaaccacaattagataccatctcacaacagtcagaatgagtagtattaaaaaataaaaataaaaaaagtcactggcaagacggctgaataggaatagctctggtctgcagctcccagtgagatcaacacagaaggtgggtgatttctgcatttccaactgtggttcccagatcatctcattgggactggttggacagtgggtgcagcccatggtgggtgagcagggtggggtgttgcctcacctgggaaatgcaaggagtcaggggatctaactcccccagccaagggatgccatgagagactgtattgggaggaacggtgcactcccgcccagataccgcatttttcccatggtcttcacaaccagcagaccaggagattctctccggtgcctatgtcacaagggccctgggttccaagcacaaaactgggcagccatttgggcagacactgagctagctgcatgagttttgtttttcttttctccatacaccagtggcacctggaacaccagtgagagagaaccattcactcccctggaaagggggctgaagccagggagccaagtggtctggctcaacaggtcccacctccacagagtccaagctaagatccactggcttgaaattcttgctgctagtacagcagtctgaggtcaatctgggatgctggagcttggtggggggagggccatttgccattgctgaggcttgagtaggcagttttacccttacagtgtaaacacagctgccaggaagtttgaaattggcagaacccaccacagctaaacaaggccattgcagccagactgcctctctagaatcctcctctctgggcagggaatctctgaaaaaaaggcagcagccccagtcaggaacttgcagataaaccccctatctccctgagacagagcacctgggaaaaggggcagctgtgggcacacctttagcagacttaagtgtccctgcctgatgtctctgaagacagcagcggatctcccagcacagtctttgagctccaataagggacagactgcctcctcaagatggtccctgacctcatgcatcctggctgggagacacctcccagtaggggtggacaaacacctcatagaggagagctctggctggcatctggcaggtgcccctctggaatgaaacttccagaggaaggaacaggcagtaatcttttctgttgtgcacctcccctggtgatacccaggcaaacagtcaggagtggacctgcaacaaactccagcagatctgcagcagaggtgcctgactattagaaggaaaactaacaaacagaaaggaatagtatcaaagtcaagaaaaaggacatctactcagagaccccatccgaaggtcatcaacatcaaagaccaaaagaatagtatcaacatcaacaaaaagtacatccacacagaaaccctatcctaaggtcatcaacatcaaagaccaaaggtagataaatccacaaagatggggagaaaccagcgcaaaaaggctgaaaattccaaaaaccagaactcctcttctcctccaaaggatcacaactcctcaccagcaagggaacaaaactggacagagaatgagtttgaagaattgacagaagtaggcttcagaaggtgggtaataacaaactccttcaagctaaaggagcatgttctaaccaaatgcaaggaagctaagaaccttgaaaaaatgttagaggaattgctaactagaataaccagtttggagaagaacataaatgacctgatgaagtgaaaaacacagcacgagaacttcatgagtcatacacaagtatcaatatacaaatcgaccaagcagaagaaaggatactagagattgaagattaactcaatgaaataaatcgagaagacaagattagaagaaaaagagtgaaaagaaacatacaaagcctccaaaaaatatggaactatgtgaaaagatcaaatctatgtttgactggtgtacctgaaagtgatggggagaattgaaccaagttagaaaacgctcttcaggatattatccaagagaactcccccaatttatcaaggcaggccaacattcaaaatcaagaaatatcaagaacaccacaaagatactcctcgagaagagcaaccccaagacatataatcaacagattcaccaagtctgaaatgaaggaataaattttaagagcagccagagagaaaggtcgggttatccacaaagggaagctcatcagactaacagtggatctcttggcagaaaccctacaagccagaagagagtggaggccaatatttaacattcttgaggaaaagaattttcaacccagaatttcatgtccagacaaactaagcttcataagtgaaggagaaatgaaattatttacagacaggcaaatgctgagggattttgttaccaccaggcctgccttaaaagagtgcctgaaggaagcactaaacatgaaaaggaaaaaccagtagcagccactgcaataacataccacaataaaagaccaacaacactgtgaagaaactgcatcaactaatgtgcaaaataaccagctagcatcatgatgacaggatcaaattcacacataacaatattaaccttaaatgtaaatggcctaaatgtccccaattaaaagagacagaccaacaaattggataaagagtcaagacacttcggtgtgctgtattcaggaggcccatctcacatgcaaagacacacataggctcaaaataaagggatggaggaatatttacaaagcaaatggaaagaaaaaaaagcagaggttgcaatccaagtctccgataaaaaaagactttaaaccaacaaaaatcaaaagaaacaaagaagagcattacataacggtaaacagatcaatgcaacaagaagagctatctatcctaaatatatatgcacccaatacaggagcacctagattcataaagcaagtttttagagacctacgaggagacttagactcccacacaataataatgggagacttaaacactccactatcaatattagacagatcaatgagagagaaaattaacaaggatatccagaacttgaactcagctctggaccaagaagacctaatagacatctacagaactctccaccccgaatcaacataatatacattcttctcagcaccacatcccacttattctaaaattgaccacataattggaagtaaaacactcctcagcaaatgcaaaagaacggaaatcataaaaaatagaatctcagaccacagagcaatcaaattagaactcaggattaagaaactcactcaaaactgctcaactacatggaaactgaacaacctgttcctgaatgattactggataaataatgaaattaagggagaaataaagacattttttgaaaccaatgagaacaaagacacaatgtatcagaatctcttaaacacatttaaagcagtgtgtagagggaaatttatagcactaaatgcccacaagagaaagcaggaaagatctaaactcaacaacctaacatcacaataaaaaagaactagagaagcaagagcaaaaaattcaaacgctagcagaagacaaggaataactaagatcagagcagaactgaaggagatacagacacgaaaaacccttcaaaaaaatcaatgaatctaggagctggttttttgaaaagatcaacaaaatagatagaccactaaccagactaataaagaagaaaagagagaaaaagcaaatagatgcaaaaaatgataaaggggatatcaccaccgaatccacagaaatacaaactaccatcagagaatattataaacacctctatgcaaataaatttgaaaatctagaagaaatggataaattcctggacacatactccctcccaagactaaaccaggaaaaagttaaatccctgaatagaccaataacacgttctgaaattgaggcagtaattaataccctaccaaccaaaaaaaaagtccagaaccagatggattcacggcctaatttcatcagaagaacaaaaaggagctggtaccattccttctgaaactattccaaacaatacaaaaagggaatcctccctaactcgttttgtgaggacagcattatcctgataccaaaatctgacagagatatgaccaaaaaagaaaatttcaggccaatatccctgatgaacatagatgcaaaaatcctcaataaaatactggcaaaccaaatttagcatcacatcaaaaagattacccaccacgatcaagtcagcttcacctctgggatgcaaggctggttcaacatacgcaaatcaataaacgtaatccattgaataaacagaatcaattacaaaaaaacacatgattatctcaatagatgcagaaaaggtcttcaacaagattcaaaagcccttcttgctaaaaactctcagtaaactaggtatggatggaatgtttctcaaaataataagagctattaatgacaaacacactgtcaatatcatgctgaatgggcaaaaactggaagcattccctttgaaaaccaacacaagacaaggatgccctttctcacctctcctattcaacatagaattggaagttctggcaagggcaatcagtcaagagaaagaaataaagggtattaaattaagaggatgtcaaattgtctctgattgcagatgacatgattgtatatttagaaatccccatcgtctcagcccaaaatctccttaagctgataagcaaatgaagcaaagtctcaggatacaaaatcaatgtgcaaaaatcacacgcatttctttacacaaataacagacaaacagagagccaaatcatgagtgaactcccatttgcaattgctactaggagaataaaatggaatataacttagaagggatgtgaagtacctcttcaaggagaactacaaaccactgctcaacaaaataagagaggacacaaacaaatggaaaaacattccatgctcgtggataggaagaatcagtgttgtgaatatggccatactccccaaagtaattcatagatccaatgttattcccatcaagctaccattgactttcttcacagaattggaaaaaacatactttaaatttcacatggaaccaaaaaggaggccacatagccaagacaatcctaagcaaaaagaacaaagctagaggcatcacgctacctgacttcaacctatactagaagcctacagtaacaaaaacaatatggtactggtaacaaaacagatatatagaccaatgaaaaagaacagaggcctcagaaataacaccacacatctacaaccatctgatctttgataaacttgacaaaaacaagcaatgggaaaggattccttatttaataaaatggtgttgggaaaacaggctagccatatgcagaaagatgaaactggatccctcccttacaccttatacaaaaattaactaaaaatgtataaagacttaaacgaaagaccctaaaacataaaaaccctaaaagaaaaccaaggcgataccattcagaacataggcatgggcacagacttcacgactcaaacacaaaaagcaatggcaacaaaagccaaaattgacaaatgcgatttaatcaaacaaaagagcttctgcacagcaaaagaaactaccatcagagtgaacagacaacctacagaatgggagaaaatttttgcaatctatccatctgatgaagggctaatatccagaatctacaaaaacttaaacaaatttacaagaaaaaaaaagaaccccatcaaaaagtggacaaagtattttaccagacagttctcaaaagaagacatttatgcagccaacaaacatatgaataaaagctcatcatcactggtcattagagaaatgcaaatcaaaccacaatgagatgccatctcatgccagttggaatggcaattattaaaaagtcaggaaacaacagactctggagagggtgtggagaaataggtacgcttttacactgtcggtgggaatgtaaattagttcaaccattgcggaaaacggtgtggtgattcctcaaggatttagaactagaaataccaattgacccagccattccattactgggaatatacccaatgtattataaatcattctactgtaaagacacacgcacacatatgtttattgagacactgttcacaatagcaaagacatagaaccaaaccaaatgtccatcagtgatagactgtataaagaaaatgtggcacatatacactatggaatactaagcagccataaaaaaggatgagttcatgtcctttgcagggacatgaatgaagatgtaaatcatcatcatcattctcagcaaacacagaaaaagaaaaccaaacacctcatgttttatatatatatacatatatatatatatatatgtatatatatatgtatatatatatatatttatatttatatatttatatatatatatatttatttatatttatatatttatatatatattattttttattatactttaagttttagggtacatgtgcacattgtgcaggttagttacatatgtatacatgtgccatgctggtgtgctgcacccactaactcgtcatctagcattaggtatatctcccaatgctattcctccaccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccatattttcttaatccagtctatcattgttggacatttgggttggttccaagtctttactcttgtgaataatgccacaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgttttttcttgtaaatttgtttgagttcattgtagattctggatatcagccctttgtcagatgagtaggttgtgaaaattttctctcattttgtaggttgcctgttcactcgatggtactttcctttgctgtacagaagctctttagtttaattagatcccatttgtcaaatttggcttttgttgccattgcttttgttgttttagacatgaagtccttgcccatgcctatgtcctgaatggtaatgcctgggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgcagatatgctgcgttatttctgagggctctgttctgttccattgatctatatctctgttttgataccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctgcccatgagcatggaatgttcttccatttctttgtatcctcttttatttccctgagcagtggtttgtagttctctaactctttttatgaggccagcatcattctgataccaaagccaggcagagacacaacaaaaaaagagaattttagaccaatatccttgatgaacattgatgcaaaaatcctcaataaaatactggcaaaacgaatccagcagcacatcaaaaagcttatccaccataatcaagtgggcttcatccctaggatgcaaggttggttcaatatacgcaaatcaataaatgtaatccagaatataaacagagccaaacacaaaaaccacatgattacctcaatagatgcagaaaaagcctttgacaaaattcaataactcttcatgctaaaaactctcaataaattaggtattgatgggacgtatttcaaaataataagagctatctatgacaaaccgacagccaatatcatactgaatgggcaaaaactggaagcattccctttgaaaactggcacaagacagggatgccgtctctcaccactcctattcaacatggtgttggaagttctggccagggcaattaggcaggagaaggaaataaagggtattcaattaggaaaagaagaagtcaaattgtccctgtttgcagacgacatgattgtatatctagaaaaccacattgtctcagcccaaaatctccttaagctgataagcaacttcagcaaagtctcaggatacaaaatcaatgtacaaaaatcacaaacattcttatacaccaacaacagacaaacagagagccaaatcatgaatgaactcccattcataattgcttcaaagtgaataaaatacctaggaatccaacttacaaggcatgttcttactcataaatgggagttgaacaatgagaacacatggacacggggtggggggcatcacacaccaggtactgttggggagtggggggtgggggctggatagcatcaggagaaatacctaatgcagatgatgggttgatgggtgcagcaaaccaccatggcacgtgtatacctatgtcacaaacctgcatgttctgcacaggtaccccaggacttaaataaaaaataaaaagcaggtgttaccgaggctgcaaaaaaaagggggggtatatttatatactgttggtgggaatgcaaattagttcagtcactgtggaaagcagtttgtagatttctcaaagaatttaaaacagaactaccatttaacccagcaatcctcttactgtgtatatatccaaaagaaaataaatcattctaccaaaaagacatctgcatttgtatgttcattgcagccctgttcaaaatagcaaagacagggaatcaacctaggtgcccatcaactatcaactggataaaggaaatgtgttacatacacaccatgacgtgttacacaggcttaaaaaaagaataaatttatgtttttttttgcagcgacatggatgcagctgaaagcaattgttataagcaaattaatgcagggatggaaaaacagatgccacatgttctctcttataagtggaagctaacaaccaggtaagtacggtaacaaagatgggaatggtagacactagcgactctcaaagaagggaaggggaaacagacagtgattgaaaaacaacctatcaagtactgtgttcaccccttgggaaataaaatcattagaagtccaaacctcagtatcacaccatatactcatgtaactaacctgtgcatgtatttcctgaatctaaaatttgaaaaaataaataaataaaatattttaaaactgtatttgttttaaatgtacagtgtaatttatatatatatatatacacattgtgaatttataaccacaaccaagctaattaacatatatattatctcagttacctttttgtgataaggacatttaagatctattctcagcaaattgaagtataccaaatagtattatcaactacagttgctatactgtacattacatctacaacttattcactcttcatatctaaaactctgtacccttctccaacttttccccattttcctaaccctcagcccatggaagctacctttctactgtttctgtgtgcttgactattttagtttccccatataaatgagatcatacaacatgtatctttctgtttctgtcttatatcacttaacataatgtcttccaggtttttccacgttggtgaaaatgacatgacttctgtcttttgtaagtctgaataatatttctttattttattttattattactatactttaagttttagggtacatgagcacaatggacaggtttgttatatatgtatacatgtgccatgttggtgtgctgcacccattaattcatcacttagcattaggtatatctcctaatgctatccatcccccctccccacaccccacagcagtcccctgtgtgtgatgttccccttcctgtgtccatgtgttctcattgttcaattcccacctatgggtgagaacatgcagtgtttggttttttgtccttgtgatagtttgctgagaatgatggtttccagcttcatccatgtccctacaaaggacatgaactcatcatgtttatggctgcatagtattccatggtgcatatgtgccatattttcttaatccagtctattattgttggacatttgggttggttccaagtctttctattgtgaatagtgctgcactaaacatacatgtgcatgtgtctttatagcagcatgatttataatcctttgggtatatacccagtaatgggatggctgggtcaaatggtatttctagttctagatccctgaggaatcgccacactgacttccacaatggttcaactagtttagggtcccaccaacagtgtaaaagtgttcctatttctccacatcctctccagcacctgttgtttcctgactttttaatgatcgtcattctaactggtgtgagacggtatctcattgtcgttttgatttgcatttctctgatggccagtgatgatggggattttttcctgtgtgtttcagctgcataaatgtcttcttttgagaagtgtctgttcatatccttcacccactttttcatggggtttgatttttcttgtaaatttatttgagttcattgtagattctggatattagctctttatcagatgagtaggttgcaaaaattttctcccattctgtaggttgcctgttcactctgatggtattttgttttgctgtgcagaagctctttagtttaattagttcccatttgtcaattttggcttttgttgccattgctttttgtgttttagacatgaagtccttgcccatgcctatgatctcaatggcattccctaggttttcttctatggttttaggtctaacgtctaagtctttaatccatcttgaattaatttttgtataaggtgtaaggaagggatccagtttcagttttctacatatggctagccagttttcccagcaccatttattaaatagggaaacctttccccattgattgtttttgtcaggtttgtcaaagatcagatagttgtagatatgcagcattatttcagagggctctgttctgttccattggtctatatctctgttttggtaccagtaccatgctgttttggttactgtagccttgtagtatagtttgaggtcaggtagcatgatgcctccagcttgttctcttggcttaggattgacttggcaatgtgggctcttttttgattccatatgaactttaaagtagttttttccaattctgtgaagaaagtcattggtagcttgatagggatggcattgaatctataaattaccttgggcagtatagccattttcacgatgttgattcttcctacccatgagcatggaatgttcttccatttgtttgtatcctcttttatttcattgagcagtggtttttagttctccttgaagaggtccttcacatatcttgtaagttggattcctaggtattttattctctttggagcaattgtgaatgggagttcactcatgatttggctctctgattgtctgttattggtgtataagaatgcttgtgatttttgcacattgattttgtatcctgagactttgctgaagttgcctatcagcttaaggagattttgggctgagacgatggggttttctagatatacaatcatgtcatctgcaaacagggacaatttgacttcgtcttttcctaattgaatgccttttatttccttctcctgcctgattgccctggccagaacttccaacactatgttgaataggagtggggagagagggcatccttgtcttgtgccagttttcaaagggaatgcttccagttttggtccactcagtatgatattggctgtgggtttgtcatagatagctctgattatttttgagataagccccaccaatatctaatttattgagagtttttagcgtgaaaggttgtaaataaagatgttctttgaaaccaacgagaacacatacacaacatactagaatctctgggacacatttaaagcagtgtgtagagggaagtttacagcactaaatgcccacaagagaaagcaggaaagatctaaaattgacaccctaatatcacaattaaaaggactagagaagcaagataaaacattcaaaagctagcagaagacaagaaataattaggatcagagcagaactgaaggaaatagagacacaaaaatcccttcagaaaatcgatgaatccaggaactggctttttgaaaagatcaacaaaattgatagactgctagcaagactaataaagaagaaaagagagaagaatcaaatagatgcaataaaaatgataaaggggatatcaccaccgatcccacagaaatacaaactaccatcagagaatactataaacacctctacacaaataaactagaaaatctagaagaaatggataaattcctcgatacatacaccctcccaagactaaaccaggaagaagttgaatctctgaatagaccaataacagtttcttaaattgaggcaataattaatagcttaccagccaaaaaaagtccaggaccagatggattcacagccgaattctaccagaggtacaaggaggagatggtaccattccttctgaaactattccaatcaatagaaaaagagggaatcctccctaactcactttatgaggccagcatcatcctgatatcaaagcctggaagagatacaacaaaaaaaagagaattttacaccaatatccctgatgaacatcgatgcaaaaatcctcaataaaatactggcaaaccgaatccagcagcacatcaaaaagcttatgcaccatgatcaagtgggcttcatccctgggatgcaaggctggttcaatatatgcaaatcaataaatgtaatccagcagataaacagaaccaatgaaaaaaacacatgattatctcaatagatgcagaaaaggcctttgaaaaaattcaacaccccttcatgctacaaactgtcaataagttaggtattgatgggacttatctcaaaaaaataagagctatctatgacaaacccatagccaatatcatactgaatgggcaaaaactggaagcattccctttgaaaatcagcacaagacagggatgccctctctcaccactccttttcaacatagtgttggaagttctgtccagggcaattaggcaggagaaggaaatcaagggtattcaattaggagaagaggaagtcaaattgtccctgtttgcagatgacatgattgtatatctagaaaaccccatcgtctcagcccaaaatctccttaagctgataggcaacttcagcaaagtctcaggacacaaaatgaatgtgcaaaaatcacaagcattcttatacaccaataacagaaacagagagaaaaatcatgagttaactcccattcacaattgcttcaaagagaataaaatacctaggaatccaacttacaagggatgtgaaggacctcttcaatgagaactacaaaccgttgctcaatgtactaaaagaggatacaaacaaatagaagaacattccaagctcatgggtaggaagaatcaatatcatgaaaatggccatactgcccaaggtaatttatagattcaatgccatccccaacaagctaccaatgactttcttcacagaattggaaaaaaactactttaaagttcatatggaaccaaaaaaaagccggcattgccaaggtattttatatgcttttaaatttcaatttcatttatttcttctctgtttcttattattttattgtttttacctattttgggtttggtttgccccacttttctagttctttaatattcattgttaagtttttttatttgaagttgtttcttttttgatgtattttcttatatttataaactccttctttgtaccaattttgttattttttataggttttggtatgttgtgtttttactatcatttctttcaaggaattttttgattgatttctaaatttctttatttatctgctggtcattcaggatcgtattgtttaattttcgtgaatttgtagcgtttccacaattccgctttttattattttctactttttttccattgtggtcagagaagatgcttgatataacttcaattttttaaatgttttatgaagtattttgtgacctaacatatggtctatccttcagaatactctatgtgctgaagaaaaaaaatgtgtattcttcagctgttagataaaatgctttaaatatttatgagatcatattaatctatagtgcagattaattctgactttttttggttgattttctgcctggaatatctgatcaaagttaaaagtggagtgttaaaatctccaggtgttattgtattggggtctatctctctttttaggtgtaataatattttcttcatatgtgtgggtgctccagtgttggatgcatatgtatttaaaattgttatgtcctgttgccgtatacaccccttcatcattacatagtggccttcattgtctcttcttgtaatttgtgtcttaaaatctattttttctgatataattattgtgacttttgttatattttggtttccattggcatggaatatcatttttattcctttattttcattctctttatgtctttacagatgaagtgtgtttcttggtggctacagattaatgggtctttttttttattcattgagccagtctgtgtcttttaattgaagggtttagtccactgacattcaatgttattattgataagtaaaggcttactcctgtcaccttattgttgtatggttgctttgtggcctactcttctttcttttctttcagttttcctctagtaaaggtcatttttttcctagtgatatcgtttagtttcttgctttttattgtgtgtcccttgtatgttttttggtttgaggctaccatgaaacttgcaaatattctcttataactgtgttttaaccttataacaacttaaaactattttcataaacaaacaagcaaaaagatatctaataaaataaacagccttaattttgttcccccactttttaacattttgttgtttctatttgccgagaccagctaggttggggagaacctaacccagtggcactagagaaattaaagacacacacacacaaatatagaggtgtgcagtgggaaatcaggagtctcacagccttcagagctgagagcctcaaagggagatttatccaagtatttattaacagcaagccagtgataagcatagtttctatagattatagcttaactgaaaatattccttatgggaaacaaagggatgggcggaaataaagggttgggtttggttagttatctgcagcaggagcatgtccttaaggcacagatcactcatgctattgtttgtggtttaagaacgcccttaagcggttttctgccctgggtgggccaggtgttccttgccctcattctggtaaacccgcaaccttgcagcgtgggcgtcatggccatcatgaacatgtcacagtgctgcagagattttgtttgtggccagtttgggggccagtttagggccagatttttgggggcctgttcccaacactagttatatcttattgtactgactatgacttcaaaagttgttgtaattattatttttgattttttcatcagtctttttagttagggtaagagtagtttacacactacagtaacagtgttacaatattctgtgtttttctgtttacgtactattaccagtaaggtttcatcttttgggtgattattttttgctcattaacgtccttttctttttttattgaagtaccccctttagcattttttgtaggatggatctggtattgataaaatcctcagcttttgtttgtctgtgaaggtctttatttctccttcatgtttgaggaatattttctccagatatattattctagagtagttttttttcttcagctctttatttatttaatgagatggagtcttgctctgtcacccaggctggggtgcagtggtgtggtctcagctcactgcaacctctgcttcctgggtttaagtgattctcatgtctcagcctccctagtagctgggattacaggtgcctgccaccatgtctagctaatttttttttttttttcagtggagacggggttttgccatgtttaccaggctggtcttgaactcctgacctcaggtggtctaccttcctcagcctcccaaaatgctggaattacaggcctgagtcaccacacccagcgtccttcagcactttaaatatgtcattctactctcctagtctgtaaggtttccactgaaaaggctgttgccaaccttattggagctccattgtatgttacttgtttcttttctcttgttgcttttaggatcctttctttatacttgatatttgggagtttgattattaaatgacttgaggtagtcttgtttgggttatatctgcttggtgttctaaaacctccttggacttagacattaatatctttctccaggtttaggtatttctcttttactatatatttgaattaactttctatccctatgtctttctctacctactttttaaggtgaataagctttaaatttgcctttttgaggtgattttctatatcttgtttgtgctttattgtttttctattcttttttcttttatctctgactgtgtattttcaaataacctgtttttttagctcactaattctttcttctgcctgattcaatctgctattaaataactctgatgtattcttctgtatgttaattgcaccgttcacctccagaaattctgcttgactctttttgattatttcaatctttttcaatgtatcagatataattctgaattccttctctctgttaccttgaatttctttgggtttcctcaaaacagctattttgaattctctttctgaatggtcgcatatctctgtttccccaggattggatttttttgttccttatttagtttacttggtgaggtcatgttttccaggatggtattgatgtttctagatgtttttcagtgcctgagtattgaagatttaggtactttttgtaggctttattgtctgggcttatttgtggctgtcttcttgggaaggcttttctgatatttaaaatgatttctgttttgtgatctaaactgtgtctgctttagggggcaccccaagaccagtaacactggtttctcgcagacccatagagatactcttttgatggccttggacaaaatctgtgagaattctctggattattaggaagagactcttgttctcttactttttcctaaacaaatgaagtctttttttctgtgatgaaccacctaaaggtgggggtagggtgacacaagcattcctttggtgaccaccactatgaatgtgctgggtcagacatgaagccagtatggtgctgggtctttacctaggcctgctctaaccactccctggctactgcctatgttcacttaagttgctagggctctacaatcagcaaaaggcaatgccagtcagtattatgtttttcctttcagggtgacaaggtccaccaggccctgggtggttccagaagtgcaatcagggagtcagtgactagagtcaaaaaccttagaattctatctggtatcctattgtactgtggctaagctggcactcaaactacaaaaggcagttcttcccactctttcctctactttgcaaaatcagaagagcctcaccaagtagccaccaccccagtcaatgaggactacttccagactaccactgatgttcccttaatgcccaagatttcttaagtcaacttgagtgactgctgccttatctgggactcatacttcagggcagtgagcagccctctagcccagggtaggtccagaaatgccatccaaaagtcaagttctggaatgggggaatgtaagtttccacttggtgttctaccccactgtgacagtgttggtacctgaggccagcaagccacagaggctcaccaaggccaatgttttagtacctggttattgctgatggttattcagggtccaaagtctcttcagttagcagatgatgaatgcttctatgataggggcattcccttcaaggcagcaggtttatttattgcccacagtgtgactagcaatgtcatctgggagctagggtctggtatggggtcctcattactctcagcagtgccctgtggctgagctggtatcctagatgcaagaaaaagttctccccactcttcactcttctctcctgaaacataaggagggggtcaattttggagtggaaaaaggggtctcttttggagccctgagctgtaaagcgggagttagaggaggggtaatgccagtactcccttgtctgccccagctggtgtctcagtatgtcatgtgttgtccgcattccactgtgtctgggccaattttagtcctaggacttgcctaatacatgcagtagtccttatagcctagagtacctttcaagtttacttagtgaccaagagcactttggccctcagtggtcagtatggcaggcacttgtgttcagataggttggattggtgattctccttttgctggggctgatttaaatgctctctctgtgggcaggcatcagctgagtttggtctggcttttctttctgctctaacagagcaccacggagttcagtgcctcacaatttccaggttcttcttcccccactgcccagagatgcttccccaacaggttaccacttctaggtgtggggaaggtgtggcatccacaattgagcactgttttctttttttctatcccttcagtgcctctttcagcaatataatgttaaaaccaggtattatgagtgctcacctgattgttttgtttttatgaaggatcttttcttttttttctttttttttctttttttttttttcctgcgtagatagttgttaactttgtgtctttgcgagggaacaattggtggagttttttatttctccatcctgctcttcatcctgtagatgtctattggttgcatttggtcaaatatcactttcaagtcccaaatatatctgtttgtttcctgcctcaatgatctaatactgtcagtggggtgttaaagtctccctctattatttttggacatttaagtttattcctaggtatctgagaacttccattctgaatctgagtgctcctatgttgtatgcatgcatatttaagaaagttaggtcttcttgtcgaattaacccttatatcattatgtaatgctcttctctttcttgtttttgttggtttatcacctgctttgtctgaaattataacaacctatgtctttttctgttttcacttgtttggtattgatctccatttatttactttaagcctatgtgtgacattgcatgtgagatgagtcttatgaagaaagcataactttgggtcttgcttctctatacaatttaccactctaagcattttaattagggcatgtagcccatttacattcaaggttagtattgatatgtgcagatttgatcctgtcattgtatttttagccagtttctatgcagatttgattgtgtggttgcttcacggtatcaatgttttacgtacataattgtgtttttgtagcgtcaggtaatgatcttttcataaatagaactcctttaagggcctcttatagggcagttttcctggtaacaaattccctgagcacttcctggtctgaaaagactctgatctcttctttacttatgaagcttagtttggctggatataaaattcttggttgtatttttttgttgttgttgttattaatgctgaatatatacccccaaccttttctggcttgtaagatttctgctgaaaattccactgttagcctgatgggttttcttttgtaggtaacctgacccttctctctagctgcctttaacatttttttctttcatttccactttggggaatctgatgactatttgtcttggggatgttcttcttgtggagtatttcactggggcaatctgtatttttctaaatttaaatgttggcctttttagtgaggatagaaaactttccatggatgatattctcaaatatgttttccaagttgtttgatttctctccctgtttttctggaatgccaattttcatagagttggtctctttacataattccatatttctcagaagttttgttcattcttgtttgttgtttttctttacttttgcctaagttatttcagaaaaactgtcttggaaatctcagattctttcttcagatttgttgattctgctgttaggacttgggttgtgttctaaaattcctgaagtgagtttttcaattctatcagttccattttattcttcttctttttttaattttattgttttaatgggcacataagaattgtaaatatttatgtggtacattgtgacttcatttattttattttattttattttactttaagttctgggattcatgtgcagaatatgtaggtttgttacataggtatacatataccatggtggtttgccacacctatcaacctgtcatctaggttttaagcccggcatgcattagatatttgtcctaatgctctccctccccttgccccccacctcccagacaggtctcagtgtgtgatgttcccctccctgtgtccatgtgttctcattgttcagctcctacttatgagtgagaatatgtggtgtttggttttctgttcctgtgttagtttgctgagaatgatggcttttagcttcatccatgtccctgcaaaagacatgaactcattttttatggctgcatagtattccatggtgtatatataccacattttctttatccagtctatcattgatgggcatttgggttggttccaagtctttcctattgtaaatagtgttgcaatgaaaatacctgtgcatgtgtctttataatagaatgatttataatcatttggatatataagcagtaatggcattgctgggtcaaatggtatttctagttctagatccttgaggaattgccccactggcttccacaatggttgaactaatttgcctttccaccaacagtgtaaaagcattcctaaatctccacatccttgccagcatctgtcgtttcctgactttttaatgattaccattctaactggcatgggatggtatctcattgtggtttttatttgcatttctctaatgaccagtgatgatgagctttttttcatgacagattgcaaaatttctctcccattctgtaggttttctgttcactctgatgctagtttcttttgctgtgcagaaggtctttagtttaattatatttcatttgttaattttggctttagttgccattgcttttggtgttttagtcatgaaggctttgcctatgcctctgtcttgaatggtattgctcaggttttcttctagcattttcatggttttgggttttatatttaagtctttaatccatcttgagttaatttttgtataaggtgtaaggaaggggtctagtttgtgttttctacatatggctagcttgttttcccaacaccatttattaaatagggaatcctttctccattgcttgctttcagcctgccctacaagaactcctgaaggaagcactaaatatgaaaaggaaaaactggtaccagctactttaaaaacacaccaaaacttaaaccccaatgacactatgaagaagctgtctcaactaatgtgcaaaataaccagctaacatcacaatgacaggatcaaatacacacaccacaatattaatcttaaatgtaaatgggttaaatgtcccaattaaaagacacagcctggcaaattgaatacagtcaggaccaattggcgtgttgtattcaggagacccatctcacgtgcaaagaccaacataggctcaaattaaaggaatggaagaatatctaccaaacaaatagaaaaaaaaaaaggaaaaaaaaaggcagaggttgcaatcctagtctccgataaaacagactttaaaccaacaaagatcaaaaaagacagaaaagggcattacataatggtaaagggatcaatgcagcaaaaagagctaacaatcctaaaaatatatgcacccaatacacaagcacccaggttcataaagcaaattcttagagacctacaaagagacttaaactcccacacaatactcatgggatactttaacaccccaatgtcagtataagacagatcaataagacagaaaattaacaagggtcttcaggtcttgaactcagctctggaccaagtggacctaatagacatctacagaactctccaccccaaatcaatagaatatacattcttcttaccaccacattgcatttattctaaaatcgaccccacagttggaagcaaaacactcctcagcaaatgcaaaagaacagaaatcataacaagcagtctctcagacgacactgcaatcaaattagaactcaggattaagaaactcactcaaaactgcacaaatacatggaaattgaacctggttctgaatgactactgggtaaataagaaaattaaggcagaaataaaaaagttctttaaaaccaatgagaacaaagagacaatgtgtcagaattttttggacattgctacaacattgttaagagggaaatttatagcactacaaggtctgcaacagaaagctgggaagatctacaattgacatcttaacatcacaattaaaagcactagagaagcaagaggaaacaaattcaaatgctagcagaagacaataaataactaacatcagagaagaactgagggagatacagacacgaaaaacccttcaaaagatcaatgaatccaggagatgaatttttcaaaagactaacaaaatagatggaccactaggtagactaacaagaaaagagagaagaataaaatagactcaataaaaaacgataaagggaatatcaccactaatcccacagaaatacaaactaccatcagagaatactataaacacctctatgcaaataaactagaaaatctagaagaaacggataaattcctggaggcatacactctctcaagactaaaccaggaagaagccgaatccctgaatagaccaataacaagttctgaaattgaggcagtaattaatagcctaccaaccaaaaaaaaaccctggaccagacagatacacagctgaattctaccagaggtacaaataggagctggtgccattgatattttcatatggattgcattgaatctgtagatgactttgagtagtatgaacactttaacattgtttattcttccaatccatgaacatgaaattttttttatatcttgtgtgttcagtttctttcatcagtatttcatcagtgtttcatagttctcattttagagaactcacttcagttaatttgtaggcatttagtttcatttgtggctattttaaacgagattactgctttttattttttgtgtatgtgctcattgttcacatatagaaatgctactgattttttgcatgctgattttgcatcgtgcaactttactgaatttgtttatcagttctaatagtgttttggtgaagtctttaagtttgtccaaatataagaccacatcatatgcaagcaaggattatttgagttctttctttctaatttggatgtcctttatttctttctcttgtccaattgatctagctaagacttccaataatatattgaataatagaggtgaaactttgcatccttgatgtgttccagctcttataggaaaggctttcatttttttttctatttagtataataccagcattgggtctgtcatatatagcttttatgtgttgaggtatattctttttaaacccagtttttttagggtttttatcatgaagacatgccaaattttatcaaatgtttttcagcattaattggaatggtcatatggttttgtccttaaatgtgttgatatgatttatcacattgattgatttacatatgttgagccatccttgagtcccagagataaatcacatttggtcatgatgaatgatctttctaatgtattgtagacacttgtttgctagtatttcgttgagaatttttgcatcaatattcatcagaaatattggcatacagctttccttttagatgtgtctttatttttggttttgatatcatagtaatactaggcttgctgaataagtttggaaatatacctttctcatctatttttcagaatagttttattcctctttaaatatttgtggaagtcagcagtgaagccattgggtcctgggcttttctttactgggagactttattatggcttcaatcttgttattattattggtctgtttgggttttggatttcttcatgtttcagtcctggtactttctatgtgtttaggaatttattcattttttctagattttccaatttattggcatataatttctcgtagcagtcacttatcatcctttaaatgtttgtggtatcagttgcaatgtctctgttttcacctctggttttatttacttgagtctactcctttttaagtagttaatctgactagaggtttgtctatttttaaaagtctctttaaaaaaccaacatttcattttattgatctttctattgttttctttattgaattttatttatttatgcttgatattttaaatttcttttcttctattaattttaggtttggttttctattgattttctagttctttaaagcatgttaataggttgtttatttgaatttttttgatataggtttttatagctataaatttctctcttagtactgctttcactgtatcccacaggttttggtatgttgtgtttttattatcatttatttaaagaattttaaaaatttctttcttaatgtattcattgatccactgtacattcaggagcatactgttcaatttccttgtgtttgtatagcttccaaactgtctcctgttattgatttgtagttttattccattgtggtcagaggaagtgcttcatatttttaaaaatttttttcaatgttttaagacttgttttttcatatggtcttccactgagattgatccatgtactgaggtgtagaatgtatattctgcagtgttggataaaatgctctgtaaatatctagtaagtgcatttgttctgaagtgcagattaagtccaatgtttatttatatattttctgtctggaagacctgtccactgctgaaagtggcatgcttaagtctctagttattgtattgtgattatttttctctatatgtctaataatatttccttcaaacatctgagtgttcaagcattggataatatatatttacaattgttataaccttttgctgaattgacacttttatcactatgtaatgacttgtttgtctcttattacagtatttgttttgaaatgtattttctctggtatagtatagctatttctgctcttttttggttttcaatggcatagaatatattttttcatctttttattttcaatttatgtgtatctttataggcgaattgtgtttactgtttgctagaaattattgggtcttttttttaaaaatccattcagacattttatctcgattgattactttagtccttttacgttaaatgttattaataactaagaactttcccctgccaatttgttttttgttttctggctgttttgtactttttttcttccttcctgtcttccttttattaaaggtgagttcctttcatgatgtgatttaatcatctcttgtttttattttttgtgtatatattgtatattttgatttgaggttgccatgaggcttgcaaacactatcttataacccgttgttctgaacagatgacaacttaacactgattgcataaacaaaaaagcagaaagaaacctaataaatactctattttaaccccatttccaagctttttaactttttgctatttctctttatgttttattataccatgtatatgtattgaaaaactgttgttatacactacaattacagtgttataacattctgtgtttttctctgtgctcttacaagtgagatttgtactgtctgatgatttcttcttgttcattaacattctttactttcagattcaagaactccttttagcattccttaataggataggtctggtgttgataaaatcccatagcttttgtttgcctggcaaagtctttatttctccttcatgcttgaaggatattttcaccatatacttaaacttcttatgcttgcatgttgatgtatttctgtaggtttgagaaattctctgatattattactttgaattaactttctacccctatctttttctctacttcctctttaagaccaataactcttagatatgcccttttgagactattttctagatcttgtagtcttgctttttttaaaaaaaatgccattttcttttgtctccactgagtattttcaaacagcctgtgtttaagctaacaaattctttgttctgcttgatcagttctgctataaacggactctgggaaagggtgccaagatggccgattagcagcaactgtggttcatggcactcatggtgaggaatgaaagggaagagtgaatacagcaccttcaactgaaatatccaggttctcagatggggaatgattagggaaacaatttgacacacggagaaggaataaaaacagagtgggatgatggcccacctgggagtaacatggagccaagggaacccacacctccagccaagggaagtggtatgggagaaactgaggcaactaggctctggagtagatctccagcaaaccgaagcagccctacagaagagtggccagactgttaaaaagaaaaacaagcaaacagaaaacaacaacaacaaacacaaaaccccatcaaaaatcagcaaccttgaagatcaaaggtatataagcccataaatacgagaaagaaccaatgcaaaaacactgaaaactcaaaaagccagagtgcctcttttcctccagatcacaacaatacctctctgtcaagggctcagaacaaagctgaggctgagatggctgaaatgacagaagtaggtttcagaaggtcggtaatactgaactttcttgagctaaaggaacatgtagtaacccaatgcaaagaagttaagaattatgataaaacaatacaggagctgaaagccaaaataaccagtttaaaaaggaccataactgacctgttagagctgaaaaacacactacaagaacttcacaatgcaatcacaagtattaatgacagaatagaccaagtagaggaaagaatttctgagattgaagcctatctatctttctgcaataagacaagtggacaagagtagacaaaaaagaatgaaaaataataaagaaaaagtccaagaaatatgagattatgtaaagagactgaatgtaagactgattagggtacctgaaatagatagggagaatggaatcaagttggaaaacatacttcaagatatcatgcaagagaacttcccccatgtatcaagacaggacagtgttcacgttcagaaaatgcagagaacctcaggaagatactccatgagaagataattcccaaaactcatattcttcagattcacaaaggtctaaatgaaataaaaaatattaagggcagccaaagagaaaggccaggtcacctacaaagtgaagcccatcagactaacagtgggcatctcagtgagaactcttcaagctagaagagatcgaaagcttaatatttaatattcttaaagaaaagaattttcagcccagaatttcatatccaggcaaactaatcttcataagtgaaagagaaatatggtcctgttcagagaagcaaatgctgagggaattcgttaccatcagacttgccttacaaaagctcctgaaggaagcagtaaatatggaaagaaatacctattaccagccacttcaaaaacacactgaagtacacagatcagtgacactatgaagaaacacataaacaagtttgaaaaataacctgctaacatcatgatgacaggatcacatctacacataacaatactaatcttaaatataaattaactaaatgtcctaattgaaagacacaaagtgggaagaaggacattacaaaatgggaaagggttcaattaaataataagaattaactatcctaagtgcaaatgcacccaatgcaggagcacccagatttgtaaagcaagttcttagagaccttcaaagagacttagacacccacacaataaaagtgagactttaataccccactgacaatattagacagattatctattcacaatagcaaagacttagaaccaacccaaatgtccaacaatgacagactgaattaagaaaatgtggcacatatacaccatagaatactatgcagccataaaaaatgatgaattcatgtactttgtagggacatggatgaaactggaaatcatcattctcagtaaactatcacaagaacagaaaaccaaacaccgcatattctcactcataggtgggaattgaacaatgagaacacgtggacacaggaaggggaacatcacactctggggactgttgtggggtggggggaggggggtgggatagcattgggagatatacctaatgctagatgacgagttagtgagtgcagcgcaacagcatggcacatgtatacatatgtaactaacctgcacattgtgcacatgtaccctaaaacttaagtataataataataaataaataaataaaaataaaatcaacaaagacatacaaggcttcaactcagcttgggatcaagtggacctaatcaatatatacaaaactctctaccgcaaagcagaatatatgttcttctcatcaccacacaacacttactctaaaattgatcccataattggaagcaaaagtctcctcagcaaatgcaacagaactaaaattataacaaacagtccctcagaccaagcacaaattagaaatcaagattttaaaatgtactaaaaaccacacaactacatggaaactggacagcctactcctgaatgactcctgggcaaataataaggcagaaatcaagaagttctttgaaagtagtgagaacagagagacaatgtaccagaatctctgggatgcagttaaagcagtgttaagagggaaatttgtaggactaaatgcctataacaaaaaactacaaagatctcaagttaacaggctaacattacaactaaaagaactagagaaacaagagcaaacaaaccccaaagctaacaaaaaacaatacttaaccaagatcagagctgaactgaaaaagatagaaacacaaaaaacacttcagaaaattaatgaatccaggagctgtttttctgaaaaaaattaataaaatagattggccactagctagactaataaagaagaaaagcagggtgaaaccattgctccaccttgcttttctttcttatgcgtatgtcaagttgtttccctactcatttccaatgcaagattcatatatttcagttgaaggtgctgtattcactttcccctttcattgctgtccatgagaagattcaaataaacacaatcaggaatgataaaggtgatatcaccactgaccccatagaaatacaaacaaccatcagagaatactataaacacttctatttacataaactggaaaatctagaagaagtgaatagttcctggacacatacaccctctgaagactgaacaagaatgaaactgaatctctgaatacaccagtaacaagttctgaaattgaggcagtaacaaatagcctaccagcaaaaaaaaaaaaaaaaaaaaaaaaaggcagcctaggaccagatggattcacagttgaattctactagaggtacaaagaggagctggtaccatttctactgaaactatttcaaaacattgaaaaggagggattcctccctaactcattcattgaggccaacatcacccgataccaaaacctggcagagatatgacaaacacaaaaacttcagggcaatatgattgatgaacatcgatgcaataatcctcaacaaaatactagcaaactggatccagcagcacatcagaaagcttatctactatgatcgagtaggcttcatccctgggatgcaaggtgtgttaaatatatgcaaatcaataaacgtgattcatcacataaacagaggtaaagacaaaaaccacatgattatttcaaaagatgcagaaaaggcctttatttatttatttatttcccatttccataggatactgggtcacaggcagtgtttacttacataagtaagttctttagttttgacttgtgtttttggtgcacccatcacccgagcagtatacactgcactttttgtagtcttttatccctcaccccattcccaccctttccaccagagtccctaaagtccattttgacattcttatgtctttgcattatcatagcttatctcccacataccagtgagaatgtatgatgtttggttttccattccagagttacttcactaagaataatagtctccaatctcatcgaggtcactgtgaatgccagtaatttattccttttcatggctgagtagtattccatagcataaatatataccacagtttctttatccaatcattgattgatacacatatgggttggttccatggttttgcaattccaaatcgggctgctataaacgtgtgtgtgcaagtatcctttctttttttttaacggaaataccatgtgcttaatttaatttatcattgaatataaggcactactctaagaagtgaaaagaaactcatagctcctcatgtcattatgaaataagtattattggcctcatcctcattttacagagcagaaaacgggaaaaggagataaactgattttttgtaaggccaaaagagaattatatgagcttgaggttgaagccaggtagtctacctgagtacatttccttagcccatgctataatccctctgctatagtgtgctgcttaactggctcactcatctataaaaaattttcaaatcaatcttggactaaaattcagttttagataacaaatcaagtaaaactcatcaaacattattttaccctgtaatataaagttgaagcacttattcttcaatttctctttctgcttatcaaaaaaatccctggctaaacattgaacaaaatcaaaactggtgaataaaattattattatcattttaaacaaataacttttttattattatacattaagttctgggatacatgttcagaacgtgcaggtttgttacataggtatacatgtgccaaggtggtttgctgcacccatcaacccgtcatctatagtaggtatttctcctaatactatctctcctctagcctccccaccccctgacaggcccttgtgtgtgatgcccctacctctgtatccatgtgttctcattattcagcttccatttatgagtgagaacatgcggtgtttggatttctgttcctgtgttaatttgctgggaatgatgattcccagcttcatccatgtccctgcaaataacatgaactcatcctttttatggctgcatagtattccatagtgcatatgtggcacattttatttatccagtctatcattgatgggcatttggattggtttcaagtctttgctattgtgaacagtgctgcaataaacatatgtgtgcatgtatctttatagtagaataatttaaaaccctttgggtacatacccagtaatgggatggctggatcaaatgctatttctggttctagatccctgacgaattgccacactgtcttccacaatggttgaattaatttacactcccatcaacagtgtaaaagagttcctatttttccatatcctcaccagcacctgttgtttcgtgactttttaatgatcgccattctaacaggcgtgagatggtatctcattgtggttttgatttgcatttctctaatgaccagtgatgatggctttttttcatgtttgttggctgcataaatatcttcttttgagaagtatctcttcatatccttcgcccactttttaatgttttttttcttgtaaatgtgttgaagttccttgtagattctggatattagcccattgtcagatggatagattgcaaaaattttcacccattctataggttgcctgttcactctaatgatagtttcttttgctgtgcagaagctctttagttaaattagatcccatttgtcaattttggtttttgttgccattgcttttggcattttagtcattaagtctttgccaatgcctatgtcccgaatggtattgcctagattttcttctagggtttttatggttttaggtcttacatttatatttaaatctttaatccatcttgagttaatttttgtataaggtgtaaggaaggggtccaatttcagttttttgcatttggctagccagttttttcaacatcatttattaaatagggaatcctttccccattgcttgtttttgtcaggtttgtcaaagatcagatggctgtagatgtgtggcagtatttctgaggcctctgttgtgttccattggtctatatatgtgttttggtagcagtatcatgctgttttggttactgtagccttgtagtattgtttgaagtcaggtagtgtgatgcctccagctttgttatttgtgcttaggattgtcttagctatacatgcccttttttggtcccatatgaaatttaaagtatttttttctatttctgtgaagagagtcaatggtagcttgatggggatagccttgaatctataaattattttgggcagtatggctattttcatgatattgattcttcctatccatgagcatggaatgtttttccccttgtttttgtcctctcttatttccttgagcagtggcttgtagttctccttaaagaggtccttcgcataccttgtaagttggattcctaggtattttattctctttgtagcaattgtgaatgggagttcactcatgatttggctttctgtttgtctagaaatgctggtgatttttacacgttgattttgtatcctgagacttcgctgaagttgcttatcagcttaagattttagactgagatgatggggtttttaaaatatacaatcatgtcatctgcaagcagagacaatttgacttcctttcttcctatttgaatgccctttatttctttctgtttcctgatttcccttgccagaacttccaaaactatgttgaataggaatgttgagagagggcatccttctcttgtgccagttttcaaagggaatgcttccagcttttgcccattctgtatgatattggctgtggttttttataaatatttttattagtttgaaatacgttccatcaatacctagtttactgagagtctttagcatgaaagagtgttgaattgtatcaaaggccttttttgcctctattgagataatcatgtggtttttgtcattggttctgtaacgtgatggattatgtttattgatttgcgtatgctgtacaagccttgcatcccagggatgaagccaacttgattgtggtgcataagcttcttgatatgctgctggatttggttggccagtattttattgaggatttttgcattgatgttcatcagggacattggcctgaaattttctttgttttgtctctgcctggatttggtatcagaatgatgctgtcctcataaaatgagttaggaaggattcccttttttttttttctattgtttggaatagtttcagaaggattgttacaagctcctctttgtacctctggtagaatttggctgtgaatccgtctggtcctgggctttattttggttggtaggctattaattactgcctcaatttcagagcttgttattggtctatttagggattcgacttcttcctggtttagacttcggagagtgtatgtgtttatgtgtttatccatttattctatattttctagtttatttgcacagaggtgtttacagtattctctgatggtagtttgtatttctgtgagataagtggtgatatcacctttatcattttttattgtgtctatttgattcttctctcttttcttctttattaatctggctagaggtctatctattttgctaatctttttaaaaaaaaaaacagctcctggattcattgattttttgaagagttttttcatgttcctgtctccttcatttctgctctgatcttagtgttttacttccaactatgtggtcaattttaaaataagtgcagtctggtgctgagaagaatgtatattctgttgatttgggatggagagttctggagaactctattaggtccagttggtccagagctgagttcaagtcctgaatatacttgttaattttctgtcttattgatttgtctaatattgacatgtgttgttaaggtcttccactattattggtgggtgtctaagtctctttaaaggtctctaaggacttgctttataaatctggttgctcctgtattgggtacatatatatttaggatagttagctcttcttgttgcattaatccctttaccattgtgcaatgcctttttttgtgtgtgttttctgacctgtagaagtgttccctattcactgcatgcacgccaacatctaatttttgattttttgattgtggacttgcatgaataagttgttatcacattgtggttttgatttgcattttcctgatcattagtcatgtttagcttttttatgctttttggacaattatatatcttcttttaagaattgtctgctcatgtccttaacacgctttttgatgggattgtttgtttgtttctggatgatttgtttgaattccttgtggattctggatatcagtcctttgttagatgtatagattgtgaagattttctgccactctgctcgctgtttcttttgccatgcacaactggcatggcagtttaaactaaactaaagtttaattaaattccagccatttatcttttttttgttgttgttgttgtttttcttttttggggggaggggggttttggtcataaaatccttgcccaagccaatgtttagaggggtttttccagtgttatcttctaaactttttacagtttcaagtattaaatttaagtccttaattcatcttgagttgatttttatataacgtgagaggtgatgacccagtttcattctcctacatgtggcttgccaattatcccagcacatttgttgaaaagggtgtcctttccccagattatgtttttgtttgcttgtcaaagttcagttggctgtatttgggtttatttctgagttctctattctgttccattggtctatgtgcctgtttttataccagtaccatgctgtttttttgactatagccttattgtatagtttaaaatcagggcatgtaatgcctccagatttgttctttttgcttagtctttctttggctatgctatctctctattggttccatatgaattttagaaatttttttgaattctgtgaagaacgatggttgtattttgatgagagttacattgaatttgtagcttccttttggcagtatggtcattttcacaatatcgagtatacccatccatgagaatgggatgtttctatttgtttgtgtcgtctatgatttatttcagcagtgttgtgtagttttccttgcagaggtattttgtctccatggttgtgtatatcctaagtatttaaattttttttgcagctattgtaaaaagggttgaattcttgatttgagtctcagcctggtcgctgttggtgtatagaagagctactgatttgtctacctttgttttatattgggaaactttgctgtattcttttatcagttctaggagcattctggaggaatctttagagttttaaaagtaaagaatcatattttcagcaaacattgacagtgttagtttctttttactggcatggatgccctttatttcttttggttttctgatttttctggccaggagttccagtgctatgttgaagaggagtggtgagagtaggcatccttgttttgttccagttctcagagggaaggctttcaacttttccccattcagtattatgttggctgtgggtttgtcatagatggctattattaccttgaggtatgttccttgtaagccaattttgatgagacttttaatcataaagggaagctggactttgtcaaatcctttttctgcatctgttgagatgttcatgtgatttttgtttttaattctgtttatgtgttgtatcacatttattgactagcgtacgttaaaccatccctgcatccttggtatgaaacccacttgatcatggttgattatcttttttatttgttgttggatttagttagctagtattttgttaaggattttagaatctatgtttatcagggatattggtctgtagttttcttttttgattatgtcctttcttggttttggtattagggagatgctagtttcatagaatgatatcatgagggttccctctttctctatattgtggaatactgtcagtaggattggtaccaattattctttaaatgtctggtagaattctactgtggatctgtctggtcctggactttttttgttgataatttttaaattgccatttcaatcttgcatctagttagcggtctgttcagggtatctaattcttcctgatttaagctaggagagttgtatctttccaggtatttatctatctcttctaggttttctatttatatatgcataaaggtgttcatagtagccttgaatgatattttgtatttctgggatgtcagttgtattatctcccattttatatcttattgagcttatttggattttctttcttcatttcttggatatccttgctaatggtctatcaattttatcttctcaaaaaaaccagctttttgtttcaattttcttgtatattgtgttttttgcttgtttatttaattttatttagttctgatcttatcttggttacttttttcttctgttgggtttggatttggtttgttcttgttctgtagttctttgaggtctggccttagattttctgtttgtgctctctcagactttttgatgtaagcctgtaggactataaactttcttcttagcaccacctttgccatatcccggaggttttgataggttgtgtcactattgtagttaatttagaagaattttctaatttccatcttaattttattcttgacccaatgctcacgcaggaacaggttatttaatttccacgtatttgcatggttttgaaggttcattttggagttgatttccagatttattttactgtggtcttagagaatgcttgatataatttcaattttcttaaatttattgaggctcactttgtggcctattatatggtttatcttggagaaagttccatgcgttgtttaatagaatatgtattctgtggttgttggatgaaatgttctgtatatatttgttaattccatttgttctaagatgtagtttaaatccattgtttctttgttgacttactctcttgatgacctgtctagtgctgtcagtggagtactaaagtcccccactcttactgtgttgttgtctatctcatttcttacgtctattagtaattgttttataaatttgggatctccagtgttatttgcatatatgtttagaattgtgatattttcctatttgatgagggcttttatcattttataatgttcctctttgtctttttaactgcttttgctttaaagtttgtttcgtatgatataagaatagctactcctgcttgcttttggcagcagatagttggttagtgaattcttatccactctgcaattctgtaccttttaagtagagcatttaagctatttacatttaatgttagtactgagatatgaggtaccattctattcatcaggctatttgttgcctctataccttggttttttgtttgttttggttttttaaattgtatttttgtttcataggtcctgttaaattcatgctttaaaaaagttatgctttgatgtgtttccaggatttgcttcaatatttacagctgtttttagcagttcttgtagtgctggcttggtagtggcaaattctctcagcatttgtttgtctgaaaaagtctgtatctgtccttcatttatgaatcttattttcacaggatacaaaattattggcagataattgttttgctttaggagactgaagatagggccttaatcctttttagctagtagggtttctgctgagaaatatactgttaatccgatagcttttcctttataggttacctggtgtttttgtctcacagctcttaagattcttaccttcttcttaactttagattacctgatgacagtgtgtctagttgatgatcttttggtgatgaatttcccaggtgttatttgtgcttcttgtatttggatgtctaggtctctagcaaggctggtgaagttttcctcaattattcctccaaataagcttttcaaacttttagatttctcttcttcctcagaaatgccaattattcttagatttagtcatttcacataatcccagacttcttagaggctttgttcatattttcttatatattttttgtctttgttggattgggttaattcaaagaccttgtcttggagctctgaatttcttttttctacttgtttgattctattgctgagactttcttgagcattttgcatttttataagtgcaataactgattttatataactgattttataataactgattttataataactgatgatattttgacactagtatgtgattttggaaactcctagggagactgtctgatgtagttttccaagctgaacactatgagggactcaaggggataaacatcctcttttttgaggcctgtcttaaggaggcatctgtggtgtagtggacagtgctgggcctcagagtcacagtcttgggctgaaattcagcatatcacttgctgctgtatattcacagaaaaattattaaacctttgtgaactttagtttcttcttttgttaaataaagattgtaaaaaatgcctaccacctaggaatatcatgagtattaaataagacaaagtatggaagtaaaaaagcacaccagcaataatcactaaatattagtttttcatccaccttctctttcactgcactactccttagaaaggaggtcttaaggaaggtaatttgctctcactagaaaccacaaggaagaaaggctttgtagaagataaccatgtgactgcacagctgccctcagtggggatccattttatctggacaggcagcaggtgaacccctaacactcatgtgtacacaatttctgaggacttaaaagcctaactgctgggtacatagaaacttgccaatcacactgtgagcataaaatgcagtagcatcataccagcccagaaatatgcaagtgattttagtccctaatgaaaaggttattaacaatcacctaagaatcttgtctgacagtttgatgacttgtttgctgctttgatccatctattcccagagatctggttccccatgtccttctggggtatacagtgggggctcactgccctttgactgacacaggcacacacaaatcaactccaaaacagagaagtgttgcctaaatgctaacccttcctatgcctttatcatcatccataaatcagaggattctgtttcccccactgtaccaccattcataattttatcaagtgagaatgcaaggcccagttaggatttaaaaaatgccttttctcaaatagaggcatgataaatacacaagttctggcctcttacctcctggtaattccagtcacttctcccccattctgtagtggttccctcaataagcccttctacagcctgtgatagttatttcccaatatatcttttcctatgcacacccctaagccttagtggtttcctccgtcctttctcctttggtatgagtgatacctcctaaatcgtcctcctctaagttctgcctagatgttttctctccctcttttctctaggctacatagggtctagagagactaaaaagaagagaacggaaaaggactcaagttctgtctctttcttttgctctgaactgagcaattaagttgtgagtgtgtgtgtgtgtgtgtgtgtgtgtgtgtgtgagagagagagagagattggttatggaatcagccctagtaatgaacatttttaagaaagtaaattagtaaaccaatagcagtctactcagagatcagagatcagtaatcatagaatatttttaaaacagctttattgaggaatattctaaatattataaaattcattcataatttcatgtatacaagtcaatgatttttattaactttattgagtggggaagacatcagcataactaaatcttagaacatctttatcctttaaataagatccatcatgcctattaacatttaattgtttttctcatgcccattccaaggcaaccattaatctacattctgtcttgattagcatgctttttatggatattttatatagatggaatcatacaatatgtggtctcttgtatctgacttattttacttgacatgatttaaggttcatctacaatgtattatgtgtcagaagttcaatattgtttattactgaatagtattctattatatgtatataccacaactttttatctgttcatcagttgatggacatttgggttgtttccacttttcggatattataaataatgtttctatatttgtatacaagtattgtgtgtacatatgtttttaattatattgagtatatatctaggagtgatattactggatcatactcaagtttagcttttagagaaactgtcagactgttttgaaaagaggctataccattttataattctaccagcaatacatgaggcttctcatttctccacatccttgccaacatgtattgttgtaaagattacagaatattaaagatggaaggaaacttgattttcctatctcttaaattaaattatagtaaagtatagcattcaaaattaaatagtttctctttaggtggtctctttaacctggtaagattatcaacacaaatacagaccttgaaatggcaaggcagtactcttaacaggtctagctagaatatgcttgtattttaagacattatgatcaaaatgaaaacacacacacacactgaaattcctaaagattttgcagacctcagaagatgtgcagtgcacggttcccttaggaccatggaaccctgtttgataagtattagtttagaacacaacaatttctagtagatccttatctcagaggagaatataaatggcataaacaattttagaaaaagaaagagagcttgaactataacccagatctcctgtgtgacaagtcagtgaatcccatcactactgatgccatgtccaatgatcagaaacacatttttttgctgtgctcactaagaaaagacacatgagcaaaatgattcaccaggttctctgaaagtagaggaataaacaaggtttttggatatatttctgtttattggccaatatgaaatgtttgcagagcatcataaacaaacatagccctgccagtatctacacatgcatatggctcaagagttaacaaaatttctataaataacccatttatgagaaaaaataattaaaatgtaccaatattcaatgtaaaacactgaagacctagctagtagggtggggttggtagagaggagtgggacaggagggattatgatctcaatgtgacagggctgtatgttgtagaggggtatgctgtagtgctgaatcctttcctaacctggatctgagaatcttggaggaaaaaattattttcccaggctccctcctgtcaaaatccaagtcaaggtatatggagagaaaaacagtaatccaaaaaaaaaaaaattcattctcaggaaatacctccccttccttacaaacaaaaactacattttttttttttgctagttcatttagagacaacttaactgctgtttaggctcaatgtatgttgaaaatgtttttatcaagtgtactttgttcttccactgaccaataacccctttgtagaaagacacataaaagcacagtgctcaaagaaatatgcctcagcattgaaaagtaaaactgtaaaaagaactctcctgaagcaaatactcaactatggtatttgccatggccaaacagaaattataaagacgaaaatccttcacttcacctttacccgaaatactttaaaatgcaaagccaattgccacctccaattgctgaacctcaaaaagttggaattaaggtgattctgggtatggcttgggctgtccacatagcattcatgccatgagcaagcacactgaagaagtcttactctttcactttatcatatttttgttattattattattattactgtgttaccatcattatctttcctctagagcagcagtgtcaaatgtgggcttgaaccactgccagccacatggcaacctttgaacacctgcagcctgctgaagccaaatcatcccctgtctggatattatttcttctaccagaaggtctaaacatgatcagtgaaagccagtgagataagaataacctgttgcagaaaaacaaaaacaaaaacaaaaacaaaaaaaaaacaggaaacctaaaggccaaggcctaaaaccttggttaccacatatttgctaatacctgtgtggggccaggctgcttgcttggtacaggcttgtatttcaattgcttctaatcctcagtccagtacaatgggacctttttgctttttcccaagtccttttagtaatctgatcaattggttgccccaggggcccttaatcagtgtttgtagatggatgaacccaaaagatgtagttaataaaattctaaaagcaaaaatcttgctgtagacagcactcctttgccagagctagaacctggtgatgaagtgcacattctgcctaatgtacttaataaaccacttaatagttgtgggacaggaactagctgtacaagtttcagacagattcttggagaataaagaatacaacctctaaggaacttgtttttctctgagcatgagatgtataggtgggagctaaaggcaaaaagacaattgagaaagaatcaaaggggaacggtggtgagaaagctgggattgaattgacatttcaatagaaagaggcatactcagatgtccctacatggattgagggctgtctttgagggactgctgtggggtagtttggggaactcaggccccagaaggaagattactttggctcagaaatgttctgtaaggttccaaaatggcgaacttcagcccttctccctgctgagggtggtgagaacctcaaatacagggtgaggccccagggatctagagggaaagtgtttgccctgcctcatgctgcaatgcagcagtctgagacatgaacttgggaattatggcacgaggcctcccccaagatagatattaatgtgtgtgtgtgtgtttgtgtgtctatgtatatgtgtgtgtatgtgtgtgtgtgtgtgttgaggagggagacagtgtggaggagctaaaaggggagaagggtttgattttgtccctaaagtgctaggtagatgtgccaacacaattttgagaggcttacctgaccaaaaatgcagacatgaaaaccctaccccattcactgtcctctctcctcttctctataatcaagttgagctaggaacatgtctggtagtcccatgaatgtggaatctggctccccagactacaaaagggaagcaagaaatgctccagatcagtccttgtgaaatggagaatcaatcctctggtgggatgggataggatatgccccatctgtagggtattagctcttgtggacatcacatttcaggcccctgctgctgttgtggtataggaacagagtccagagagaacaactgggcaaggctgccaggggcccaagagacctaaggagagagcaaaccaagttagaaacatgtggggaaatctcactagcacccttctttctctacccctccaaatatcataggttaagccaatggttgaggatgtaatagcagaaagacattacctagatagggatatgacaattctaccctattctacattgttgaaaccatttatcctgaagataggtttagttctaagctccacatactttagaagaacctaaagtggtattctccagagaggtggtgttgtcttcaagcctctgcagggctatcttaaagcagaggaaactgatgaggtctgtctggcacgaggaacagagccaggatggataggcgggtactacagggaaagctctttcttacattgagctcaaacccaccagtcacaattgtgtatactgtaatatacattgagaagtagtcagccctctgccacctaaagtatgtgagcaaggactacacaaactcttagtggggatattataaaatggacccaaaccttggaagaagaactggactagataaccttgaaggtacctaagttgattgatttgacatcagttataactttcaaatttgatatcagttatgactttcaaatatacatttgttcacgttttcttaggttggatgcagggagcagggaagtcattgggagaactgaaaatgtattaactgaagaaatacggaagtgggcactgcaagatatttggttagttgaaaactgggaatctacctactctcctacctcatgctacataagctttgagaaagtaacattggctatcaaatggttgcaatggtggagttgaaccaactctaaaatgtagcccccaaacctgggttcttgcacagttctagcccactaatttgccctgtgactttgagaaactaactttccctctctgtgtctcagttcctgcctctgtaaaatgtaaaatgaagtgacatacacacaaggtttgtatagttattagggaatgaaggttgatttgaaatgtagggtttccagatgacaaggcttgtatatctttttctactgtgctatgctgcttgcacacataaagggagatacctgaatatgaccattagatagtggggccctgagagagcttacgaaagaccagaatggagagactggtatcatgacaaccttgccagttccctgacaattgtagacccagaagtgtgatatctgtctggcttaaaagtttagcatcaccactgttgcccctccacccaaagtgttcctagcttgctgctgttcctccactcctagtgaataatactattccaaaagagaattccttgaggttagtccttaatttctgttttgctttttttgtttttttctgatccacctttccagctcacctcattagagttaagggctgggaacttcaaagggcacattgagctccagcctgtctccagtgctttcgactgtgtttccccccaaggtctcagctccagtataggaggcagagctggaaaacttttgcaggtccagctctgtgcattcgatggggctgtggacccagtgggagtggctctctgaggtgcaggaggccatggtaaaggactcctgtgtggggaagccactagtcgagctgcagtcgtcctcgaggatagggttaagtggctgggtctgaaagatgttctcactcacttgggactcagcactggtctccttgctgggtggcacggggaagagagattcctcctttgctgttttatcagcctcaaactgcagcaaacctcctgcaactcgaagcagaaagccactgggttacccaaaagcaggggctcttctcagctgggcactgggtactgagtacaagacaggtaaaggtctgggagctgattctttccttcctctccctggggtctagagcacctagcaccaggctgaggtgacacagttgagaaacatacttacattcaggtatcagattgaggctagctggtactggatcagagaaaataatcaatttctctagagaaaaagaaacctttgtgggaaacaggattttgataccatctcccttgccataatcttcatggcctggtcttatgtctatgtacattaagttacatggcaaactagactctgcagatggaattaaagttatggatttcaaaataaggagagaatcctggattactctatgggtccaatgtaatcctgtgtccctaaaagcagaagaggaaggcagaggagacagagagtatcagagagatgtggcatgagaagaactcaactcatcattgctagttttgaaaatagaagggggccatgagccaaagaatgtaagtggtcctagaggctaggaatgaccttcagcttacagccagcaaggaaatgggacctaagtcctttaactgcatagacctgaattctgccacttttgtgcatgatcaagcagattctctcccagagactccagaaagaaacacagccctgccaatatcttaattttggcattgtgagactctaagcagagacaaaattgagcctactgaacttctgagctatggaaactgtgataataagctactaaatgtgtggcaatttgttatggccatgatagaaaagtaatacccccttcatgcatggatctggttcaacatcaggtcacaaactgagaacctatgggatttgtgtttgtcctctttgctttggttgtgattttgctctttattcaaattcattgactatggttaacacaacttcattaaaaaaaatccagatttctgaattctcttgaaaatgtagaagatcttgcaacattaaatatttccatatggttacaaacagctggatccaagtagtgggattcccctttagataagggatgtgctctgtagtttgccacagttgcacttttctctcttgcaaccttacactggatttaattcgcacatacatctcaccccagtatgtgtgtaagtcagtgactcctgaaaaacagttttccaaagtaagaaaatgtctagccttcctagcccttataaaaacagtgaggaaactgcctgccctcatattccaagcaggttaccacattattatcttcaggatagaaggagagcagaaaagggttacccatctctcttcttctgaggcagctctctgatattttctcattttcatcttctggaccctggagtccaaatgcttcattgctcatgtttcatgtccatgcacccagggcctaagcaacaactcttatctgggacactggcctccaaagtcagagacaggaaggtctaccttgagtcacagtgtcccaggagctagcaagaagtagactttgagaaaaatcataaaggaacaacagtgttccccgtgtatcctgcagcccatgaaatgctatattcatctccaattaagccagggcacaaccaaacatacctcttgggcttttcaagatcatctgctaggccccagagccaaactgacccaaggcaaatttacattagcaggatcttcccacacaaatactgcagctttgcacacagtatccagtgggctgaaaaggagtcctgagcactcttttatctagtaaactttatcttcccccttataaatcaacttcattctctgatctgagttcctgtttcagtgtccctgcctaactctcagttcccttaatggcaatgaagctgcactgaaccttggtactcttggctggagttctaactctttgcctggtcctgatcagccacattcccacctcccccatctttgtcctcagtgagctggcttttctgtcccacattcttgtctagtagctgaagttgtgcttaatagagatcacaatgttactgtgactttaaatatgattttccatctggaattttgcatggctgtctgatatggactgggctagacctcttgacatcagtattatctgagggagaaagtccaggtttgccaactactctggacatagggctttcagttatccccatttgtgaagttattatactgatagcagtggccttagacctcaaccacttttattacagtcgtatctcagatatagccaagccttcctcaattcatgacatgctctagaatttatacctactagtatagatataaagaattggaaaagaacccagaaatcaacaaatccaatcctatctcttatcttaaagattaggaagaaagaggtctgaagaggctagatgacttgtctaaggttacacggtgatttagaggtagacatagaacctaggtctcccgattcctttcctgaggggtttcccaccgtgccacattcctttaaaatcccctgaaacataatgaaccaggtcttctaaactctcagggttggcttcagtaatctcttaagtcccatgctttccattgcagccccagatagttccccaggccaacagaagactattcatggggttttcaagcatggtagaaaaggcccattgtctctcaaccccagaacatccctctcttctgccaataagagccttgttcctgattcatgtgaaacatgaaacagccacccttaccacgctggcaatgtctgttgaagaactgcttgcagtagaggaagaagagccccaggaaggccagggtaaacaccactagcaggctgctcaccagtgcaacaagtgtggcctcctgagggggcactgtgggtgtatctgcctccactaagctcaactggaaggcacctgtgagacaaaaaaatgggggaggtcagttagcatgggcagtaaacagtcaccctgaccctggacctggacttcctcaggctgtcacccttctccctagggccttccccaattagggtggctatgctggttttacttctttctagagcaggcaaaattataaagaacaaggcaaaataatttgtatatagtgctggtatgtagaaattagtacaattaatcgaagatgcacatatcctgtgatctttctgtgccacatctaattatataatccagatcaatggaaacaagctaaaaaattcatcagtagagcacaagataaacaaatcatgatataatcctaaaatcttacattattatacagcacttaaaggcctttatggatcaatataaataatctagagggggaaaaaggaagttggagaaacagaacatatagcttgatatcatttctataaaacattatacaatacataacaatagcatatattggttatgaatatgcacacatatcacaaaagaacccaagtattaaaacattagtggagagtatggcagaggtatagtgctcaccagttatccacatactcccatgtatttcccttacacccttgcagtaaggccatcagagtacttctggccaatgaactgtgagttgaaataacatgtgtcacttccagactgaggcagttaagaaccagtatgtctcctccatctcttcccctgtgtcattgacctggaagacatatggtctagaatgcacagtcaaatgatgtaggaaggcctttgcatagtaaaaaaaaaataaacttttattgtataaagtcactgagattttgcagtttgtttgttactttagcatagcctaccaacagaatacatacaatttcaggatagtggttgtatctgaggaggtagggaggtaataggactctgagagaatctagaagagaattccattatatctgtggaatctttattcttttaaaacatctgaagcaaatatgcaaaatgctatgatttattaactttggatagatgctgggtgattgcattttaattttatatttttctgcacttaaaaatatttctacatgtttgaaaactttcatgatttaaaaaatatgtcaataattttaaaataggaagtaagtaaatagatggtagacaaaaaagatagacgattagataaatggatagtggtataggcatagattggaccctagttcttcattcagcctcttacaagtcctcagccctaggggctcctatatacttcatataataataatatctcataggtttacaaatattataatttgtgaagtgcttcctaacatccattttctcattagacctagatacccatcacacaaggtatgaagaaaaatgattatcatgactcacccttttttcagaagtaggaaatgaggttcaatgagattgaatgatttgcatagagttgcaaagataatatgttgtaaaaccagacttctaatctgattcccttgccactctactctacatgaaaaggtatgaggggatatgggtagtctttactaccctatcttgctgccacccaatgggatgaggagaaagggaagaagagaactgggtacacacattgaacctcagaggtgggggtctgcttcgtgcacgggatgcactcttggtcctgcaggcctccaatgcgtgtctttcggtagaacctgtgttcagagcaattaggaatggcagggtgatcaaacaagcaatgcacttggaccagttcttcctgggaaagcagctcctaagaatcttgccaacctgaaagtaagtgcccacccctctttctgagttatctgcctctgtgtctttttctgactcagagacccagacactctacttcttcccccattcatgacaccatgtagccaaaaggagacctaattccacaagagaggggtgcactgctttgataccaagtacatcataacttcttttaagtctacagtgagatttaccttgaactttggtcttcagctgagagtgatgatggaaaagcggtcaagtactcatctgtgactgacaatgtgctaagcactttatagaggtatcttgggaagacaccacttctctcttctgggagcttaaactgaatattatgtttataagaagaatatttcgactaagttctgagaggtgaggatgggagaaacctccaacagctagaaaagcccagacaagcttggtctcataaagcaagctcacctgggcaaacagtccccacagacagcattagaggtagctgtgcagttgaccttctgaacacgattgatgacagcacaggtgatgcaactctgacatctgtggtggccccagctgcttttgtacctgcgaggagggcaggctgtgcagtaggcatctccaccctctccataaccacaatcctgtagacagatgggggttgttaatattgctttataggagcttggagatgggatcacctgtgggacaagtggactgtacagggtagtattttgcaacttgcaaccccattactaagtcataaaaccaattcactagcttccagccagcattgaaagataaaatagaatgaaatagaataatagtatcaaatataagagtacatggaatgaagtaaagctaagtatttgtatcagtcagcataggctatgctgcagtatggcaaaagtcaaaccctaaatctcagtgtcttaaaagaataaaagtttatttctcactcatcatatttgcctaccagggggttcctgaggactctgctgtacatcatcctcaatggggtacccggggttacagaagctttatttttctgcttttatgattgaaacattgtgaactgcgtacaagctcttaaagttttccccaagaaatgacccatattgctttactcacatgtccttggccatacacatcacatgatcattaataactacaacaggtacaagaaaatgcaattctacaatgtgacagaatgtggggagctgaaatatttgacaaatagtcataagcactacccacataagtactgttttataaaagttttacagataaaatgcatgaaagtatatattgggttgtgataaaaagttatttcttactctaggtcatggtaaaaaatgtttgaatgccaatggtatagatgagaggcaaacactctagctggctcttgtctcagctctggtactaactttggccatattccttccccccgacccccagtttctgggcatcagaagtcccaacactgaggaaattgaaataaatgctctctagagattcttagatctgacagcctaacttcaacaggaacaaggctcctgcctgataccagtcacagctctttctcaaagaaacaattctagttgtgaaagcatattaattgtatgctagttgtagcagaagctggctggttgttcacttaacctattctttatttctcctgggaacaccattagccaaaattctttaaccccactgcaatgaagtgggggcatgtgcatcatttctagccaatgaaatatggatactaatattgtttgccattcccaggcttgactcaaaaacatgtcctgtgtgatacttaaattttcttcatacattcattttccagtgcatgctgacacccctggaaaccttggaataaatatattaagaatgatagcggaagccagataaaatggaggagtaggcagcttcaagctcttatgcccctacagaaacatagaaaaacaagcaggaactgtcataatcaatgttgtcagaactctggaaaacattcaaaggcttacatcaaccatgtaaatgttaaatcaagaaaaaggtcacttgaaaataataggaaagttttctgctatttttacttgtacttgttacatccctcaccccagagcagtggcagtcctaaagtagtggaagtcttaaagtagcctcagcctgtattcctagtgtgagacctcagtacctgattccagagtgagctaagcaaaacttattgacaaattactgtgtatgtctgtcctaacctatttgagggctatttgaaggactgatacaaggtatttatgtatgttccactcgattgagaatgcagattggaaaagtgatgggcactgtttcaaaatgttgcaaggcaaactaacaaaccacaatacctagggcaatgattatggattaagacataaaacagactgtctgaatctgggagcaaaagctgggggaggttcctttagaaataagtacattcaaaagtatccacatggaggaatttagaaaggtgtgtgcatacaagacacatgctcagaaaatactagtggagacctaaagcttacatgtcaggctgatccctaagctaagtgcacatctggctaactgtttaagtagttccccagcacagagccaatctaaaaatgtgagagtaatgtgtgactattttttcttttggttgttgttgtcattttttaacttttagcattcaatgaaattgctgtccaaacattagctgaacatgagctaaattaacataggtttcaatggcgatacatgacaaaaaatagtctctacaaaaatagtttggaaaaacacctaaacaaatggagtgctagcctaggcaacacggcaaagccttgttgccaaaaatacaaaaattagttgggaatggtggcatgcacctgtggtcccagctactcaggtggctgagatgggaggatcgctagagcccgggaagtggaggctgaagtcagcaataaccatgacactacactccagttggggtgacagagcaatacccagtcccaaacaaaataataataataacaataatgataataataacaacaacagatggactactatagccttcaacaacacaaatctagaaaacaaacaaacaaaaccaaaaccaaaagtaaaacaggaagaggggaaatctgactaccagagttacttcattacaatacaaaactgcccagtttttaacaacaaaaaaataaatcacacagtgtaaaaagaaacaggcaagtgtggcccattcaaaggaacaagaaaaagaaagaattgagactattcttgaggaagcccagacattgcacttagtagacaaagactaaaagaactgtcttaaatttgctcaaagacacacatggacaaagaactaaaagaaatcaggaaacaaatgtataaacaaagtgagaatattggttaagaaaaattgtaaaatggaaccaaacatgaatactggagctaaaaagtaagataaatgaaatgaaaacttcactagagaatttgagtaggtaaaagaaagaatgagcaaacctgaatgtaggacaatttaaattatcaagtctgaggagaagaaagtaaacagaacataaggaacttgtggaacatcatgcaggtgaccaatatatgcattatgggattcacagaaaaaacagggagatgggggacgagaatgaatatttgaagaaataatggcttaaaacttctcaaatctgatgaaagacataaattaacccatccaagatgctcaagaaactccaagcagagtaaacataaagagacctatgctgagatacactatcaaaaaatgtttatagctgaaaacaaagagaaaatattgaaaatcaagagtgaaattacttgtcaagtaaaggtattctcgataagattcaaagcatatttctcatcacaaagtgcagagacttaaagtcagtgagatgacatataagtgcctaaacaaataaactgttaaccaagaactctatatacagaaaaaagttcttcaaaaataaaggaataattaaaacatccctagacaaacaacagctgattgatatcatttgacctgactacaagaagagagtccttcaggctgaaatgaacagacaatggagagtaacccaaagccatgcaaagagtaaatatctctggtaaaggtgactgcatgaaaaaatatgattccacttacatgaaatatctagaatagcaaaatttgtagagacagagagtagaggctatcaggcactttggggagggggaaattgggagttattgcttaaggcatacagagactgtatttggggtaataaaaagtcttagaaataaaggggtgacggttgcataacattgtgaatgtgattaatgctgctgaattatacacttacaatgtctaatacagcaaatttgagattacatattttaccacaatcttaaaaatcataatgcagtataccaaaaaccatgaattgtaaacctaaatgggtgaattgactggtatgtgaactgtattttaataaggctgcttaaaaaacacagagctcccataagcctggcttcctgaatggctgagaagaatcttcctactccccaacatggattggagtcacattcaggaataaacccttaacctcttatgtcaccaaactttagtatttgttacagcagttaatattacctgaactaacatttaagttatactttcccaggagttggaaaaagtgagcatcaggcaggctcgaaatactccttccattctgccccatgtttgcccactcaggctttactcaatgccttgcagcctcactcacaatgatcccatctaccaatgggatctgacatgggcagtagtcattttactcatgctctaagtttcttgaaaagttaaagggtttcttggaatctctgctaccttatgtgcaccactggaatggtgatagcttccatatctgcttaaaacagtgagctgggggtcaaattattaggaaatataatgtagtgatgaaaatccctgatccaaggtaatgaagacctatctttaactcccacttttactactgaccagcgatgtgaccttgggcaagtcattgggcctgaattttcttgtcaatccaattggaaataatgctatccaacttatagatttgttaagattacatgagctgaccaaatgaacaaaaggaatatcccaaagcaatggagaatagctggctttttaaataggttatgttggataaccgaatgacaatgtgaaaaatgataaaatttgatacattcctcacactatacaccaaaatagatcagaaatttatagataaaaattaaaaccaaaaagtaccaaaacaaaatataaataaattcctctttaatctgggagtggagaaattttctctaactgcaacacgaagtccagaagcagtaaaggaaagatagatataattacataaaaattttaaaaagtttcagggtaaaagattcataagcaaaattagaagacaaataatgaactagtaaaaagatgtacaccatatcacagactaaagatttatattccgataacacagaactagtataaattaacgacaaccaccttatgagaaactaaacatatattcacagaaaaagaaacacaaacagctcttatttagataaaggatgtctcttaaccagatacacaaacacacacacacacacacacacacacacacacacacacacacagatacatatatagctctgtgtgtgggttgtgtgtagtgcttgtcaccatgcctagaacatagtaatccttcaatgaacagatgaacattaggtattgttcttctggaaagcaagtttttattctatctatagcactggaatcagaagatatgtgcctgactcctcacttactcacttgctagagaagggaatgacaaaagcaagctagcatttattgaaagttaaccaataagttgagtgattgattgattgattaattggttagcactccctttcattttattggttaactcagaaaacatttttgaagcaactacaatgcatgaggatgctattctgaatattgtgactaaataattgaatcaatcagacaaaaatccacacactcatgaatttatatacttgtttattcatcataaaaccttataagggtgcaatataatccatgtttcacaaataagcaaaattgaggcacaaattgttggcctgagaagcctcttccccatgggcctgcgattccccacacacaactagagacaataggctgcagggggcacttgagattccaccataagtaaccagctcaaatgcttctttgtcctgtgggtctgagattattttcccccacataggaacaggtggctggggtatactggcaagtggtatcctactaataacaagtggtcgagcatgggaaatgttctttgactctacaactcagacacttctttatgccgacctaaatggaccaagtgacctggcccaggaaatcgtctatacctgaggcagcacaagataaaccccgcagaccaaaaatcacactacaaaggttctggaaattaaatagcctttagaactgcagctcacaaacgtaggccaaaacctgtatgctaaacataaacagatgactgcctgctaaagtaaaagtttaaataggaccctgagtctcctgacataattgacaaaatgtccagaacacaacgaaaaaccacccatgataataagaataaggaaaatcacaacatgaatgagaaaagtcaattaactgacagcaactcttagataaagcagatgttggaatgattgaacaaggattctaaagcacccataataaaaatgttttaaaaaacaatttaaaattctcttaaaaatagaaaatctcatcaaagaaacagaagttttttttaaataaacagatggtaattattaaaaataaaatgacagaaattttaaaaattcactggatgggcttagtagtagagaagagacagatgatagaatcagtgaacttgaggacagaacaacagaatttatgcaatatgaacaacagggagaaaatgacaaaataaaatgaacaaagcctcaagaacctatgagactataacaaaatatagaaaaatcatattgtcagaatcttatgaaaagaaaattttttaaatgtttatctaaaaatattttcaaacaaattggaagaaaacttcacaaatttggtaaaagacctacaagttaaagaggatgaacagatcccaaacagaaaaaaatccaaagtaatgcacaccaatacacatcataataaaacttctgaaaactaaaaaaaatatattgaaaatagccaagaataaatggcattacctatagaaaaacacccattcaaatgatacgacagtgggtttctgtcagaagccatggaagccaagaaggaagtattacatttttcaagtactgaaataaaaaaactgtcaactgcaaatttatatccagtgaaagtatccccagaaatgaagggacataaaaacattctcaggcaaaggaaaactaacagaatgagttgctagtaggcctacccttaaataattctaaagagagttcataaaacacaaatgaaatgatttaagaaagagtggaagtgataaaagaagaaatcttggagcatcaggaaggaaggaacactgggaaagaaaaaatatggttgtataaaatgtactatctttctcttcatacattttataaatcatagtagatgactaaaacaaatttaacaaaaattatatctgatattcgtgacaatgatatttaaaagtggggaaagtaaaggaatctaaatggaacagatatttcaatacttcacttgaaatggcaaaatgttgataccagctgacattgaaaaagtaacgtgttagtttttcatgtaatactcagaaccacctctaaaaaaatgatacaaagagacacactcaaaaacactacaaataaatcatgatggaatcctaaataaaatgttcatggaacccacaggaaggcaagaaaagacaaatagagggacaaaagaaacagagaaaacaaacacaaaaagaataaaatgttaggtttaaatcttaaaatatcaaagattatttaaacataaatgttctaagtaagccaattaaaagacagggattggcatagtgaaataaaaccaaagactatcaaattgtactcaataaaaattaaataaatgaataatttttaataaattaaggagcaaattatcattaaaaatttattgagaattctccttcataattaggaggcaaaggaagttctttcaaatcattaaggtgcaaaatttcttttgctattaaccacttttatagccagaaaacattgatattcttgattttgccatggtagcacaatgctgatccaaaattttgatgctgatagtgttacaataataattatttgttttagttaaaatactaacttatacaacataaaagggtatttaccttaaaactataatcaagaatggtttatactgggaatgcaggatatttaaattttaggaatttattaatacatgtcatcaaattaatacatcaaagggaaaatatatttacaaatcaacagatgatactaaaatgaaacaaaatttaaaagcatttctggtttttaaatacaaatatacttacattttaaacgatttttaaaatactctgttatctactatatgtctgtctacttaggttccttatgtgagtagacaaagaacaatacataatgaatagaaagaatagaaagagaaacaatcagaaatagatcacaaaattggaaaggcaaatgggcaaataaacacagtaaagttggtacatttcccctatcaaatagataaaaagtaaaaccaaaattctcataaagtcctcataaattagtaattactgttaaaaggaaggcataaaattaatagatcatgaaaatatctattattcatttgcgtttaggcttctgggacatgggaatttgttgtgggaagtcagggaccccgaacagagggccacaacaggaattctatgcactgttgaaaataaatgtaatggtaatagaaattagtataaacaaaattcagaagtgttatctgctgatatatttcaagagtcttaaaatcgtacgcattatttagcttggcaattatacatcaagaaaaatgtcctgaggaaatggtgttaattttctgcaatgatttatttacagtgatgtttataattcatgagtaaaatttaaaagtaaataaaagttactttaaaaaaggctatcagatgcttctagctgcttattcaaacaattgcccctcttcttccttactataaaaacactgatttcattctaggtggcatgaagactagcctccagaacggattcttgattggtcttaatcacacaatcccattctcattggccagatacttatttcccagtctctattccagctaaagatagctacatcacccagttctggaccataagatataaggaaaaatctgttggacagcttctgggaaaagacttcttccctacaaaaggcaagctattttgaccttgcccctgattcctgactttgactattgtatggagatatgatgctttgagttttgcaatcatgaggccacaatgagaacaaaacagcaagatgtccaatatgaaggatgaaaagaggctgagtccttgataacattgctgatctgcccaacaagcaaaaaggttgcctgtctccagacttcattacataaataaatatacttatggttcatgtcatggttaaattttatgttactttcaacttactacatcctaattgattctgaggtgaaataatttgcccagagcaaagatgggactcatgcccatgtgtatctggctctaaagcttatatgtattacacatatataagctttaatatctattttaatgtccagcatgaccttacctctggcgatctttccttggtactgggatcctttatcaaccatgtgggtaccccactgtgggacataatgccatgtgtaaaaacttagaattagtgcttgtatctcttgatatccctgcgccttattctcttcattttttaaaatacaaaggtaggaataaagtgggctagataattattatgttgttttccagccacagattcctataactttccaacccaaaaccctccaaagagctcctaatgcacttagagaaagatgaaaatttctcatagacctcaagctgctatctggtctggtctatacttctctctctgacctctttgtgtactaccctccctctcattcaccatacacccattgcactaccttcctccttttccttcaaaatgcctagttcattttcaccttgggactctgcactagtatcctctccccagaggctgtctccttagggagacctttccttgtttcataatctgaagtagccacccagtcaccctaatttgattcttctcatatcttcatatccagattcttcatttatctctgtatgtgtctcaattattattttttcactaataatagaaggtaaggtccatgaaggcaaatatttttgtttgttctgccatatccatggtgtctacaaccatgcctgccactctgcaagtgttcaataagcaactgctgaataaacaaaaattgcataaaatagagtgtgaatatgcagaaaccatctgctagctgcttgcttctggcctctgtagccccagctgcagccaaaatttaataccacccccaagttcagggacctacaagggacctgaggaaagaacaattaagcagatccaggcttgaaacaagtaagttacataaagtctctgccttgctggtcattttattctgatccttatctttaattgggattttagaccctccgtggttccctatccctatattctccattgcacagcttcctcagtagcgcagaccctctagaacagaggtcttcttggctcttctctctttctcattcctaagacctgatatctggctcttgaacaccatgtggttgggccttgctttagatgacagattaccctaatgctgaacagtcctcatgggtctctgcattacacatctattcttgaaatactctgttatctcatggaaacttcccttgaccttgatcctgctaggctgacttcatgctggaatcatgactgctattgcatactctgtggatcccaggttttacccgctgaactggatcagtcataagtagggctgactcccctaatcttggcctctttcagttgccgggctggttcctaagatgcaacagaaataagtgtactgaataggataacttaccttggatagctcctgtccaggaccacaccgttggcaggtgacacaccgtccccattggtcccagtactcattttcttggcaatccatggtgggaaggctgtgggtagagaacacaagaactagcaagctagtgggaagggactataagtagtggcttccatgccacttggcttctgggtccccttaatctattctctagatctgagatagtagggacgaggaagccaacacaaaagagttaatgcttatgtagctctgaccatgtgccatgagttcttgtaaatgctttgcatgtagtaactcattccattctcaagacaatcatattaagaattattgttagcaacattttacagatgaagaaactgaggcaaagagaccaagcaatttgctcaaattcacagtcagtggctataccaggagctgaatttgtaaagagagtaataagacaaggagttggcttctgcccagggggtaaagaataatcacaatccctcatgtgtgaacagatcataacaatttagaaagtactttcacatctattattatttgatctacacaacatccatgtgaggtaagcattatagagattgtcatctttattttataactgaaaaagctgaaacattgtttctctttgccaacagtggcctcagtacctctgaggaccaatacctgccatagcttctgtcttaggcagaatgggaggggagaataacccagaatgtagacatattttggtgcacaaaggtgcacagatagggaaacattactcagataatagttcttggaatacagatgcatatagcagtagagctagcattgaagtgggatggctgttcaccaagcctggctcttaccctttcaatctacaatctgggatggatcactttatcttttctggcctcggttacttaatctaagaaaaagggatagaatgttcttcacctattgtatatagctcttgggagggttaaaggagctaaggtccatcaaaccattctaaagagctatacaaaataagacagagttaagtatgcagaaaggttgtcttctacaaagaggaattttaatgaaggggctaaagtaattcataaatggggcttatcctactcaaagagaaaggtagcatgaggttctttacttactcatgacttcatactagggtgaatttcaagtggtttctaaaagtgccaaagtcctaaatgtgtactcttagtcagaagagacgagagtgtacatgtgtaccttgagaggccaccactcctccactcaaagttccccaaaagcgacaggttaagtcattctaaatggcattccataagtgcacctttttttcatcatcaactgggccattctttcccattccttcattcaaaggaaagtgggctacaagatccatgcttgcataagataaacatactgtcttctgtgctgatttgattgctggcccatggtgttggcctcagtaggcatgcttccctccccttgccatgcactcttctccttgagaacagaaaacttcagtattctcatagccttcatgaccaggaagttaagcaccacagtaacagggccaggaaactgctctggacaactttctcatatccctttttgcccacaaaacagaaaaacattggcaggaaccaagaagtagccctctttttgagctaagttcccaacataggcgtttaaaatctccatgacaactgctgctggcatttgagggtctgagacatcctatttcatttggtttctagagctccacccccctaataaacatcatgtgtcctaaaccccaacatgtctctctaaccatggctttgaaacctctgtctaggcaaggcaggcttggtgccaaattgagcagagggactttctctcccctcttttttccctccctccctcccttccttccttccttctttccttccttcctttcctcctttctttctctctctctctccttccttccttccttgatggagttttgctcttgttgcagtgcaatggtacagtcttggctcactgcaacctctgcctcctgggttcaagtgattttcctgcctcagcctcccgagtagctgggattacaggagcatgccaccatgcccagcaaatttttgtatttttagtatagacagggtttcatcatattggtcaggctggtctcgaactcctgacctcaggtgatccacccgcctcggcctcccaaagtgctgggattaaaggcgtgaggcaccttgcccagccttccctctttttttctcatactatttattcaaagcatacaaattaaattatctttcattcgacgcttaacaaattgactttattaaagagaacaaaattatagattctggactcttttgaagaggtcagggcgtatgtgtaaaactacctaataagggttaaatgtcattacctagggagaaagtcagaccttatatgaatttttccctgtaatcaacagtttcctgtagcatatgtaaccgccttttaaaagaaaaaataagaaagaataattatgttttcagaaaattatagttactctgaggtattccatactgcagctagacactcttccaaagtatcacaaaggatgtggctgaatcctctaaacttctggctaagttggcaatatatacagacctataaagttcccaagagtagagaccactgcatgcccagtgcctagccctgcacctggcacagagtgtgtacctcaacagtgcttactatttgttagcttatcaacatgctacattccctggactatggttaactatgcatatgaatctagcaacatagatcatttctctttaagataatgactttccaaacaatagtagtaacctcacatccatcaaaaaaagagcaaagctcttagttagggacatgtagacttgagttttaattttaattctgcatcctcaaacaaatagttttacctttgtcagcatcagttttttcatctgcaaaatggatgtttaaataatatactgcacagtaatttagaaaattaaatgcaataatacatattaagggaccaagtatagggcttgatacatatgagacgtttggtaattagcaggttccctttcttctttcctcttcagaagagtgaggtttatagtaaaaggagtgcacatttgtcatttttgggatgtgtggggaagaaaaaggaaaggcacccaagcttcttcattgaccatttcagctggagcatgaaggccatgtttaagatggatgccactatagcagtttcctcctcattaatcgcaaccaccagtgacctgatgcttaaggaaaagattctccaagataccctcagtgcctaagccaccttggctaaaagaaacattgttctaagtgtttgctggatttttttcatcaaggcatttctgtataggattaacttggtcaacaaacgtttggaaacttttccgagacaattgcctttgaaatggaagtgaaaaagaaataaaatcagatttgcaaataagtgaggatgttattatggactttatgaaatagcacatgattttccacagaacagtccctctcacctccacaacctaaggttatggctgctcaagaacatttttttcaccccaactctgacatggggttgtgttctctttacattactgagggttggggagaggaagggaagtggcagatgcctcttgtctcaatcccatggagtataacacatgatgaggttctgattctgctaaagcgcatcacccactcagttgtactgtttgtcagctacaccctgaaatacttcctccaacttcccaacttgcccagagaatatctgatctgtgtaactcagaagttacacagatgaggtaatgtggaagtgctctaaaaattcatgtgggtaacatgctgggattttttgtctgtttctgattgcagtacaacatatacatagtaaggagcataaagattaaataaattaataaatttttactgtgtacatgcccatgtaaacaccacccaaataaatacacagaacttttctattaccccagcaggctccctcacgccccttcccagtcaatatcgactcctccccagataattacagcactggcttctatcactacaattagttatacctgtccttgaaattcacataaatttgaatcatacaagatgcgctcttctgtttctggtttctcttgataactataatgtctgtgatagttatccattatgttttgtgtagcaacatttgttaattactattgttgtgtagtatcctattgtatggatataccacaatttatatatttttcttggcaaacattggactgcttttaatttgaggccattataaattgagttgctatactatggtcaatggattttttaaagaatgccaagaaaattcaatgagaaaaaaaatcttttcaaagaagggtgttggggaaactggatatccacatgcaaaagaatcaaatcggacccctacctcatatcatatacaaaattaactcacaatagactaaatccccaaatgtaagagttaaaactataaaactcttataaaagttttcttacaagaaaacataataattctgtaattaatgtttttcttataagaaaatataggtgtaaatttttgtgacactggattaggaagtagttgcttagatataacaacaaaagcacaagcaacaagagagaaaaacagaacaatgacatgtcaacaaaatttaaaaattaaaaatgtttgtgcttcaaaggacaccatcaagaaagtgaaaagacaatccacataataggacacaaaaattttcatatcacatatctgataagagacttgtatctaaatatatagaaaactcttgcaactcaaaaaaagatagataatttaaaaatgagtagagaatttgaatagatatcactctaagacttacaaatggcccataaacacatgaaaagatggtcggtgttatcagcaacaaagggaatgaaaatgaaaaccacaataaaacagcactttatatccactaccaaaaaaaaaaaaaaaaaaaaaaaatagccggccaggcacggtggctcacgcctgtaatcccagcactttgggaggccgaggcaggtggatcacctgaggtcaagagttcaagactagcctggccaatatggtgaaaccctgaatctactaaaaatacaaaaattagccggggatggtggcaggcacctgtaatcccagctacttgggaggctgaggcaggagaattgcttgaacccgggaggcagaggttgcagtgagccgagatcgtgccattgcactccagcctgggggagaaggatgtggagaaactggaacccttgtgtattgctggcgagaatacaaaatgatgcagcccctttggaaattaattttgcagttcctcaaaatgttaaacatcatgttacaacatgacccagcaatttcactcctaagtgtaaatacccaaaagaattgaaaacatgtgttcatacaaaaacctgtaaacaaatgttcctagcagcattatttataatagccaaaaagtggggaaaatccacatgttcatcaactgataaatggtaaacaaaatgtggtttatccatacaatgaaaattattcagtcagagaaaagaatgatgtgcttaacatgtgcaataacatgaatgaacgttgaaaacattatgctaaataaaagaagctagacacaaaaggacaaatgttgtatgattctatttacatgaaatgtccagaataggcaatcaatcataaactagctttagtggatatcagggcctggggagaaagggaaatgggaagtgactgctgaataggtatgtttctttctagggtcatgaaaatgccctggaattagacagtggtgacggtcgtgtgactttgtgaatatgctaaaactagtgaattatacactttaaaaaggtaaatcttatagtatgtgaattatatctcattttaaaagatggttctttagctttatttaatactttgaatttattattccaataggatattgcttaagttagccccccaaaaaatgttaaagctgctatgaatatttttacacaggcctccaaatataatttgattcatccaacttctcacccaaacttatccaagtatgtgttgtatataccttgattgtgtttacaagggccaacaagtggcaatatgactagaattattcccttattttgcctgtctgtcatgtggctgctcttcccacccatctccctgtcctgattcctcaaaaaataatgtagacgattaagaatgcaagcagacagggaagaggagaaacaatacagctgacatcaatagtaatccccaaattagctcatcatgccctgaataattgatgttggccaagtttctgctggatgtgaggtacccaggctgctgggggtgcagctgctccttgctgcagcttgtggctgctgctcttctcaacttgcacacatgcctgtggggtgaaacatgctctctctatgtagtatgggtaggcaggaaagaaggacaagtctaaattaagaactcagtacttcaggatatttgctttgcctggacagtgcaggaggtgtgggattaaaaacgatgaagaagacagcagatggtctccatgccttgcccattcctctactgcgagcccatctatccacccacatgcacaagacagaatcaaagaagttgctcaacgtagccttgagaacactgctttcttgaaaatcaagcttctaaactgtacagtgccatcatttccagatgcctggcctgtaattcaaatgttgctttaccttttggtgttggcactcagcctttcccttttctgaactgacccaaggccacttctatccaaggtttatcttgtttataacctccttccaaactatcaaacatcatatcttccttctgccccactatttgtaaagtttgcatttcctgttttagctcagcatagtgaatggtcctagtcccagctctgccatcaggagaatatcccttcccaatgctggaatcaagttctccattcataccacgagggagttggtttggctaatctcttagaccagtggttctcagtcttggttgcaccttgggagtgccaaaaaatagtgacacctgggtccctcccctaagattctgttgtagttagtcaaaaatgtggcatgagcacgctacattttacagttcaccaagtgattctcatgtgcagtcaatgttgaaaatcacagttttaagggctcttttcttttagttctgaccttgtctgtttcacctgaaaataaaatgcagtcagaaaaaaaggtttttctgtatctctcccccatattcagagagaatctgttgagggagaaacccaaggtctatccatttttttctagggagaatagaaaataaagataaaggggataaaacatgttagatcatgtcatttccagcctcaaaagccattgatggctccctctttcactcataatatcacataagtcctacacagttttggatataacttaaaaaatgaatgggtatgtaaaaacataaaatatacacagtgatgtatggcatataataaagagctcatattttaaaaaattaagttcttataatggccaatagagaccttagatgatacgcctacctcaatttcccccattatttattgaccttaagttctactactcttttccttattgtcttcactccacccatgctggcctccttgttgaacttcaaactaaccagaaatgccttcatcttaaggccttcacatctgctgttccctcaagcaggaatgttcttccccagatacctgcatggctacttccctcatcttcttcagttctttgttcatatacagtcttcttagtcaggcttccctgaccactctctcaaattttcaccttctttccagaattcctatccccgtttccagttttattcttttccatagcacatatgaccttatgacatatcataaatcttatgtactttattgctttttcttccccagttagaatgtaaatgctatgaggccatggtacgtattgtgtttgctacttcatcatcagtgcttacaatagtgcctggcacacagtaggcattaaacaaatatttgttgaatgataaaatggtgaaaatctacagaatactgggaatactctcctgtctgagtaaaaggtttcatagtttataaaggattttacatcgattagctcaacagatcaccatcacatccctaggaggaagctagggattgttatcaaaaattaataaatttgggcaggtgcagtggctcccgcctggaataccggccctttcagaggcctagatgggtagatcacatgaggtcaggagttcaagaccagcctagccaacaagatgaaacctcaattctactaaaaatacaaaattgagctaggtgtggttgcatgcacctgtaattccatctacttgggagactgaggtacaagaattgcttgaacccaggaggctgagtttgctgtaaaccaagattgtgccactgcactccagcctgggcaacagagcaagactctgtctcaaataaataaatgaataaatacattaaagaagaagatcacatgatgaggaaggaacagacagatctgagatcttgctcaagatctcagtaaagaagtagagctgggggatcatcatggcagacgggaggcaggactagattgcaattccaactcagatggacagagcagtgtgaggaggtttgcatcgtgcattttagctccaggacgactgcaagaacaaaccagggatctcgagaggacctacagacactcttaggaagtggactgctcctgcaggacccaggagacactccaaatactttgagcactccaacagcagaagtgggaaagggagatcctccattccttaacacacacccacactggggaaacacttaacacactggggaaacacactggggaaagtctaatttgcaggagaagtttctgactttacctggagctgagtcaatttagagagctgagcaaaatacaggggtagaggaagcagcgggaaaagccccgggagtttgctgggtccccaagcaggcctggaaccacagggaaccttcagaagggtcgccagaggcacaggggaaaatgccacggggaaaaggaagtctccagctgaactttgtaacaatttgaaccagaagagaagcatcctggccagaacttggggtagggcatgaatctggtgtggagactctaaaggagtgggaagaaccaaagcccttttatttcacagctgggaggtgggtaacctggggcaggttctcaagccctactcacccattgcctggaaacagacttgggactgttatgggagcacagtgggagtgagactggccctttggattgcatgggagctgggtgaggcctgtgactgccagctttgacccacttccctgaccacctgcatgactcagcagaagcagccataatcctcctaggtacacaactccatggatctgggaacctcacccccacccacacagcagccacagcaagacctatccaaggagagtctgagctcagacatgcttagctctacccccacctgatgggccttccctacccaccatggtagctgaagacaaagggcatatactcttgggagttctagggccccgtgtactactggttcctctccatactaccaaagctgatgctctctgaaaagcaccacctcctggcaggaggccaaccaccacaaaaatagaacattaaaccaccaaagctaagaactgtcacagagaacatttcatcccttgacacctccaccggaacaggtgctggtatctacagctgatagaccaatagatggttcacatcacaggactctgtgcagacaacccccagtaccagcccaaagccggatagacttggtgggtggctagactcagaagagatataaaaatcactgctgcttggctcacaggaagccacatccataggtaaagggggagagtactacatcaagggaacaccccatgggacaaaagaatctgaacaacagccttcagccctagaccttcccactgacagagcctacgcaaatgagaaagaaccaaaaaaacaactctggtaatatgaaaaaacaaggctctttaacaccccccaaaaatcacactagctcaccagcaatggatccaaaccaagataaaatctctgatttacctgaaaaagaattcaggagattagttattaagcgaatcagggaggcaacagagaaaggtgaagcccaatgcaaggaaatctaaaaaatgatacaagaagtgaagggagaaatattcaaggaaatagataccataaagaaaaaacaataaaaacttcaggaaacaatggacaaacttttagaaatgcaaaatgctctggaaagttcagcaatagaattgaacaaatagaagaaagaaattcacgactcaaagacaaggtcttcaaattaacccaatccaacaaagacaaagaaaaaacagaataagaaaatatgaacaaagactccaagaagtctgggattatattaaacaatgaaacctaagaataatcagtgtttctgaggaagaagagaaatctaaaattttggaaaacatatttgtggcaataacagaaaaacttccctggccttggtagagatctagacatccaaatacaagaagcacaaagaacacctgggaaattcatctcaaaaaaaatcattgcctaggcacattgtcttcaggttatctaaagttaacacaaaggaaagaatcttaagatctgtgagactggaaaggaaaggaagaggagggaaggggaggggaggggaggggagaggaggacaggggacaggaggagaggagaggggaggggaggggagggaaagtgtaaaagcaccaggtaacccaccaaggaaaacccatcagattaacagcaaatttctcagcagaaaccctacaagctggtagaaatttgggccctatattcagcctcctaaaaatatacaactatcagccaggaattttgtatccactgaaagtaagcatcatatatgaaggaaagatacagtcttcttcagacaaacaaatgctgagagaattcaccactaccaaaccaccactacaagaactgctaaaaggagctctaaatcttgaaacaaattctggaaacacataaaaatagaacctctttaaagcataaatcacacaggacctatcaaacaaaaacaaaatttaaaaataacaaaaaagcaagatacacaggcaacaaatagcacaatgaatgcaatggtacctcacatctcaatactaacattgaatgtaaatggcctaaatgctccacttaagaaatacagaactgcagaaaggataaaaactcaccaacaaattatctgctgccttcaggacaatcacccaacacataaggactcacataaccttaaagaaaagggatggaaaaaggcatttcatgcaaatggacaccaaaagtgagcagaggtaactattcttatatcagacaaaacaaactttaaagcaacaacacttaaaagagacaaagagggacattatatcatcatacaagtccttgtccaacaggaaaatatcacaatcctaaacatatatgcaaataataccagagctcccaaatttataaaacaattactaacagacctaagaagtgagacagacagcaacacaataatagtggcgaacttcaatattctactgacagcagagatagacagcaacacaataatagtggtggagttcaatactctactgacagcactagacaggtcatcaagagacaaagtcaacaaagaaacaatagatctaacctataccgtggaataaatggaattaacagatatatacagaacatttcaaccaacaaccgcagaatacacatcctattcaacagtgcatggaactttctccaagataggccgtatgatagggctcaaaatgagcctccataaatttaagaaaactgaaattatatcaagcactctgtcagaccaaaatggaataaaactggaaatcaactcaaaaaggaaccttcaaaaccatgcagatacatggaaattatataacctgctcctgaatgatcactgggtcaaatacaaaatcaagatggaaattaaaaaaattcttagaactgaatgacaataacaacacaacctatcaaaaggacacagcaaaggtggtgctaagaggaaagttcatagccttaaacacctatatggaaatgactaaaagagcacaaactgacattctaaggttgtgcctcaaggaactagagaaacaagaacaaaccaaacccaaacccagcagaagaaaggaaataaccaagatcagagcagaactaaatgaaattgaaacaacaacaaaaaaaaacacacgaaagataaataaaacaaaaagctggttctttgaaaagacaaataaaattgatagaccattagcaagattaaccaagaaaagaagtcagaaaatccaaataacctcattaagaaacaaaatgggagacattaggactgacaccactgaaatacaaaaggtcatttcaggctactatgaacatcattacacacataaagtagaaaacctagaagagatggataaattcctggaaaaatacacccccccagcttaaatcaggaagaattatatatcctgaacagaccaataacaggcagagatactgaaatggtaattaaaacattaccaaaaaaaaaaaaaaatccaggatcagatggattcacaactgatttctagaagacattcaaagaacaattggtaccaatccttttggcactattccacaagatagagaaagagggaagccaccctaattcattctatgaagccagcatcaccctaatacctaaaccaggaaaggacataaccaaaacagaaaactacagactaatatccctgatgaacatagatactaaaatcctaacacaatactagctaactgaattcaacaacatatcaaaaagataatccaccatgatcaagtgggtttcataccagggacgcagggatggtttaacatacacaaggcaataaatgtgatataccccataaacagaatttaaaacaaaaatcacatgatcatctcattagatgaagaaaaagcattcaacaaagtctagcatccctttatgattaaaactctcaacaaaaccagcatacaacagacatacctcaatgtaatgaaagccatctatgacaaacccatagccaacataatactgaatggggaaaagttaaaagcattccctctgaggactggaataagacaagcatgcccactctcaccactcctcttcaacatagtactggaagtcctcgccagagcaaccaggcaagagaaagaaataaagggcatccaaactggtaaagaggaagtcaaactgtcactatttgctgaccatatgatcatttaccttggaaaccctaaagactccctcagaaagctcctagaactgataaaataactcaacgaagtttccagatacaagactaaagtacagaattcagtagctctcctatacaccaacagtgacaaagtggagaatcaaatcaacaactcaaccccttttacaacagttgcaaaaaataattaaatacttaggaatatatctaaccatggacgcaaaaaacctctacaaggaaaactacacaacagtgctgaaagaaatcatagacgatacaaacaaatggaaacatcccatgctcatggatgggtagaaacaatattgtgaaaatgaccatactgccaaaagcaatctagaaattcaacacaattcacatcaaaataccaccatcattcttcacagaattacaaaaaaaaaatctaaaattcatgtggaaccaaaaaagagcccacataaccaaaacaagactatgcaaaaagaacaaatctggaggcatcacactacctgatttcaaactatactataaggccatagtcaccaaaacagcatggtactggtatataaataggcacatagaccaatggaacgaaatcaaaaacccagaaataaccccaaatacttgcagccaactgatctttgacaaagcaaacaaaaacataaagtgggaaaaggacaccattttcaacaaatggtgctgggataattagcaagccacatgtaggagaacgaaactggaatgtcatctctcacattacacacaaatcaattcaagatagattaaggacttaaatctaagacccgaatctataaaagttctagaagataacattgaaaaaacccttcgagacattggcttaggcaatgatttcatgaccaagaacccaaaagcaaatgcaataaaaacaaagataaatagccgggacctaattaaactaaagagcttttgcatggcaaaagaatcagtcagcagagtaaacagacaaaccacagggtgggagaaaatctgcacaatatatacatctgacaaaggactaatatccagaatccacaatgaactcaaaaaaatcaggtagaaaaatcaaacaatcccaccaaaacgtgggctaaggacataaatagacaattttcaaaaaagatatacaaatggccaacaaacatatgaaaaaatgctcaacatctctaatgattggggaaatgcaaatcaaaaccacaatttaatacctcctcactcttgcaaaaatggccataatccaaaaataaataaaaacagtagatgttggtgtggatgtcgtgaacaggcaacacttctacactgctggtggaaatgtaaactagtacagctgctatggaaaacagtgtggatattccttaaagaactaaaaagaatcatatatatatatacacacacacacacacacacacacacacaaacacacgtatatatatatacacacacgtatgtgtatgcatatatacatatatacacacacatgtacatgtgtgtatatacgtacatatatacacgtatgtgtgtatacatacatatatacacgtatgtgtgtatgtacataaaaacacacgtttgtgtgtatatatacatatacacacacatgtgtgtatatgtatatatacacatatatattgatgagattcgagactattattcttagtgaagtaactcatgaatggaaaaccaaacactgtatgttcccactgatatgtgggagctaagctatgaggatgcaaaggcataagaatgacacaatggactttggggacttggagggaaggcagtgaaggggggcgagggataaaatactacaaatagtgtgcagtgtatactgctcaggtgatggatgcaccaaaatctcacaaaacaccactaaataacatatccatgcaaccaaataccacctgtatcccaataacctatggaattttttttaattaatagattaaaaaatactgaggctcagagggaaaatatacaactatctttatttggctagcaaaaagcaaggcagaacccaaaggtcatttagaagctatgagtctggcacacttttcaaggcagtattgaactctaaaatagagaatggaggtcctcccagtcttcactgaaattttttcttcagtgatatttcaggatgggcaaaaaagcattttattaatgttaacctgagtgcattttaaataatggtttgatagggttactgcccaagctttaggagacaagggccaggtcaaaggtggttacaataggaacagagaggaatgatggtgggagatacaaaccttacaaagtgaagacaaacagaatgaccagagttagagattctgggagtttctgcctgggaaaccagaagaatctaagtgccatgagaagcgtgaaaggagcgcagcttggtaaaagaaaagaaaatgcactgtttttcaattattttcagtatagagaagttgaaggggacagaggaacatttcagtggtcatgcccaacaagcatatacaatatgtaaaatataagttgaagttggagatgtgtcaaatgcataaaaacaccagaataacagttcttgcttatggctgcacatcagaatcatatggagcactgaaaaaaaaatcctacgctctagattaattaaataaaaacctctggggttggaataaccactggccgaagtaaatcatggcagaagttaaatcatgggtaaagaagaatggctggatgcagtggctcctgccggtaatcccagcactttgggaggtcgaggcaggtggatcacttgaggtcaggacttcaagaccagtctggccaacatggcgaaaaactgtatctactaaaagtacaaaaattagccaggcgtggtggtgcatgcctgtagtcccagctactcgggaggctgaggcaggagaatcgcttgaaccctggaggcagaggttgcagtgagccgagattgtgccactgtactgcagcctgggtgacagattctcaaacaaagaagaagaagaagaagcaggaggaggaggaggaggagggtgaggaggaggagaagggaagaaggaagaaagaaggaagaaggaaggaagaagaaagaggaagaagaaccaaacattgagggtcactcatacttgaagctggaagaggaggaatacatgacagcaacgaagaaggggaagccagagaagaaaaaaaaaaaaaagaaccttgatagagtagaataggacaaagctttaagaagtaagggatgagtaatgtgtcagctattgatactgggacgtggaggaggccaggactgaggatgtgtcatttttattttatttcatgggcatgtgataaaagtaaattatctttttgtgtttaagtatactaaaatctgtgcctggaatagacataatgtagagaccacaggtgggtactacagtttttaatgggctactttcaacatttccaaagtggctgaagaattttaactgttagtgatagcaacatctggcccagcaatgtcaggaatagtatatcaacagaggagaatgaacctgcgcaaaattaaagaagtctcatctattctcctttgtcttttattctagcgcacagagcaagaggtaaagccccagctggggaagaaaaagaaaaaaaaatccttactaaaagctgttgtcattgtacagacaaaattaataaccaactgaactgggctacttccacttggccaaaagtaaatgctaaccatatgagtcaattgttttgccttcaaaacatgcgtacgtgcacaaagacaacaaacaaagcacaaacctcaaaagacaaatacaacttagcagactgtaaattaaaaatataaatatttggttagtgtttggcaactgctgaaaaataattgttaaacgaatggggaaaagagactgtgtagccaagaatacaaagataccattataaaagaaataggatgaaattaagaacagcaaactctaggctgattttgagggaaaacgttcttctactgactgctaaaatactcttcccaagtgggagcaaaagcacagaaactaccctggattatgttcaagggtaaaatgagataatgtatgtgagagtgctgtggaaactccagattgtgctacgtatgtgaggagttgctatgattgttgttactatcccacccagagctggggaacaaagggtattggagacaagccccaagccagaccggcactcagctaacacctgaaacctcttgctttgctctgctgttatcctagccaaagtgagtcactggtcatgtaccaatcaccacaagattccataaaattacggtataataaaaaaattagttactcaaccagcagtactggaaggggagataagctgacttcccaagaaggcttttggctgagttgtcccagttgggtattgaattcatggtatgatttatttgcaggattgggactggataaaactcagtcaagtactccaatttctgatttctattaagtttgttggtcttgccccacactccctccaccctgtcccatttaccaagcaatctggaatagctgtatctgaagatgtcaacaagaacagtctctttttttttcccatggcaatcaagtactccatcccatcctcataggcctgggaataaaatatcctaaaggagcagagatacaaaccagtgggcatttacaagcccaacccaggtccacatccttaacaaaggactggaagaatacaatgagaactatagaatgaggcatgtctgtacaaaatgaaatgctgctgccaaaatatttcttcattttttctttagatgtccaagaaaagggagaaaggtatagtactttgtgaggttgtggagggaaggtgagactgataacaagaagcctatgacctcatatgtaaatgcacattctttgagaccatttttagactctgacaatcttagagtcaaagggaggtttaaaattaatcttagtcccagtggccttttgcccagtaaagaaataccatccagctctacttgaagtcctttagtaacaggcacctcagtactcataagacagcacattccatcatttgttttttttttcctcctctttggcaaccagttaaaacttcaagctatcagataattgaaaacatatagtcatgggatcctaaaagtattattcaggacaacttaaccccattccctgatgatctaagatgaggaaactaatgctcagaaaagggatagaattttcccaaagtcacacagtggtcaatggtagagctaaaagtagaattcaagtctgcatattcagggcccagtggcttctctacttcccatatacgaagaaaggagttggcccagctttaggaccaattactcagtgactatactaccaaggctccagcttctttttcctaactcccacagcccaataatggctcattttatcctcaacagaaacaattccaaagggtgggctgggtcatggagaggtggatcgtagaagggaagaagtaatgcccactctttttggcttaaccacaacggtgactaacaatctcctggaagtaggacatctcagtgtctgattccaccatatattacatggaaaatcctttatttttgagaatagcatgatgtcttttggtggtgtttggaagatataataactgttgtcatcccaagatagggagaattaatttctggtcactcagcaaccacttgatgagtactttctatgctaggcattctattagaacttagtggcaagagaaaaaaacagaggtgaataaaccatattctccaaatttaggagattgcagtctggtggggaacatagaaaatatatacagtaaactctaatccaagacaaagtatagccatcctcatatctatgttcacaaaataatagtagtcgtattttacatactgatggtgaaacttacccatatctttcctgttaagctcccaagaagagaatacacgggtggagctagtttctagaaagaaagcagtgaaaagcagcttctgcttcaatatgaagcttcagcactgaggaatggctccaaaagatgactcactctctgcaggaagcattcaagtggagaaggtcaagaagacatctaaagaaaggaattctctcaaagagggaataactggtataaggtaattggaggatccctcttttttttgactcattctttagtgccagagttggcgtaattgcccagctatctatcaccttaaaccctaacagctgtggaaaatgaaaagccatactgaacttggagtaagaaaaatgtgtcttgcagttctggcacagatgcttactaactaaatgatctctagcaagtttcattttctctaggcctgtttggccacctgtataatatatataaataaatctgcaattccctcatttggggataaggaatcagtgggatgatggatttgaaagtatttagcacatagtggaaaaaatgatttatattctttaatttttttttgagatagggtctcactttgttgcccaggctggagtgtagtggcatgatcatagctcactgcagcctcaaactcctgggctcaggagattctcctgcctcagcctcccaagtagcgggcactacaagtgcccagcacccagtgcccagctatttaaaaaaatttatatagacagggtctctccatgtttcccaggctaatcttgaactcctgggctcaagccctcctctcgcctatgcctcctaaagtgctgggattacaggaatgagccacccttcctgaccagaaaaaaataatttaaaaaataataaattacaaggaattttgtcacatttacccatcctgttccttttgcagtattcctcatcactatgaagacatactcataccccaatttatatacttcaaaaccacagagtcatatttgacttgataccatgccagataagaaatgatacaattatctgagctgtttgacctgggagcagaagatgcagggggatctgatctctggtcttcagatctctgaaaaactgtcatggaagaaaaagaacagactgctctaggtggcctcagggagaatgactaggatatccaggtacaagctttaggaaaactaagttcagcttagcaaaaggaagaacttttaacagtccaaggctttccctgaagacagtgggctctctcaggaagcagtaaggaacctccctctagaagtgttcaagcagaaactggcaaggatgttttaatgtggaatccattagggtaaaggaaaattacaattcatgaaattctacttgtcaggcactgtgctagacccttggcaggaaatatatcttttaatcctcccaataacaccatgatgtgagtactgttatccctctttttcaggttagaaagctgaggctcaaagaatttgactacttctcattgggcttactactggcatggtgggtgggaggaacaattatttgttgcatctgtttggcattaaatgcagtagtacctcagactgtgtgtaaaacacacacacacacacacacacacacaccccacatacttctaaatgtcttgtggaaataccgatcctagttgggaatgtcaagtacataatatgcttaggatcacaaacagcagataaatagcagacccaggacttgaaaatagctgtgtctagctcagaaggtacatactctttctattgcgttatccacagaagtgagatgggaatgcacaaccttgtaaggtctaagccaacccgaaaagattctgattttctcattcttcctttttcaattccatataatgtatcaactacaaagttctgtagattcaacttttgtgatggcttgttaaattcatcacctcctttctattcccacagccacgacctcagttccagggccttgttccctctctgcccctagtttatccccctcttgtgttttcctattccaatccagctgactaaccttttaccagattactcttcctaaagcagaggatctgacgttttttttaagctcaaaaactttcaatggctttccattgtctgctaaatcaaatcaaaactctagcatccactgtcttttgcagtttaccaccaatctgccttggcaagtttaacttccaattttccgctaatcgtactctaaaatccagctcagctggtgttcttttcatatgccctgagcttccctgccttaaagcagttgttcctattttctctgcttaaactgtcttctctatctccacctgttgaaatcttatctgtgtgccacagtctatcttaaataataatagttaatatttattgagtgtttattttgggccagccactgtgctaagtgtgtgcaagtattttatatggattatctcatctaatcctcacaacagccccatgaggtgggtgctattattatccactttagcctgaagttaacagaaactcagaaagggagaagtaattttatttgtccatggtaacacaagttaaatggtgagcatg[450 bp omitted]ctctggcgggtcccttcttgtcccccagttcttgcagcttgctgggtcttggccagtgtttggagtgaggcaggatcaaaataacactgcccggggctcagcttccaggaatgagagatcaagtgaaaccaagctcggcgggtgagggggtggattgaaagcccccaaacagagccagcatgctctttacacaagccctgacttgccctcaagccacgcgggttagcagttctgctttcctcaggatgctccacaagtctgatccactgtccccgccttcactaacacccagcctccttctcttctttatctcccaaccctagatgctcaaggttgttggacacgtccaggcatgttctcagaggcaatgcaggtccagtaagagcctacaggaaatggctcgccaagatcctagagatgtcagcccagatccctgatacctcagaaagcgctctccggacacaaatggatggactgacagccagccacagggcgccttcccaattgttctgattttgcggtaccctagcaggatcatcctgacctgattctgtacttctgcacctagatgccgcaggtcccagccgccttgccacaccagggggtgttcccacactcacccggtaacggacgagtagatggctcttgctcccaaatgggactccggtacaaatccacctcagcgcagagcacacatctcacccagccccctcccgtcaccccccgcccttcaccccgcgcccctcagcccccgcccctcagacccgcccatcagccccgcccctcagcccccgcccctcagcccccagcctgcatacacactcacagtatatgaaattccttgtaatcaaagttccgcttgactcatttcacatccacgtgtagcaacaacagcccaaaccctcctttcacggtaagcttacctcttccgcccccgtgaagttcctagagcagctattggactgtttgagtgcctaggcgtggctacgaaaagaaactgcctttgagaggaacaatgtgaggctgaagaacagtgacccagccactggtatggcaggagctgcaaatctcctgggactgaagcgggggccagagagtagagggccagggagtggggtccagagaaagcatcaagttgtctctttcacagctgaatgcagctcagctcatcaaagtttattcatgacttagcaggcttggagtttgacagggaaaattattgttggaaaagccaaaattttcagacacatggagaagccgctttccagctctgcatctgcctcaaaaaaatactcctccattcagaagggtagataggattgtgacaggaggaagagagcagacatgaagcagggaaaagaccactaaaaataaaggaaaattggattcggcactcagctttgatcatccatcttctctgggcccctgagtgtctgtacaaggagggggttgagctacgtagtctctaagggcacttcaaacaatgacactttgggagtttattaatccatgatctcagaggcagcggtggataaatcccgaaacgttactagtccctgaccttgaagagtttgcagagctgggaagataaagtagaccggacagagacagagaattaagggccaaactatgaggtgcagactggaagggtttgggggccagtaggaagaaggagtaaaaaagagtctgacaaggaaagcaaatgcttttcaatagattaggagcttttaaaagaggtcaaagaggaaatagcctaatgggtagaggaaaagaaaagcttgagccaaggtatgggggagaggaccaagaaatgagccattatcagtctctgagggacccctcctgtactgggcagaggctatatgccagctcagggtggagtctcagtaaagcagctgaaaagcctttggtgggaaagggctgaataggccctaagctgaagtagaaaaagtcctaaatgaacttcatatctgtcccctagctagagttaagaccagaataggctactgtgggctcaggcctagtagaagggaaaactgccagaattggaatcctaggtctgccccttactagctttgtgacctaaggcaagttacttaaccactctgtggctcaggattctcttctgtaaagtggggaaaataacaatcccttactcataggattgttttaggtattatatgagttaatatacaaaatagtgttcatatgcgtaaggagcttagaatgatttctgggacgtagtggtatagaagtgtttattaaatataaataaatacatgaatgcaatttagggacctctgaaatcatctgtgagattcaaatgaaaatagctaccctgggtacctcctaattctgttctgtcctttcctagaaaacaggacctcttctttttctccatcctttcctacccagagaagctgaattacagacagttttgaaactttagtgtaaagaaccctagcttggaatttagatgtcttgacaaaactaagtgtaacatcatgtaaatctcttcctctctcttagttttcctttctgcatctgtatcctgaagagactgttggactggatgaccttgaaacgctagagccgtgcttctctcatattaatgtgcacacaaatcacctaaggatcttgttaaaacacagattctgagttagcagctgtggtgtgggactaagactctgattttctaactgcttccaggtgatattgatggtgctgggccacagaccatagttttagtagcaaaggtttagaaggtggacaagaataacatttactgagcacctataaatcatgcatatgtgtccctttataccttacaaccattctatgaggttgaggttaccatcctcattttgtagatgaagaggctccttgtactctgtgattctgcctggaagtacaggaggaaacttgagatagaggtaccagggatatgtcagagtccacaagctattgtggaaagtgattataagcagcaaatatgaaaccactgtcctccaccataacttgtccaataatactataacagttagctggccctcactaagcacttgccaggcactgctcaaatttttttcatgaattaattcattttatcttcataatctatgaagccacaatcattagaattatcctcccctctccttttgctcacacctcacattcaacccatcagcacatcctatcagctctgcctcctgcctcagagataaactctgaatttcaccaacttcttagcaccttcactgcaaccactctggtgcaagccacgattacttttcacctgaattattgccatatcctccaatagctctccttgctctcatgcttaccccactccagtcaattctcagcagagcaaccagaatgatccttttaaaagtacatcagtctaagtctgtccaagcaattctactggttggcttcttattcagcagaaaacccaaaatccttaactatggtctataatagtctacaatctatcccacgccatcccatcctcactaacctgcccctctatctctgatctcacctcttaccactcgccttgaccaccatacccaaccccaactggcggccttgatattttttccaacactcaaagcatgctcaagactctggtctttgcacttgctgctccttcagcctagccaattcttcccccagatatcagcatggctccttttctcacttcctccatatccctgcttaaatgtcactttatcaaagtggactttcttgaataccctagctagtacaagctaatgggattgcctaggccttttgaaatccactgggtaggtgagctttttctcaacatagccccaggacccccggtgcagtgtggtggtgagtagggttaaggctctcaactctgctctctgtgggggagccactctagctccatgtgcttgtgcagcagaactaagtttggatcagctaatttcttgggggctttccacagcccctccttttatgataaacaggagtcactttgtgaacccaaactgagaactatcagtacagagtttctctacctacattctactgctggaaccagcctaacctgacagcaggataggcaggaccagcctccactctgcttatctctgggaccagacagattctggggctcagtgagattcagggctctctgatgccacccctcagctctctctcagaggttacttagggtcactcaggggaatactggccttggctgtgtctcagagaatcctgggtagcctctaattctagtgtccaacaatggcaggaccacctttcatgaaggagcttcatggttatccaggcagaatggggcccttatagctcctctcaagactgggaccagggggcaggaaaagaagctgaaagactaaggggatgctgaggcctgtggggcaacccctgtaaactcaaacattgctaaggatgtccctgaacacaatatcagcttcttgttctctttagcctgtgagatgtgtgtagataaacttggccataaatgtttgctgcagtggtgtatacaggcttaggtcttctgaattagaaagctggggtataagagttacttctagccatgggaattttcaaacttcagctagattctagcacagtccaatagtgttatctctcattttaaataatcttctattccacttgcccaagatggcttttaaaactcactcttcttaagtcaagtgctcaacacagctcccaaacccctagcagatgacttcacctccagtttcaccgagaatgtaaaagggcacgaaacttgaagtctaaacaacttctgacatctccacattcaagttcatcctgtttcttacctcagagtttcctcctgtccctcctgtctccatctgtgtttactcctgtctattccattttgctttatttgtatcttcatggtctttcttcctctggctctttctcctaaattgtctttccattctgaactaagattaattcttttcatatcctcacctccacctcttcatttccaaactcactacattttgctcttctcaaggtcacccatgattttcatactatcaaacccatggattcttctgttttcttatttgaattatctaaaacatccaacattgtctggattcttttctttctgactctcttcccttgactttcatggaactaatgtcttctagtttcacttatttctctacagcattttatggattctcattctccacttgcccctcaagtgcagggattttacagagttcctcccaccctccattgtccctctggcctgattctaacttctctcactggagtgtgaacctatgtggcagggaccttatataccatttcacaaatttccacatgcaaaactgtacctagagtattttaagcgctcaatacatttttacatattatatatatcaatatatctgttgaataagcccaaggagaaaaatgttcacatttgaatgtatccttctataatgagctcccaggcctcaggtgtgccacaataaaaataagatggctaaaaaggaattgaaacccacacccaaaataataataatagccaacacttgatcaatgcttgatgaactctatatgtcaggccctatgccaaatgttctgtatgcaatagctcatttaatcatcacaataatcctatgaggcaaaaaccatgacatcactcctattttatagatgacaaaattgaggcacagaaacgataggtgacttatctatgccatctatcagtgccacaaccaataagtggcaattgacccaggattctcaagaatagctgatgccttaattattcactgtcacactcaaatgtacaatccttgctttcccttccaatcagaggctccttccatcctctctgaagagctattctaaacctctacctttagaagtaaaggttaagttcctactttagcactgaattcttagcccagaaacattgactcttttcttcttcatcaataaaacagattctattaggcatttagtgcctataacttcttccctaattcctataaggttctctctgtcttcattcatcttggcctttcctcttgaagaagaggagagaatgcctcccctgatatttatgaatctttctccatcaattacccccactctctatggcatcattatttacctgtcttctgtgcctacccctttaactcgtaaacatatttgaattcctcccactacaaaataaaatcaacccttctaccacatttcctctttctcaaacaacagcctcgtctcattttttttcttagccaaatttctggatagagttttctctaataactgtttccatgactttaatttccattagctccccaacctactataatctggcttctagccccatttgttctccctaaagctacaggggaccacttaactgccaaattttaggaaacattttctctcatctttttttttcttttttttattatactttaagtttcagggtacatgtgcacaacatgcaggtttgttacatatgtatacatgtgccatgttggtgtgctgcacccattaactcatcatttacattaggtgtatctcctaatgctatccctccctccttcccccaccccacaacaggccccgggtgtgatgttccccttcccgtgtccaagtgttctcattgttcaattcccacctatgagtgagaacacgtggtgtttggttttttgtccttgcgatagtttgctaagaatgatggtttccagcttcatccatgtccctacaaaggacatgaactcatcattttttatggctgcatagtattccatggtgtatatgtgccacattttcttaatccagtctatcattgttggacatttgggttggttccaagcctttgctactgtgaatagtgctgcaataaacatacgtgtgcatgtgtctttatagcagcatgatttatgcacctttgggtatacatgcagtaatgggatggctgggtcaaatggtatttctggtactagatcccggaggaatagccacactgactttcacaatggttgaactactttacagtcccaccaacagtgtaaaagtgtccccatttctccacatcctctccagcacctgttgtttcctaactttttagtgatcgcccttctaactggtgtgagatggtatctcattgtggttttgatttgcatttctctgatggccagtgatgatgagcattttttcatgcctctgttggctgcataaatgtcttcttttcagaaatgtctattcatatccttcgcccattgttgatggggttgtctgatttttcttgtaaatttgtttgagttcattgtagattctggatattaggcctttgtcagatgagtagattgcaaaaattttctcccattctgtaggttgcctgttcactctgatggaagttgcttttgctgtgcagaagctctttagtttaattatatcccatttgtcaaatttggcttttgttgccattgcttttggtgttttagacatgaagtccttgtccatgcctatgtcctgaatggtattgcctaggttttcttctagggtttttatggttttaggtttaacatttaagtctttaatccgtcttgaattaatttttgtataaggtgtaaggaagaggtccagtttcagctttccacatatggctagccagttttcccagcaccatttattaaacagggaatcctttccccatttcttgtttttatcaggtttgtcaaagatcagataattatagatgtgtcgtattatttctgagggctctgttctattccattggtctatatctctgttttggtaccagtaccatgctgttttggttactgtagccttgtagtacagtttgaagtcaggtagcatgatgcctgcagctttcttctttggcttaggattgacttggcaatgtgggctcttttttggttccatatgaactttaaagtagttttttccaattctgtgaagaaagtcattggtagcttgatggggatggcattgaatctatgaattaccttgggcagtatggccattttcatgatattgattctttctatccatgagcatggaatgttcttccatgtgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggtatccctgtcttgtgctgattttcaaagggaatgcttccagtttttgcctattcagtatgatattggctgtgggtttgtcataaatagctcttattattttgagatacatcccatcaatacctaatttattgagagtttttagcatgaaggggtgttgaattttgtcaaaggccttttctgcatctattgagataatcatgtggcttttgtcgttggttctatttatatgctggattatgtttattgatttgcatatgttgaaccagccttgcatcccagggatgaagcccacttgaccatggtggataagctttttgatgtgttgttggatttggtttgccagtattttattgaggatttttgcatcaatgttcatcaaggaaattggtctaaaattctcttttttggttttgtctctgacaggctttggtatcaggatgatgctggcctcataaagtgagttagggaggattccctctttttctattcattggaatagtttcagaaggaatggtaccagctcctctttgtacctctggtagaattcggctgtaaatccatctggtcctggactttttttggttggtaagctatcaattattgcctcaattaagaacctgttattggtctattcagagattcaacttcttccttgtttagtgttgggagggtgtatgtgttgaggaatttatgcatttcttctagattttatagtttatttgcgtacaggtatttatagtatgctctgatggtagtttgtatttctgtgggatcggtggtgatctcccttttatcactttttattacatctgtttgattcttctcgtttcttcttttttagtcctgctagcagtctattaattttgttgatcttttcaaaaaaccagctcctggattcattggtttctttgaagctttttttgtgtctctatctccttcagttctgctctgatcttagttatttcttgccttctgctagcttttgaatgtgtttcctcttgcttctctagttcttttaattgtgatgttagggtgtcaattttagatcttttctgctttctcttgtgggcatttagtggtataaatttccctctacaaactgctttaaatgtgtcccagagattctggtacgttgtgtctttgttctcgttggtttcaaagaacatctttatttctgccttcatttcgttatgtacccagtagtcattcaggagcaggttgttcagtttccatgtagttgagcgcctttgagtgtgtttcttaatcctgagttctagtttgattgcactgtggtctgagagacagttggttataatttctgttcttttacatttgctgaggagtgctttacttccaactatgccgtcaattttggaataagtgcggtgtggtgctgagaagaatgtatattctgttgatttgggttgcagaattctgtagatgtctatgaggtccacttggtgcagagctgagttcaattcctggatatccttgttaactttctgtctcgttggtctgtcttttgtttaaatttgggtgttaaagtctcccattattattgtgtaggagtctaagtctctttgtaggtctctaagggcttgctttatgaatctgggtgctcctgtattggatgcatatatatttaagatagttagctcttcttgttgaatttatccctttaccattgtgtaatggccttctttgtctcttctgatctttgttggtttaaagtctgttttatcagagactaggaatacaacccctgccttttttttgttttccatttgcttggtagatcttcctccatccctttattttatgcctatgtgtgtctctgcacgtgagatgggtttcctgaatacagcacactgaggggtcttgactctttatccaatttgccagtctgtgtcttttaattggaggatttagcccatttgtatttaaggtttatattgttatgtgtgaatttgatcctgtcattatgatgttagctggttattttgctcgttagttgatgcagtttcttccttgcctcaatggtctttacaatttggcgtgtttttgcagtggctggtaccagttgttcctttccatgtttagtgcttccttcaggagctcttttagggcaggcctggtggtgacaaaatctcttagcatttggttgtctgtaaaggattttatttctccttcacttatgaagcatagtttggctggatatgaaattctggattgaaaatttttttctttaagaatgttgaatattggcccccactctcttctggcttatagagtttctgctgagagatcagctgttagcctgatgggcttccccttgtgggtaacccaacctttctctctggctgcccttaaaattttttccttcatttcaactgtggtgaatctgacaattatgtgtcttggagttgctcttctcgaggagtatctttgtggcattctctgtatttcctgaatttgaatgttggcctgccttgctagattggggaagttctcctggataatatcctgcagagtgttttccaacttggttccattctccccatcactttcaggtacaccaatcagatgtagatttggtcttttcacatagtcccatatttcttggaggctttgttcatttcctttttctctaaacttctcttctcactttatttcattcatttgatcttccatcactgataccctttcttccagtttatcgaattggctactgaggcttgtgcattcatcatgtagttcttgtgccattgttttaagctccatcaggtcctttaaggacttctctgcattggttattgtagttagccatttgcctaatcttttttcaaggtttttaacttctttgcgatggggttgaccttcctcctttagctcggagaagtttcatcctctgaagccttcttctctcaacttgtcaaagtcattctccatccagctttgttccgttgctggtgaggagctgctttcctttgtaggaggagaggggctctgatttttagaattttcagcttttctgctctgttttttccccatctttgtggttttatctacctttggtctttgatgatggtaacgcacagatggggttttggtgtggatgtcctttctgtttgttagttttccttctaacaaacagtcaggaccctcagctgcaagtctgtggagtttgccagaggtccactccagaccctgttttcctgggaatcagcagcagaggctgcggaacagcagatattggtgaacagcaaatgttgctgcctgatcgttcctctggaagttttgtctcagagtggtacctgtccgtgtggggtgtcagtctgcccctactggggggtgcctcccagttaggctaattgggggtcagggacccacttcaggaggcagtctgtccattctcagatctcaagctgcgttctgggagaacaactagtgtcttcgaatctcagttggaaatgcagaaatcatccatcttctttgtcgctcatgccgggagctgtagactggagctgttcctattcggccatgttggaactgcccgacttgcttttttcactcgtcttcttacttgatttatccacagctttttccagtagtggtcactcttttcttggaaaacactatttctaatgttgaaaaaagaatcctgtcccctagcttccttctatttttctttttcttttcatttatttatttttttatttttaaaattaatatttttccataagttattggggtacaggtggtatttggttacatgagtactttccttatcattacttccccttattgtctgctctcaccttactcaaatcacttcaaatgtagttctgactcagacaagtagccaaaccctctatgcctactctataccttagcaggcctatgctcagaagctcagcacacactgaccagaaggctctgcaataatgactattctacacatgtatttgttaataatattactttaaagtaatgtgggatataaccctttaaagtcctgtatacatgtacctcattcaatctttataatcacaggaaagtggaattactcttattgtagcaatttactaattggaaagggcagaattgctgtctgttggatgtgcactatatacaggcactatactaggtaatttatgtaagttatttcactaacccttccagagcagctccataattagctccatttttaaaagtgaaacaagtaaacatataaaacattaagtgggagtgacagcagcaacattgttggatagaacttttcagcactcatcctcttgtagaaacatcagtttgaaaaacaatccatagcctgagcaacaaagcgagaccccaatctctacaaaaaaaaaaaaaagtaattagcctattgtcatggtatgagcctgtggtatcagctacttgaaaggctgaggtgggaggattgcttgagcccaggagtttaaagctgcagtgagctatagatgatgccactgcattccaacctgggtgatcagagcaaaactctcttaaaaaccaaaacaaacaagcaacacaaacaatgacaattacaaaaaataaaactatccatgaacaaaaatatgttcacaagagtaaaggaatccaggcgagagattatagcacctggacatagcacagaaataagaaaagacacatcaaagagggaaggaaagaaagttttatgttatccatattatccctcccccatgtctcggcaaaaaccatgacattgctcctattttatacatgagaaaattgaggcacataaatgataggtaaattatccatactaatatatctggcctagttaccaggctcaccacagctataggccagtccctatatattgaggttccaggcccctcccatactctggagaagccccagcaccaggctagtccccacagcattagactccatgctggcatccacagacccagcctccaggcctgctagagtgtcagaacaaaactgacagaccccacctccagtttggcttacatggcactaggcatgaggccagcatgcacacaccaaggctctatgctagtattcatggccccacactccagtggaccccgagaccagacctgcttcagtaggccccagcaccaggccagcctatggccttaggctgcagaattaccccccacagccccaggatccaggcttagcccacagactcatccttcaggcccagacacatactaggcttgctcccacagatccagcatccaggccaacccctatagacctagcttccaggccaccaactgcagacttagaatctagtatgccacctgcagacccaggatagaggcctgctacagtgaacccaggctccaggccctttgctgtggataaatgataacaggaaaacaatacttcaaaaaaatgaaacatttgacaaagagatagaaagcataaaagggaaccaaatagaaattctggagcacaatgactgaactaaaaatttctagagaaagctggaaataacaggctcaataacacagaaaaataaagcagtgaccacaagacagattatttgaaattgcccactcaaaagcaacagtaacaaaaataaaagaaaaaggtgatgaaagcatgtgggacttatgggataccatcaaggaaaccagtatgcagttagcactccatatatgcaagttcagcatccagattatcaactaaccacagatcaaaaatatgttttaaaacccaataacaataaaataatacaaattttaaaatacagtataacaggtatttacatagaatttacataatattacatattatgcttacatctagagatgatttaaagtatacatgaatagatatgtgaaggttatatgcaaatagtacacaattttatgtaagatgtatattctaagtctcatggtaactacataaaaagcgaatattagatacacagatgataaagagaaaacaaaacatactggtaaaagtcatcaaatcacaaagacagacagcaagagaggaacagatgaacaaaagaattacaaaagagacagaaaacacaatggcagtggtaagttcttagtatcaaaaattacttaaaatgaaaatagattcaattttccaataaaaaggaataaagtgactaaatagaaaaacaagatccaacttatgttttctacaagagtcacagttcagcttgaaggatgcagataggctgaaagtgacagtatggaaaaacatacttcatacaatgggtaatcacaaagagcagggatatgtctactaatatcaaacaaaatagagattttaagtccaaactgtgacaaaagacaaaaaagcattatataatgataaaggggacaattcatcaagaaggcatagcaattaattgtaaatacatatgcaaccagcatgacagcaactaaatatataaagcaaatattaacagagctgaaggaagactattttgcatttctgcaaaaatgcaaatgcaaaaatagtagcaaatgcaaaatacagtagagaacttcaaaaccacatgttcaacaatggatagatcatctggacagaaaatcaataagaaaacagtggatttgaacaactggctcaacacacatgtacagaacattccatccaacagcagcagaatacacattctattcagcacacacagaacactctccagaatagaccatatgtccagccacaaacaattcttaataaaacatttaagaagattaaatcacatcaagtatttttttttctgaacacaatggaataagactaaataaacatcaacaagatgaaaatgagaaaattcactaataagttgaaattaaaccactaacttctgaacaattagtgggtccaaaaaaggaaaataaaagtcttaagaaaaatgaaaatggaaacaaaacataacaaaacatttatgcagcagaaaagtaattttaagaagggcatttatagcaatgtaagccaacaatagggaataagaaagatctcaaataatcaacctaacctgagacttcaaggaactagagaaagaagaaaaaatgaagctcaacttcagcagaataaagaaaataacacagaacacagcagaaataaataagatagatacaaggaaaagcaatagaaaagattaatgtaactaagagttgcttttttgaaaaagataaactaaattgacaaacctttagctagattgagataagagagaataaacaagcaaaattacaaattaaagacacgacattaaaactaacgccatggacataaaaatggccataaaagattactatgaaaaactatatgccaagaaactggataaacttgaaaaaaatggttaaattcctacaaacatacagcctatcaagactaaaccattgagaaatatgaaatctgaacaaatcaaaaatggataaaaatatcgaattagtaatccaaaacctcccaagaatgaaaagctcagaacttgatagcttcactggttaactccatcaaacatttaaagaagaattaaggtcaatccttctcaaattcttccaaaaaataaaataggaggggagactagcaaactcattttacaaggtaggcatcaacctcattccaaagccagacaaacactcatatatataaaccaaatattattatagctaaagagagagataaccataatgcaatgaaagctgagacttcaacactccactttcagcactggacagttcttccagacagaatatcaaaaaagaaacatgggacttaatctgcaccattgaccaaatggacctaagagatatttacagatcattttatcaaacacctgcagaatatactttttttcccttagcacatggatcattctcaaatatagaccatctgttaggccacaaaacaagtcttaaaatatacaaaaacattgaaaaaatattaagcatattctctgaccataatggaaaaaatgtaggatttgtaacaagatagattttggaaattatatgaataaatgggaattaacaagttcctgaatgacccatgtgccaatgaagaaattaagaagaaatttgaataatttcttaaaaaaatgataatggaaatatgacatacctatggaatacaacaaactgagtaataaaatagaagtttatgattataaatgcctgcactaaaaaagaaagaaaacttcaaataaataaacttaaagatgcatctttaaaaaattaaaatagcaaaagcacataaagccaaaaattagtagaagaaaataagtactaaaaatcagagaattaataaatgaaattggactcaagaagacaataaaaaagattaatgaaataagaagtggtttttctaaaaaaaaattaaacaaaattgacaaactttagccagactaaataaaaagaaagagagagagcatttccagctaaataaaattagagatgaaaaaggagacattacaactgacaccacagaaattcaaaggattattagtggcttttatgagcaactgtatgccaataaattagaaaatctggacaaatttttagacacatgccagctatcaagattgaaccatgaagatatccaaaaccaggatagaccaacaataagtaacaagattgaagatgtaataaaaagtcttcttggaaggaaataataccaaacctagtgaacttattctgaaaactagaagaggtaagaatgcttccacatttattctatgaggccagtattagcctgatgccaaaaacagacaatgacatatcaaaaaagaaaaccacaggccactatcactgatgcatattgatggaaaaaccctcaaccaaatattagcaaactgaattcaatagcacattacaaagttcattcagcatgaccaagtaggatttatccctggaatgcaataatagctcaacatatgcaaatcaatgtaatatattatatcaacagaatgaaaggcaaaaaacattatctttccaattgatggtgaaaaaacatttgataaaattcaaatgacttcctgataaaaaccctcaaaaaactggagatcaaagtaatatacctaagcataatgacacacaaatgggaaagaccaacagctagtatcataccgaatgggaaaaaaatgaaagccttttctctaagatctagaacacaaaaaggatgtccactgtaaccactgttatttaacatagtactagaagtcttagctagagctatcaaacaagagtaagatataaacggcatccaaattgaaaagtaataagtcaaattatccttttttggagatgatgtgatattatatttggaaaaaatgtacagactccaaaagaaaactattagaactgataaacaaattcagcaaagttacaggatacaaaatcaacgtatagaaataagtagcatgtttatatgccaacagtgaacgttgtagaaaagcaattaaaaagtcatctcatttataatagttatgaataaaaagtacctaggaaaaaacttaaccaaagtagtaaaatatattagcgatgaaaattataaaacactgataaaataaattgaagaggaccaaaaaatagaaagatatccatgttcataaattagaagaatcaatattgttaaaatgtccatactacccaaggcaatctacagatttaacccaaccactatcaaaatatcaagaacattcttcacagaaatagagaaaataatcctgaaatttatatggaaccataaaagatgcactatatccaaatctatcacaagcataaagaaaaaagctggagaaatcaaattaactgactaagttataccacagagcaatagtaaccaaaaaagcacggtactggaataaaaatagacacatagaccaatgaaacagaatagaaaacccagaaataaatctatacacctacaattaactcattttcaagaaagattttaagagcatacattagaataaggacaatctcttcaacaaatggtgctgggaaaactggatatccatatgcagaagaatgaaactagacccctatctctagacatatacaaatcaaaatgaatgaaagacttaatgctaagaccccaaactatgaacctactacaaaaaacttttgggaaactctccaggacatggaagtggacaaaaaccttttgagcaatatcccacagacacaggcaacaaaagaaaaatagaaaaatgagatcatatcaacataagaagcttctgcacagcaaaggcaacaatcaacacagtgaagagacaatccacagaatgagagaaaaatatttgcaaactacccatttaacaagagatcaacaaccagaatatataaggagcttaaacagttctataagaaaaaaatataataatattattttaaaatgggcaaaagatctgaatagacattactcaaaaaagacatacaaatggcaaagaggtatatgaaaaggtgctcaacattactgatcatcagggaaactcaaatcaaaagtaaaatgagatatcatttcaccaaatgccagatgtggtggttcacacctgtaatcccagcattttgggaggctgaggggggttgatcatctgaggtcaggagttagagatcagcctggacaacatggtgaaactccgtctctactaaaaatacaaaaaattaactggacatggttgtgggcgcctataatcccagctactcaggagaccgaggcaggagaattgcttgaacccgggaggcagaggttgcagtgagctgagaacacaccattgcactcagactgggtgacaagagcaaaactccgtctcaaaaaaaaaaaaaaattcttttatccaaaagacaagcaatagcatatgctgtcaagaatgtgaagcaaaggaaaccctcataaactgttggtgggcatgtacattagtaaaactggtatggataacagtttggaggtcccataaaaaattaaaatagagttaccatatgatccagcaatccagtgcctagataaataccctaaagaaaggaaatcagcatactgaagacttatctgcagtcccatgttttttgcagcattattcacaaagataaattcttaaagacaataaggtacatatacaaaatggagtactattcagccacaacagataatgagatactgtcatttgcaacaatttggatggaactgtaagggattatgttaagtgaaacaaggcaggcacagaaagacaaacatcacttttctcacttatctgtgggtgctacaaaatagaacaattgaattcatggatatagagtataagaacggtttaccagaagctggccagagtacttagggttggggaagagatgattaatgggtaccaaaaaaagttaaaaagaataaataagacccagtatttgctaaaataacagggtggctatagtataaacatgatttaattatacattttaaaataatttagagaggtggagcaagatggtgaattagaaagcttcacattccatgcccacaacaaggacaccaagttaacaactatctacacatgaaaaaaaaaaaaaaacaccttcctaagaaccaaaaatcaggtgagcatactacctagttttaatttcatgtcactgaaagaggtactgaagaaatagaaaaaatagttctgaattacatataccatgccaccaccaacccaggaagcagcagaatggtgtggagagcatctctgggtgctggaagtgggagaacacagaaattgtgaggcatggaagtccgtgctgtcctgtaaaacaagaaaggaaaaccagacaaatctcagatgatgccccctcatggaaggagcaacagatagtttaaaaagcagggaaatgatgttaagttgtcaaagtgttattagttttctttttgtctgtttgtttgtttatgcaaatagtgttaagttgttatcaggttgaaataatgagttacaagacagtatttgcaatcctcatggtaacttcaaaccaaaaatcatacagtgaacacacatacacaaagcaagaagctaaaaaccatatcatcagaaaaaagcaccttcactagaggaagacaggaaggaaagaaagaagaaagagaagaccacaaaacaacaaaaataaaataaaatggcagcagtaagtccttacatatcaataataatgttgagtgtaaatggactgagctctgcaatcaaaagacagagactgactgaatggataaaaaaacaagaaccattgatctcttgcctacaagaaacacacttcacctataaagatacacatagactgaaaataaaaggatgaaaaaggatattccatgccaatggaaaccataaaagagcaggagttgctgtacttatatcagacaaaataaatttcaagacaaaaactataagagacaaagaagttcactgtaaaattataaaagggtaaaatcagcaagagaatagaaaaatgttaaatatatattcatccaacactggagcacccagatatataaagtaaatattattagagctgaaaaaaaagataggtcccattacaataatacctggagactttaacaccccactttcaccattggacagatcttcaagagagaaagtaaagaaaaattaaacttcatctctactgtagatcaagtaaatttaatagatacttacagaacatttcacccaagacctgcagaacacatattcttttccttagcacatagatctttctcaaggacagatcatatgttaggtcacaaaacaagtcttaaaacatcacaaaattggaataatattaagcatcatctctgaccacaatgggcttaagctagaaattaacaagaagaattttggaaactatgcaaacatgaaattaagcaatatgctcctgaaaggctagctggtcaatgtagaaatttataaggtaatttaaaattttcttgaaacaatggataatggaaagacagtatactaaaacctgtgtgatacatcaaaagcagtactatgagggaaatttatagctaaaagtacctacagcaaaaatggaaagacttcaaatgaacaatctaacaatgcatcttaaagtactagaaaagcaagagaaaatcaaaccaaaattagtagaagaaaagaaataaagatcatggcagaaataaatgaaattgaaatgaaaaaggtaatacaaaatattaatgaaacaaaaagttgtacttttaaaaaattgacaattgacaatcctttagccaggctaactaagaaaaaaagaagattacaaataaataaaatcagaaataaaaaaggagacattgcgactgatattgaaaaaaatgaaaggatcattagtggctactatgagaaactatacaccaataaatttaaaaatctacaaaaaatggacaaatttctagattcatgcaacctgtcatgattgaaccaggaagaaatccaaaatgcaaacagaggacacaaaatcacagaaaaatattttatgttcatggattggaccatcaatattgttaaaatgtctgtaacacagaaggcaatctacagattcaatgcaatccctatcaaaataccaataatattcttcatagaaatttaaaaaaattccaaaatgtatacaaatccccccaacgcacaaaaatagtcaaagctatcctaagcaaaaagaacaaaactgaaggaatcacattacttgacttcaaattatactacagagctatagtaaccaaaacagcatgttgctgtaaagacagacatgtagaccagcagaacagagtagaaaacccagaggaaaatccacacacctacagcaaactaattttcaaaatggtgccaaaaacatacactgggagaaagacagtctcttcaataaatggtgctgggaaaactggatatccatatgcagaagaatgaaactagatctgtatctctcaccatatacaaaaatcaaatcaaaattaattaaagatttaaatctaagacttcaaactatgaaactactggaataaaactttggggaaactctccaggacattggtctgggcagaaatttattgagcaatatcccacaagcacaggcaaccaaaacaaaaatggacaaataggatcacattaagttaacaaacttctgcacagcaaagaatacaatcaacaaagtgaagggacaacctacagaatggtagaaatatttgcaaacagctcatctcacaagggattaataattaggatatttaagaaactccaacagttgtataggaaaaaatctaataatttgatcaaaagttgggcaaaaacaactgaatagatatttctcaaaaaaagacacacaaaaggcaagcaggcatatgaaaaggtgctcaacattattgctcatcagaggaatgcaaatcaaaactacactaagatatcatagcaccccaattaaaatggcttccatccaaaaggcaaaaacaaatgctagcaaagatgtggagaaaagggaacccttgtacagtattgttgagaaactatattagtacaaccactatggagaactctttggaagttcctcacaaatctgaaattgcaccaccatattgatatgttttgactctgtgttccacccatatctcatgtggaattggtaatccccacatgtcatggggtggggacctggtgggaggtgattggatcatgggggtggatatactgcatgctgttctcatgatagtgagatctcatgagatctgatagtttaaaagtgtggcactccctgccttgctctctctctttccttccaccatgtaagacatgccttgcttccctttcaccttctatcataattataagtttcctgaggcctccccatccatgcagaactctgagccaattaacatcttctcttcataaattacccagtctcaggtagttctttatagcagtgtgaaaacggaactaatacacatgatccagcaatcccactactgtatatataccccaaagaaaggaaattggcatatcaaagagacacctgcacttctatatttgttacagcactgtttacaatagctgatttggctaacctaagtttcccccaacagattaatggataaagacaatgtggtacttacacacaatggagtactattcagccataaaaaagaatgaaatccagtcattttcagcaacatggatggaactggagatcatcgtgttaagtgaaataagccaggcacagtaagacaaacattgcatgttctcacttatttgtgggatctaaaaatcaaaacaattaaactcatggacatagagactagaaggatggttaccagaggctgggaagggtgttgagcggctggtggggaggtggagtggttaatgggtataacaatatagttaaaaataatggataaggcctgctatttgacagtacaatagggtgactatagtcaataataacatagctgtacattttaaaatgaagagtgtaattggattgtttgtaactcaaagaattaaatgcttaaggggacagatggactattctgcattaatgtgtttatttcaccttgcatgcttgtatcaaacatctcatgtaccccatatacatatatacacctactgtgtacccacaaacatttgttaaagtaatacataaaaaaataacttaaagagtataattggattgtttgaaacacagaggaaaaatgcttgatgtaattgttacacattgcatgcctgtatcaaaatatctcatgtaactcataaatatatacacctactatgtacccatgcaaagttttttaaaaattaaaaaatgatgaaaaacaagtgctggcatgaatgttgagaaagaggaatccttgtacactgcagctgaaatgtaaattagtgtatagacattataaaaatatggaaatttctcaaataattaaaaataaactaccatgactcaataatcccactagttagtatacatctaaaagaaattcattcattactggcatacctgagagatattgtaggttcagttccagaccactgaaacaaagcaaaaggagcaataaagaaagtaacacaaatgttttggtttcctagtgcatgtaaatgttatatttatgctataacatactctattaagagtgtaatagcattatgtctaaaaaaagtacataggttaatttaaaaatattttatttctaaaaaattgattatggttatctgagcctttagcaaatcattataatctttttgcagaggaggatctctccttgatgttcatggcttctgactaatcagagtaatggttgctgaaggttggcgtgactgtagcaacttcttaaaataagacaacagtgatgtttgccacatcaattgacctttcctttcacaaatgatttatctgtaatacgtgatgctctttgacaacattttacccacagtagaacttccttcaaaattggagtcatcttctcaaactctgctgcagatttatcaacaaagtttatgtaatattctacattctttgttgtaatttccataatgttcacagcatcatcaccaatagtagattccatcttagcaaaccacttttttgtgctcatccataagaagcaattcctcattcattcaagctttatcatgagattgcagcaactaaatcacatcttcaggctccacttatgattctaattctcttgctttttcaccacatctgcaattacttcctccactgaagtcttggaaacctcaaagtcatccatgagagttctcatcaacatttcccagatccccattaatgttgacatgacctcttctaatgaaccacacatatttttaatgacatttagagtggtgaatcatctccagaaggttttcaatttacttcacccagatccatcaaaggaatcactatctatggaagctatagcctatgaaatctatgttttgaataataagacttgaaattcaaaattaccccttaatctatgggctgaagaatggatattgtgctaacaggcatgaaaacaacattaatttcctatacatcttcatcagagttcttgagtgactaggtgctttgtcaatgagcaatattatgaactaaatctttctgagcagtaggtatccagagtaggcttaaaatattcagtaaatcattctttaaacagatgtgctgtcattcagctttattgttcaatttgtagagcacaggcagagtaaatttagcacaaatcataaggtccctaggattttaagaatggtaaatgagtattggtttcaatttaaagtcaccaactgcattagtccctaacaagagagtcagcctgacctttaaatctttgaagacagacattgagctatctccagctttgaaagtcctagatggcaactttttcaatataagactttttcatctatattgaaaatcttttgtttactgtagacccttcgtcaatgatctgggtaacttccttcaacttttacatcagcacttgctgattcatcttgcactttcatgttgtggagattgctcctttccttaaacctcatgaaccaacctctgctaccttcctacttttcttctgccacttcttcatctctatcagccttcatagaattaaagggagttaacgctttgctctagattaaactcttgctaaagagaatgttgtggctgatttaatcttctatccaaaccaataaaactttctgtctattagcaataaggctgtttgactttgttatcattcatgtgttcactggagtagcaattttaatttaattcataaactttttctttgtattcacaactttactctttggcacaagaggcttagcatttgacctatataagcttttgacatgccttcctcagtaagcttaatcatatctagcttttgatttaaggtgagagacatgtgaatctccctttcactagaacacttttggccattttagggttattaattggcctaaatttctattttgttttgttttgggggatagagaggggcaagtagaaggaaagtgacagggaagtggccagtgagtagagcggtcagaacacacattatcgatttcattcactgtcatatgggcatggtttgtggtgctccaaaacaattaccagaataatattaaagataactgatcacagatcacagaagaaaagacttgagaggttagatggtataggaaacaaatcagttgccaccttcaggtgttagaggacctgtcatgaagaatggggaggataagacttgcttagtgttgcctcaggtaaaggaaggaggacagttgtttagaatgtatagagataagactacccacatggtctccaccagtaacacagtctccactggtaacacagtgggtggtgttaaaagttcagtctccccatctagcgttctagaactaaataaagtatactcatggtggaggaggggagttagggggcaccttgctagagcctggcaagggtgaaagtctatgctccgcatccggccattgccacagttgttgtttttcctctggtgtttggttgtagtggagctgtcatttaaaaattttgtgtgttgctgagctgctactttggatggctttttggggggctttttctatgtcctttggcattaccacattgtcagattctccagtatccagtctgggataggtgacgcaaaaagaaaacacaaagaactcactgtgctgtcactccttagatctcaaagatgctagtcattcttcctttctttctccacctttcagtcttcttatccttgttttatatataatgtccagagtatttagctgtactcagtgggaggaatagagaaaagtatgtctacttatctaacctttcacaaaactgtccattgatcaaatgggcaaatgagagagataacaaattcccttttattagagatattcaaacggaattgggaacaatcgatttggctactaatgctatagtagtcaaataaattaagcatcaaatggtgagctgaacagaaagatctcaaaatttatttctaatctatagattctatattaccatgattttatacacatttaatcctttcaatcaagtacttagtgggttctgtatgccaaccattgtgctgagtgctgggcacatagcagtaaataaaaacaaaaaagttctcaattctcacataatttgttctagagaggggagactgacaagtaaacaaatattatcaagataatttcagatataagttgggggagggggcataaaagaccactttaaatggggtagtccacaaagacctctcccaggaggtgatacatgagctagtattttaataaggagccagtcctgtgcaattaaggggagaaggctgcagacagatgaaatagcaatttgcaaaggtgggaacaagtcagttgggttaaatgaacaaaagaaaccaatgtgattttagcatagtagataagtggagagatcatgttggaccttatataccaagataaaggatttttattttatcctgagttagattaaagacacttggagcgttttaagaaagcaacattatctgattcatgtgcagcagatttggtgaacagtgctactcagcagaatacaagtataaaacagttttgcttttcttcaataccttcttgtgatgtcaaatcctttatttgctgagtaacaaatcttttcttaataatgtcttgggcagattccacaactacctggtcacgtttcttattaaatttgacccagtctaaaaatcataatttcatgtcaggtgcaaacctttccctcctgtatcacatgccaggtctgtagcttgaggtgcctaaattgtaaagatgatctagaatcctttcttgtctatctccagtactttggaattgttgtgcatgtgtgtatgtctgtgtgtgtgtgtatgtgtgtgtgtgtgtgtgcatgtgtaggggggctgtgtgaagttctgtagctccctttttctccacttcccttttcaggacccaactactctggtcttgggggaatgggaaaagggaacagggaagtaaaggcaaacatctcctaactgctaatacttgaggttctctctgctggtgttcttgtcttctcaggataattgaataccaatgccttttgagttaaaaaggctcacctctgggtattgggggcttccctactgtttcatttcctaacgtgagaaatccagctccagttcaccctcttcagcctctctcagatgtcactcgcacctgcaaaccccaaagtttcttgctgctggggaacacttgccttgtagcaagccctcttgtatgggacccagcaaagcagctcaagtttagccatcctctggggtgactactagatgcacaggaaacatatttatctttgcaaactgggtaataaaatgttaggtttctttttctattttgaaggctcccacaattgctttgagtgattctcttgtcttgaagaacaccttcacttggctcaagggtaaggacacttgtaccactgacctgtaaaagtgagaaaaaaaaaactctatattgtccattaggccaatgatgcacaagtctcagagtccttcctcctacccgttatatgctgctaacatgctaggtggtaacagaggtacttggatggactgtgacaacgatggtgttgctaccttccagaaagcctttggcagaatatttggtcccagtttttggcaatattctttattgtgaggcactttgcatccctccttcttcttctcctcatcctttctcattttcttccctttcttctttcttttcttttttaaagttccttatctaggcaatcattatcaaagtcagggcaacaggaatattcacattcaccacactgtaatatatttttattttaaaaaacattactctgacttctgtgtagtgaatgaattgtaagggaaaaagtggaagtagggatactattagggagctggtacagtaatccagatgagatgtaatagaagcttggaccaggttggtagcagagttgataaggattagtagtagttagattcaaaatacagttgtgacatgtcaatagaatgcatatagtaacacacaaataaagatgactactaagtttttggcttgaacaactggctggaaagtggtgctaattactgacctggataacaataagagaagaactggtttgggtgaaagctgtgttttggccatgttaggtttaagatgcctattaatcaccaatgagagatatctgaataagaagaatgaaacaaaattagattctcgtgtcactgaggtggctacagcagaaactttataggtatctggctcatcagtaatgagatacccatgtggtatctagttcaacctatgagccagaacttcagtctttccaatgacctatgccatgtttttcttcacaaatgcaaccattctggctcaccataatacctaacaaaaatcttctgtgcaatagtaaataccaatacattgagcaaaaggttcttacaaacctcagtataagaacaccttgagaatggcattactgaatataaaccacccttctttttaactgccttgtcatccacagcatagaactttgctcagctgtagaaagataaaggcatgaagatggtcactggggacagctagagataagacaatctacatagtggggacaggtggacaatgattgccaaataaatttgctgggtgtgtgagagtcaatcaactctacaactgcttcccttattactcctttataagtagtcctggttccaaatatcttccagggtgtcagtttcagataaggtgatcccatcaattaggtcatcaggtacatagagctggaaacttctggcaatattttcaattctggaggccagaaaagcaatagtaaatactattacactgagcaagaggctctggcagatctcaggcaatggaagacctcctctgctaaaagttttctccttgagtatctttctgactatagtgtgttgaatgatgatcccccaaaagaggaaaagtattaagttaaggatctcgagatgagatgaagattatccagataggccctatctccaatgacaaatgtttttataagagacacacagcaagaaggaaaaggccatgtgaaggctgaggtagagattggatttatgcagacacaagccaagaaacacctggagccaccagaagctagaagagataaggaaggtattctcccctagagctttcagagagagtgcatccctcctaacaacttgatttctgacagctacgtaacctccagaactgtgcaaaatatgaatttctgttgttttaagccaccaagttgtggtagtttgttatgttagccctagcaaatactgcctcactttctttatctcccttattaaaacataacatacatgcataaacatatacataagtgtacagctcaatacattttcacaaactgaacatgctcaagtaatcagcacccagatcaatgtataaaagcttcaacaccctagaagtcctccttgtgccccattctagtctacccaccctaagggtaaccgctattagaacgtctaacagcatagattagttttaactgtttttgtcatttatatgaatagaaacatacagtttacattcatttctggcttcctttacttgattgtgaaattattccatactgttgcacatatctgcagaggtttttttattgctgtagagtattcctcatacagaatgttttatttttcttttctttttttttcttttctttttttttctttatttcttctaaaaaaaaaccgggatatatatgcagaatgtgcaggttttttacataggtctacctatgccatggtggtttgctctatctattgacccatcctctaagttcgctcccctcacccccaccccccaacaggccctggtgtgtgttgttcccctctctgtgtccatgtgttctccatgtccaactcccacttatgagtgagaacatcctgtgtttggctttctgttcttatacagaatgtttttatccattttatccattctactgttgctttgcatatgaggagtttctaggtttgggccactacaaatagtgctgttatgaacattcttgaacacgtctgttgatgagcatatttctgttagttagatacctaggagcagaatcagtaggtcatagggtatgcttatgttcagttttagcaggtattgtaaaacagttttcctatgtagtcatacctgtttgcattcctaccaaaactgtatgggagtttcagctgttccacatcctcaccaaaacttgatattttccaacttttcaaattttagtcattctgatgagtgtcagtgttacattactgtggtttcaatttgtatttctttgattactaatgaaactgggcacttcatatgcttattgggtatttgaatacatttaagtcaaatatcttcaagtctcttgtctattttcctaataagttgtcttttgtactaatttgtataagttatttatatattctgcatatgagtcctttgctggatgtattgcaaatatcctctccaagttggtgagttgccttttctctcttggcataacatcttttaaagagtagaagttcctgattttaatttagtttgtgtgataaattttacctttaagaatggggcttttgtgtcctgttttagaaatctttgcctactccaaggtcataaaaatgttttacatgtttttaaaaagatgtattgttttgccctttactttagatctgtatatatctggagtcggttttcagttatggtgtgatagaaattaagatgtagttttcagttgggcatggtggctcacacctgtaatcccaccactttgggagcctgaggcaggaggatcacttgaggtcaggagtttgagacgagcctgggcaacatattgagaccaagtctctacaaatagatttgaaaaaatatatatatctgggcatggtagcacaatcctgtggtcctggctactcaggaggctgaggcaggatgatggcttgagcacaggatttcaaggctgcggtgagctgtgacagcaccactgcacttcagcctgggcaacacaggaaggccctatctcttaagaaaaaaaaaaaagatacagttctccccatatggcaacccaattcacataaaaccatttatttaaaagatcattatttctctgttgcactgcagtgttaccttcagcataaatcagttgactataaatgtgtcgatctgtttctgaattttatattatgctcaattggtccgtttgtttatccttgaaccagtatcaaacagtcatatttatcatagctttgtaaaagaaaatgaaatctggtagtatatgtcttccagctttgttcatcttaaagattgccttggttatttcttgcccttttgaattctaaatgacttttagagtaagcttgaaaattttggtcaaaaatactttttgcttaagattctgttaaatgtatttgttaatttggggagagctgacatctttataatgctgagtcttccaatccatgaatctcctcattcatttacaccttctttaatttctctcaattgtgttttgttagtcttgcaattctttcattagatttgctcctaggtatttgatagctaatgtaaatgtcatctttttttataaatttaaattgccatatgttgctgctatgtagaaataaaagtgacttatgtatactcaccttgcatccagtgaccttgcaaattttacttaattggaataatttatagattcttttgaatgttatacatacacaaatatgttgcctgggaataataacagttttatatatttttctaattcttatgccttttatttttcttatcatattgcactggctataactacagcataatgttgagtggaaatgctgatagtaggcatttgtcatttattcttgatttcaaggggaaggcttttgatacttcatgactaagtgtgatgtttgctgtagatttctgtagatagtctttatgagatcaagaaagttcccttttatatctactctgctaatagtttttatcttgtatgggtgtttaattttttcaaatgtttttctgcatctccttagatgatcacataatttccaccttttaatgttaatgattttgaatgctaaaccacactttcattcctagaacaaaccccacttgcttgtgatgcattttcctttatataaagctagattcgatttgataatacttttagtgtctcagcatctatgttcatgagagggcactttgtagatgtgttttcttgtaatgtccttactgctttgttttccatgttgatccaatggcacaataactaagtcaatgaagcataccctaagaaaggctgtgtcatccttggaatgttaggccttactctataagcatctttggactcccacacttcctgcctcaggctcaggaacttgatcagtagagggctttgcctttatgttagtcactctctttccctacctcttatatggctaatgagaatgctaggctcttttgaaatctcttgtgttgattttctccctcatgtaggtagggagagggtgaaagggctactgttcttagtcctgtcttctgtgtaggggagcccatcttctttttggggcaatattgaggttgggttaggttatcccttgcaaacttcctacgtatcctcccctgaaggattgcacctgagtcttaccctcaggtttcagtcaggtagtccgaagtaaagagtttttctgaccctatttcaccaaagggaagcctggcctgagggcagactagacaggcttggctcctttctgatgtatgtgacctatcttggtctaagtgaaaaagctgaggcttcctgcttactctttctccacctagctctctcttaaagctaatggagttatctctcaagattaatgaaactccttacttgaagaggtttgctaatcttgatttttccccacatagtgatgtcagaacaccttttcacttcaaagtcgaagatcacttctgaacaaacaagcttatttaattgattgagaaatctaggagggttagagtatagtttaagaggctacataggtagggcaagaggaggctgacttgattcaagaagggttgaagaagtttcagtggcttgttattaagcccaagctgctaaactacacttgccattttggctggtgatttcagggtctgatttacacggtggaggtctggcaggtttcttatgctcatgagtaaccccggaatgtttaaaaagataggaattatggaaggtttccctgcctgtaggtcagctgatctgttagatcttgctattggggaaggaaactcacatcttctgaacacctatagcaccctgcactgtgactcttattttatgtctatcttatctacatctcacaaaaactgtacatgtacgtattattgtcctagttttacaaaagagaaaaactgaagccctgatggcatgatgcaaattgcccaaggtcatctaattaagaaatgggatattaatttgattccacttgtattgaatttcaaaactgtgctctattggaacaggctgtgtttggttataggcaacagaaaatcaactcagtttaacttagacacaaaccagctaaacaaaaaggcatttattggctttattttaggaagaaattgctggaataatctaggaagaagtactagggtaactcatggaattgaagagctgtaggaaccaagattttggtgagtagaactagggactcaaagctgctaggatcctccttttccctgcatatctcttatctttgcttttctatgcaaatttctttcatgctctcttacttcagacagggttttgtccacttggcaggaaacatggctgacaagagcctcatttcagcaacttcagtgggtaaaaaacttcctttttcctagaatctacatatctcagtaaaggactgagaattgggctttatcaatcactgctgccagagaaggtgggatatcttccttggcaaaacctaaatcacaagcccacctagatttgcgagaatctgttacaagaaaaaggagaagaaaggaaggacagattacaaaaaaggaattcccacagactattaattgcatttgcttttcctactcactagggactactgcagagtttgacaagctttttttcccaagggtcagattgtaaatgtttttaggctttgtaggccacatactgtctcttttacttcttcttcatcctccttttcttctccttgcaatcctttacataggtgaacaccatttttagctcataggccatatcaaaacaggcctcaggctgaatatggtttggctggccagttttctgagctctggtttagtgaagttaagtaaggatccaggtctgagccattttgaaacagagcatgctacagtatcttaggatccagtcaactacacactgggaatgttcaaacctgtagctaaattcattaagtgaaataaggtagatgctttagtgagcaaggcaagaggaaactaacattggagtgcctaattggtgtgaagtgtcatgctaggcattttatataacataatctcattgagtcttcacgatatatttgtgaatcagatactattattattcttgtctgagagatgaggaaactgagactgagagaaaagttacttgtttaaagtccacctagccagtaagtgccatagccaaggttcagacacaagtttctgtggctaccaaaccaaaatactttacagtaattttagcatgtcagctgcaggttctgtggttggtgggttggggaggtggttcagtctagcaggcacatcaacagcaatagttgatacctccctagggtcacaaaaggatggtagtcgtaattatctttgggcatcacatctgtttcaatgaagtcacctggtatttttacagtttcttatattacactgacttttaataaccaacatggaataccttttcacaaaataatgttagccaaaggtgataggcaaggtgttttaatagataacaaagggtagttgcttcaatgttaatagaattttattcctttgagctcctatggttgtgtgctacattgatttgtggatagggagatttaacccacagtagattttgaaacagcagaatattgttttgatgaaggaatatagccaggtagaccccttcttactgtttttctgctcccccatataagagaaaacttgaagtagatagcagattgacgttatgctttcaggagtgtcttctttggacaatgataaattggtagcctttgaaatatgtccttccaaaaataaactagtacataccttcacaagtcatctgacattagttttctgctttatcttttgaggtctggcaggggccactaagtgaagaaaatgaagaaaacttatttactgtgtatctactacgtgtcaggtgctttcctaaaataagtttgtaagttacatagtatgattatcccattttaattaattttaatgattcttagtgtatgctaaacctttcacacccccatttatgaagaagttgagactcagagaaaggaagagattttctcaaggttacacagcttagcagatccaagatgatgatctcaagttagacacacaaactctgctcttttcccaatataccacactatcagcaattgttcactggtccctacaactcctggactagggcaagaaatagagtttatatttatgaagtttcaacattagcattttggcctatgggggtttctggagttcttcattatagggatttggagtacaatgagtcatgaggcattttttggcatgtaacataccttttttgaagatctatttatcccctgtaagctaatgctttttcccacagcatgccatgcgaaataattgtccccagtcaacccctctaccctggcttggtcctctcacagttctcatgtctgtacttatggtgcatcccaaggtgaagcctgtaaagtttctcttaagaaaggtcccaggcccttccctagggcctagaaaaataaaattttattttaaggtatattatgcataaataaaagaagcagaaacagagggaagcaatatgaatgagaatatgcaataatagataatagcttgcttgcttttctctctatataaacactatagtttacttttgcctgttttttaaagtttatatgaatggaatcatatgctatgttttcttttcttgtctcattgctttcactcaatattatgtgtatgagattcattgaatatattggttatggaagttatgcattcattcatgttgctaatcattttattgtacaaatatagacaaatatagcatattttatgaatttatgtgtcctccttatataaggacgatgctaatcatctattcatttttccaattttagtttatgtgctgtgaaagtgagcatgagccttggtttcttcatctgaaaagtgtagataacagaactagttaactcatcagtttgttgtgagaattaaataagacaggtataggtttagcattcatagtgcctggttggttttctattatttccacaatgagaggctttaatatacagagtatgtggttttggagccagagatacttggcattgattcatagttccattgtttcttgcttttctcaagtctcagtttgcttgtctgcaagatagagatgagtaatattccacaaccaagttttgtcataggagttctgttaaaaatgcagaatatctggcacatggtaggcacttggcatagtttgttgatctgtacttcatttttaaaaagtattctaaactgtagtgtttagaaatcacactggtgatgtgagagtatcgatttctcagtttaacatggagaaatagaactggaactctgtgtgtatgtgagtgtatgtgtgtctgtgtgtgtgtgagagagagacaaatacagagtgagagagacagagagagagaaaaggggagtgaaagggagaagtgattcaaggagaaatagtgaggctgttttcctgtgtgtggctttatagtcagagaccttgcctagacgcatggaggaagaacctttgtgaaatacagcctataaaagtaattttaaaaaatgctaatccaggatgtagtttttccctaggtgggggttctgatgagttgtttgtgtgagaaaagtgtagttattgctacatttgtctcagtgtgacaaccggacatgaattacacaccacccaatgcgaaaagttacccttggaacacatgctgactaatcagaaacaattttgccagatgttattaattgcagaaaagctcccctttcctcctcaggaagttgactcaaccctttcagaactttctgtttgttttgatggctgacaaggagagtgaggcatggaactattttatatcctcccaaataatttctatcctagtaggatgggttgtctattgtgcttcttttgtgtcctagaaggcaggacctgaaccttatccaccgagctgggtgatccttaacaaacatcaaatcctgaagatagttctggctttttgtctacacttttcttctcccattatcccccctaccccttgctgtacccaactccactttatctcccagacgtgaataaaacagctacggagaagccgtgatatcactgagtataaaaggctaaccaatggccaaaggaaggctggactcttccattagctcacttttgataagtcacttcctttctctggacgtcagttttaccatttgtcaaatgggaataagacacttcccagttctcacagggtcgctgaggaaatatgcaaaacaagttgtgcaaactgaaagccttcagtatatgtaaggcataataaaaacaaccaatacttattgactcattaagtgcttactatgaactaggtactcttctaaactctttattcacaatattttacttaatcttcccaacatgaggcaaatatgatttccatcttaaatgtatggaagaattaggtgaggctgagagaggtgaagtcacttgcccaaagtcatatggtctagtaagtgggagagctgagtttaaagccagaaaattggactgtctctactcttaaccagcttgctattctgtctctttgctgttattactacattactcatgcattctcatttgctaaatttcaattcaagtcccatcccttcagaaagacttgtctaaccattccagccattagctaaatatcccctcctgagttttttaatgatgctgtgttactaatttgatgcctagcactattgccttatcattccaaacatacttctgcttgagtttttcatagatgttaagctcatttgttcagatatattgtaagcttactgtgaaagcatattatatctcataccttggtatcccccatagtattgaggataaggtagaatgaagaactctcagaaacagaagggctctgaaagattttttagccaaggctctctttaaatgatggtctgactatagcaaaataaaaaagtaatagaaacaggatgatcatctttcttgcacctaatggtgtacatttttattagtgcagctcatgagtggttggttcattcatgcatttctttgactgacaatattgtggtattatatgttatgataagcagtgaaacaaaacagagtgaaaacagaaaaggatcataacaaagtccctgccctcaaggagattacaacttagtaagggaaggtggatatgtatattagtacatgggacaacatatttaagaaaatatttaagtatttaagtaaatatgtgtaggaagagtggggaaacacaaaactggagcaaaaggtaaaggagccatggaaattttcctggaagaggtgaatctggagctaaatgttggccattgagtacatgcttattagaaggccaaggtgagggagcatttccagtagagaaagtagcataagctatctgacatggaagtgtgaaatcattgaggtccttacatatcacactaaagaatttggattttattctataatcattaagaagacagtagaagactattctagcagcagttagagaatggactaaaagggaacaaagctgcaggagacagggagaccaattaaaagaccagatatatgaagggagaactaattagaatactatgtagatgaaggtcttaactaaggcagcagcacagaagattgggaggaaaacacaggcaggacatatattaacaagagagaaaaagtagggcttagttgctagctgaacacgtggagggtgaataaaagtgagagatctaagagtatgaatgtgcaggtttattacagcttaggtgactggataaatggtggtgtcattcaccgagattgagaacccaggatgaaaaacaaaattggaggaaacaaccatgagggtaggtttggacatagtgagttttagatttctgagggtatgcaggtagatattttaagtaggcagtcagttatatggaactgaagtcaagagaaaagactgggcactatgtcatttaaccctcacaaagactttatgatttaggaagcaaatttgacccctttttactaatgaggaaaacaaggcttagaagaggttaagtaattcacacaattagtaagtggcagagccagatttaaacccaggtcagtcctgctttaacacctgcatgcttaatcattgctgtaaataaagtactggcagtggatgggattgttgaaggtacatgtatagattgcaaaaataagagggtcaataggtgaaacttctaggcacaacaaacttttaggtgtatgaagaagaaaagactacagatgggattgagaaggaactatcaaagaggtaagaggagaagccggcatgagaagtatggcagaagctgaaagtagacaacagtcaaaggccatggagcaggggtcaaataagcaaggttgttgcaaagagacctcaggatccagcaataaggaggttgttgatacctgctagagcactctcagaggagtggtgagagtataatctggaatgcagcagattgtaaagtgagggaattgatagactgacgtgatacccttttgaggtgcttatcagtaatgaagaagggaaagacagggtggcagtctgagaaagatgcagagtagagggatatctttttccaactgggaagtggttgggtggagtgggatacatggtttgaggagtgggcaaagatacagaatatcgaatatggggaaaaaaacaagggactgaccaaggacgcattaaaaatactgccaagtgcagcactaaaggcctcacatggatttgtaggtgccctaatgtgccttgttccatgatagctgtaacctcacttaacagctttattgtgggaaggacaccacaccaaatttgttctcaaactttttccagcccagtgctcctgaagggcatgacatgaataactaacaatttctgtgcacttaccatctccaaagcactgttttaaatgttttacatatgttaactcatttaatccttgcaacaaccatagagtttaagcgtctattttcattccaattttacaagtaaagaaactagaatgcagaggatatgtataatgctagcaaactgaggagacaggatttatacagaggtggtctaagtatgattccatgcttataaccacaatgctgtgactatgagtcactataaggcagtgattatccactcaggctagagtgggtgtggagtttagctcccacttacaagtgagaacatgcagtatttggctttctgttcctgtgttagcttgctgaggatgatggcttccggcttcatccatgcccctgcaaaagacatgatctcattcctttttatggctccatagtattccatggtgtttatgtacatattttcttcatccagcctacagttgatgggcatttatgttgattctatatatttgctattgtgaatagtgctgagatgaacatatgtgtgcttgtgcatttatggtaaaacaatttacattcctttggatacatacccaacaatggattgctgagtctattggtaattctgtttttagttctttgaggaattgccacactgctttccatgatggctgagccaatttatactcccaccagcagagtataagcatgttcttttctttgcaacctcctaagcatctgttattttttgactttcaataatagccattctgactggtgtgagatggtatctcattgtggtgttgatttgcatttttctaatgattagtgatgttgaccactttttcatatgcttgttggctgcatgcatatcttcttttgaaaaacgtctgttcatgtcctttgcccactttttaatggagttgtttgcttcttgcatgcaaatttgtttatgttcttttagattctgaatattagactttttcagaagtacactttgcaaaaattttctcccattctgtgggttgtctgtttactctgtttgatagtttattttgctgtacaaaagctctttagtttaactgtatcccatttatcaatttttgcttttgttgcaattgcttttggcatctttgtcataaaatctttgccagttcaaatgtccaaaatggtatgtcctggctcttcttccagggtttgtatagatttagattttacatttaagtcttttatccatcttgatttaatttttgtatatggtataaggaaggggttcactttcaatcttctgcctacggctagacagttatctcagcaccatttattggggagtcctttccctattgcttgtttttgtcagctttgttgaaggccagatggccgtaggtgtgcagaattatttctgtgctctctattctgttctattggtctatttgtctgtttttgtatcagtaccatgctgttagattactgtagccctgtagtatagtttgaagttgagtaatgtgatgcctcctgcttgttgtttttgcttagatctgccttgtctatttgggctgtttgtttgttccatatgaattttaaaatagtttttcttctagttctgagaggagtgttatttgtagtttgattatttgtagtgttatttgtatcattgaatctttaaattgctttgggcagtatagacattttaatgatattgattattcctatccacaagcatggaatgttttttctatttgtttgtgtcatatctggtttctttgagcagtgtttgtaattctcattattgagacagtttacttccctagttagctttatccctaggtattttattcttttttgtgggaattgtgaatgggtttgcattcctaatttggctcctagcttggatgtttttggtatacagaaatgctactggtttttttttatgctgactttgtatcctgaaactttgtcgaagttgtttttcagatccaggagctttagggcaaagactatggggttttctggatacagaatcatgtggtctgcaaacagggatactttgacttcctctcttcatatttggatgccttttatttccttttcttgcttgatttccctggccagaacttcccatactatgttgaataagagtggtgagagagggcatccttgtcttgtgccagttttcaaggggaatgcctccagcttttgcccattaagtatgatgttggctgtgtgtttatcatagatggctcttattattttgaattatgttccttcaatgcctagttttttgagggtttttaacatgtagggatgttggattttatcaaaatataaatgctgtttttgatgaggtgttcagagaaagcctcaaagtaacatttgaacagagggtcaaatgatgtgaaggaatcagccatgagaataaatctaccagaatagagttcttagcagactaaatagcaagtgtaaagtccatgaagtgggaacatatttgacttgtctgaggaacagcaagaaaaccactgtggctagggcagagtgaaggaggggaagagtcatgctagatgagacttgtgatgtgaacaaaaactagtctttcctcttctataaactgcagataataatagtacttatagagctggagtaaggaataaatgatataatgcatgtaaaaatcctgatacaattccggcacatggcaagtgctcaaaaactaatatatgctatcattgttattattatcaggctgatcatgcctaattttgccatgcaggtggcagagtttgaattagaagtgtaagtcagagcaggagcctcttggtggagcaggcagagacaagagcatgagcagaaatgaagtagccataaataggaagcaagatcgacatacttcactggcgcaaacagactagagtggtgtcacacagaatgactaatatttaatatgagggagaaagactggaacattgacaacagggctgaaaaccattaaatcaagatggctcacaaggagaaggtcactagtctgacagtcaggaggctttgtcttcacatccataaaatagaaaaagtaactacttcataaagttgataagattaatgaaagcacctagcacagtgctgggcatgtaagaagggtagaaaatatagccagctgaaaattgttaagaactaggatgcatgaagagtcttcttgggctagagaatagagaactctgttgtccatgtcatatttgctccacaggtgcaagtctcatttgctagatggcattcatgatgattgcttcacactccctctgttttcatcctcatttgtttcttaaattcatggctttatattctgactgtagtccactgactctgaccccaccagaactcagaattattccacactttctcttcctgtatttggacccctggcatgccattttggttttgtatgcacctctggtctcctgtgcaactctattgtttaagggaaatatgaggattccctggccttgaagaatctaccctcaatcctactctcttaataagaaaatgaagaaagagagtgcaatgtgggcatctgtccatacaggatcccaccatcatcacaggaccatctcattatccccagatgctcgctgttcccggatccatttaataatgagcttggctcaatattaagcctctgcactccacccccacccactacacatagatttttaactgttttgtacttagggtagaaatgggaaaaggaagatatttatttggcacttcttgtctcaggcaagaattagtctgcactacagggcagataaattggtttaaaaattagtagagtcagctatcaccaaagtcaatagagcagagccaggaggaatgatgcaagagacaagtcattttaacactttctggagctaagtggggcataaaaaatagtttgaaagtactttgaattaggggattcagtttgtgcctaacatctgtccaaacctccttcttgtcctctgagtcagagttaatctgatcttggcttaaaacccctggaaaaagaaattaaccagctaggtcactgctgcttgggaatatattatgccaggaatcagaataatcaagaagaatgcatcagccacgtgattctggaagacttgctgtttgaggttggacaactctacaaaaacgtaaccattagactctgggctctggcaaacagattcccagtccattatacaacactgaggaaactgtacagcattttgagtctgaataaaaaatatattttctgtaaaattatttatttttctgcactccatttaggctatttgtttatgcgtgggtttgatgtgtgtagctatggcttgctaagatagttgaaaaggtttataagcaatgttcacttagatatggaactcatatcaatatgatggcaaagggtctggtatatgttatgttgtgaagagatgcaggattggaatttcaggaaatgatggaattacctaggtctttagaagagagggaagataggagtataaacaacctattttaaattccagtaaaaagtgagaactggctgaagatcaaggcacattggaaattaaccacagatctggggagttacatataacctaagctgtctggcaacttcaaaaagcaactattcctggtgtaaccctactagctgacacttgagacaatataaaatgctgtcaccttgcccttgcactattcctgacagaaaagatctaaggtcctttgataatagtcacttgccaaggtccaagaatagattgtctttcaggtatctatctcactttgttacaaggcaatcatatagacacacattttctggaaggcatgttctggaagaaaataaaaaatcttagaaatattcatgggttttgatctagcaatccccattctgagactccagtctaaagaaacataaaaaaaaacctatgtatttggggagttttgtcagaaaacatttttaacttgcagtatttaaaagaatatttactgttcccaaaatgtcattcaaatgcacgtattgtcattgtttggggatgggaactagttttgcaaaaaaacacctaatgttgtataataatgccccaatgatcttgctggttaaaaatacagtatttttggccacaataaaaaagatagtgggaggaaacttttgaaggtgatgggtgtatttatggcattgattgtggtgatgatttcataggtatatacttatctccaaactcataaagttgtatacattaaaaatgtacagctctttgtatgtcaatcatacctgagtaatgtggttcaaaaatgatatacatatacatttatgcataagattgtttattacagtggtgacgcttttcatagtaacacatttcaaacaatcttaatgtccaataacaggaaaagactaaatgaatcatgttgtgatgcaatattatgcagccagtaaaatgatgtttacatggtgttttaaaaaatgaaattagactatgtttctaatgtaaagttatataaaaattatacaattgtacatatagtataaacttaattatgtaaacacattatgtattgtgcattaatgtatgtatatatacatggaaaacatattagaaggaaatatacctaaacattagcaatgattatcattgtttaacaggattataagtgatttgtattttcttctttattttgtgcatttttcctagaagcagagagtagaatgattgttaacagggtctggaggtggcagggagattggggacatgttagtcaaaggatacaaaatttctattagacagaagtaataaattcaagagatttactgtaaaacatggtgattatagttaacaacaatatattgtacactagaaagttatttaagacagcaggttttaagtgttctcaccatgaataactgaaaagtatatgaggtaatgcacatgttaattagcttgacttagccattccacaacgtgtatctgtttcaaaacatcatgttatacactgtaaatatatacatttttgtcaatttgaaataaattttaaaatagatattaaaataaagaatcatgttactagcaatctcatgactatattatgttttatgaccataaggattttgcagatataataaaggtcccaatttagttgattttgagttaatcaaaagggagatcattctgtctgggcctaacctaaatagacaaaccctgtaaaagcagtaagcattctcctcttgtcttgaaggaagaaaacagacatctatgctgtgaactgcttaaggaaagcagttgattgaaagaactgagagaaattcctagcagacactagtaagaaaacaaggaccacagtcatacaactgcaaggaactgaattctgccaacaacctgaataagactggaagaagatcttgagacctaaatgagaagcacaggattggccaaaactttactgtaatctagtgagacctgagcagagcagaatatccaattaagctgactcctgacacattgaaatggtaacataataaatgaatattgctttaagttgctaggtttatggtaatttgttttgcagaaaaggataactaatgcaacaataatcaaatgaacagctttttttattttattattattatactttaagttttagggtacatgtgcacaatgtgcaggttagttacatatgtaaacatgtgccatgctggtgcgctgcacccattaactcctcatttagcatcagttatatctcctaatgctatccctcccccctccccccaccacacaatagtccccagagtgtgatgttccccttcctgtgtccatgtgttctcattgttcaattcccacctatgagtgagaatatgtggtgtttggttttttgttcttgcgatagtttactgagaatgatgatttccaatttcatccatgtccccacaaaggacatgaactcatcattttttatggctgcatagtattccacggtgtatatgtgccacattttcttaatccagtctatcattgttggacatttgggttggttccaagtctttgctattgtgaatagtgccgcaataaatacgtgtgcatgtgtctttatagcagcatgatttatagtcctttgggtatatacccagtaatgggatgactgggtcaaatggtacttctagttctagatctctgagaaatcaccacactgacttccacaatggttgaactagtttacagtcccaccaacagtgtaaaagtgttccaatttcttcacatcctctccagcacctgttgtttcctgactttttaacgattgccattctaactggtgtgagatgatatttcattgtgcttttgatttgcatttctctgatagccagtgatggtgagcatttttttcatgtgttttttggctgcacaaatgtcttcttttgagaagtgtctgttaatgtccttcgcccactttttgatggggttgtttgtttttttcttgtaaatttgtttgagttcattatagattctggatattagccctttgtcagatgagtaggttgcgaaaattttctcccattttgtgggttgcctgttcactcggatggtagtttcttttgctgtgcagaagctctttagtttaattagatcccatttgtcaattttggcttttgttgccgttgcttttggtgttttagacatgaagtccttgcccatgcctatgtcctgaatggtaatgcctaggtttgcttctagggtttttatggttttaggtctaatgtttaagtctttaatccatcttgaattgatttttgtataaggtgtaagggagggatccagttacagctttctacatatggcaagccagttttcccagcaccatttattaaatacggaattctttccccattgcttgtttttctcaggtttgtcaaagatcagatagttgtagatacgtggcgttatttctgagggctctgttctgttccattgatctatatctctgttttggtaccagtaccatgctgttttggttactgtagccttgtagtgtagtttgaagtcaggtagtgtgatgcctccagctttcttcttttggcttaggattgacttggcaatgggggctgttttttggttccatatgaactttaaagtagttttttccaattctgtgaagaaagtcattggtaacttgatggggatggcattgaatctatgaattaccttgggcagtatggccattttcacgatattgattcttcctacccatgagcatggaatgttcttccatttcttcatatcctcttttatttcattgagcagtggtttgtagttctccttgaagaggtccttcacgtcccttgtaagttgggttcctaggtaatttattctctttgaagcaattgtgaatgggagttcactcatgatttggctctctgattgtctgttattggtgtataagaatgcttgtgatttttgtacattgatttcgtatcctgagactgctgaagttgcttatcagcttaaggagattgtgggctgagacaatggggttttctagatatacaatcatgtcatctgcaaacagggacaatttgacttcctcttttcctaattgaatatcctttatttccttcccctgcctaattgccctggccagaacttccaacagtatgttgaataggagtggtgagagagggcatccctgtcttgtgccagttttcaaagggaatgcttccagtttttgcccattcagtatgatattggctgtgggtttgtcatagatagctcttattactttgagatacgtcccatcaatacctaatttattgagtttttagcatgaagggttgttgaattttgtcaaaggacttttctgcatctattgagataatcatgtggtttttgtctttggttctgtttttctgctggcttacatttattgatttgcatatattgaaccagccttgcatcccagggatgaagcccacttgatcatggtggataagctttttgatgtgctgctggatttggtttgccagcattttattgaggatttttgcatcaatgttcaccaagggtattggtctaaaattctcttttttgtttgtgtctctgcctggctttggtatcaggattatgctggcctcataaaaggagttatggaggtttctattgattggaatagtttcagaaggaatagtaccagttcctccttgtacctctggtagaatttggctgtgaatccatctggacctgtactctttttggttggtaagctattgattgattattgccacaatttcagagcctgttattggtctattcagagattcaacttcttcctggttcagtgttgggagggtgtaggtgtcgaggaatttatccatttcttctagattttctagtttatttgagtagaggtgtttgtagtattctgatagtagtttgtatttctgtaggatcggtggtgatatcccctttatcattttttactgtgtctacttgattcttctcccttttcttctttattagtcttgctagtggtctgtcaattttgttgatcctctcaaaaaaacagctcctggattcattaattttttgaagggtttttttgtgtctctatttccttcagttctgctctgatttaagttatttcttgccttctgctggcttttgaatgtgtttgctcttgcttttctagttctcttaattgtgatgttagggtgtcaattttggatctttcctgctttctcttgtgagcatttagtgctataaatttccctctacacactgctttgaatgtgtctcagagattctggtatgttgtgtctttgttatcattggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagatagtttgttataatttctgttctttcctatttgctgaggagagttttatttccacctatgtggtgaattttggaataggtgtggtgtggtgctgaaaaaaatgtatattctgttgatttggggtggagagttctctagatgtctatttggtccacttggtgcagagctgagttcattttctgggtatccttgttaactttctgtctggttgatctgtctaatgttgacagtggggtgttaaagtctcccattattattgtgtgggtgtcttagtctctttgtaggtcactcaggacttgctttatgaatctgggtactcatgtattgggtgcatatatatttaggatagttagctcttcttgttgaattgatccctttaccattatgtaatggccttctttgtctcttttgatctttgttggtttaaagtctgttttatccgagactaggattgcaacccctcttttttttgttttccgtttgtttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaattttatcctgtcattatgatgttagctgtttattttgctcattatttgatgcagtttcttcctagcctcgatggtctttacaatttggaatgattttgcagtggctggtactggttgttcctttccatgtttagtgcttccttcaggagctcttttagggcaggcccagtggtgacaaaatctctcagcatttgcttgtctgtgaaggattttatttcttcttcacttatgaatctagtttggctggatatgaaattctgggttgaaaattcttttctttaaaaatgttgaatattggcccccactctcttctggcttgtagagtttctgccaagagatcagctgttagtctgatgggcttccctttgtgggtaacccgacctttctttctggctgcccttaacatgttttccttcatttcaactttggtgaatgtgacaattatgtgtcttggagttgctcttcttgaggagtatctttgtggcattctctgtatttcctgcatctgaatgttggcctgccttgctacattgtggaagtactcctgggtaatatcctgtagagtgttttccaacttggttccattctccccgtcacttttaggtacaccaatcagacgtagatttgttcttttctcatagtcccatatttcttggaggctttgttcatttctttttattcttttttctctaaacttcccttatcacttcatttcattcatttcatcttccatcgctgacaccctttcttccaattgatcacatcagctcctgaggcttctgcattcttcacatagttctcaagccttggctttcagctccatcagctcctttaagcacttctctgtattggttattctagttatactttcatctaaatttttttcaaagttttcaacttctttgcctttggtttgaatttcctcctgtagctcggagtagtttgatcatctgaagccttcttctctcaacccatcaaagtctttctccatccacctttgttccattactggtgaggtgctgcattcctttggaggaggaaaggcgctctgctttttagagtttccggtttttctgctctgttttttccccatgtttgtcgttttatctacttttggtctttgatgatggtgatgtacagatgggtttttggtgtggacgtcctttctgtttgttagttttccttctaacacacaggaccatcagctgcaggtctgttggagtttgctagaggtccactccagaccccgtttgcctgggtatcagcagtggtatctgcagaacagcagattttcgtgaaccgtgaatgctgctgtctgatcgttcctctggaagttttgtctcggaggagtacccggccgtgtgaggtgtcagtctgcccctactggggagtgcctcccagttaggctgctcgggggtcaagagtcagggacccacttgaggaggcagtcttcccattctcagatctccagctgtgtgctgggagagccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccatttcgagcttcctgcctgctttgtttacctaagcaagcctgggcaatggcaagcgccctcccccagcctcgctgcctccttgcagtttgatctcagactgctgttctagcaatcagcgagactccatgggcgtaggaccctccaagccaggtgcgggatataatctcctggtgtgccattttttaagcccatcagaaaagtgcagtattagggtgagagtgacccgtttttccaggtgccgtctgtcacccctttctttgactaggaaagggtactccctgaccccttgctcttcccaagtgaggcaatgcctcaccctgtttcagctcacacacagtgcgctgcacccactgtcctgtgcccactgtctggcactccctagtgagatgaacccagtacctcagatggaaatgcagaaatcacccgtcttctgtgtcgctcccactaggagctgtagaccggagctcttcctattcgtccatcttggctgccactctgatcaaccttaatattaccaataatatgcctccttatgttatacactgaagaaaatacattaccaacgcagtatttctgtcaaaaatgtttaacgagggactaatcattagaaaactatcagacatatctcagttgtgatgtattctgtcaaacaactggcctgaatttttttaaaatatcagtgtcacaaatgacaaaaaaggccaggatactgctttgattaaagaagattaaagagacatgacaactaaatgcaacagacgatccctgactggattttagataagaaaaaaaagacaagtgtaataaaaattattaagacaaatgaggaaatttgaatataggtaatggtgttatatcaatgtcatatttcttgattatgatgatcatattaaggatatgtaagggagtgcccatattcttaggatatacatgctgaagtacttcatgaatacaggtcaagcattatgatgtctaaaattaactctcaactatctcaggaaaaagtataataaccactataaaatacatacacatatacacacacacatacacactaaggcgggaggaaattgggagactacttatgagcatacatgaggaaaaatgctaacaattaatgaatttaggtaaaagatatatggtgttcattggactgttctttcaatctttctgaaagtttggaatttttcagaattatgttacgaaaagaaaataagagatgaaatcatgtatgtaaaatgtgtctactaaagcacctgacaaatagtacacattcaattaatggagatactgttgtcactgaaataaatactcagataaagtcacatacgcagctctctaccctctgaggacccaaaattcagagctgttgaaacatgagcccatgatcttccagtccacttactgcaagagccaaagtatacatgccttccattctaggatgtgcattgcctgaacagtcactagacatttgccatcccaagtccactctgatgtaccttcaagccctgtgataaatgagacccagagaaagtgcctctgtgctgatgatgggaccaggtcattctgctgctgcttgggacatattactgggtcagtcgcagcagctgactactatctactcatattgaaatccaagtcatgagccctacaagagttattcatgggatgaaggtgatatactttcatctgtccctctttgtctaccaatgcccttgccctcttcataatgaaaatcagagagctaaccttgactgtagtgcttggagtatacgagtcaggcagcaaaaaggggaaaggagtgtcaaggaattaaataagacacagccacatatcacagagggccctgtctgtcaaattgaaaaattttgactttttactctaggtcattcttgtcaaattaggacataagtttaccgagcatgcatagcaactgttagggagtattctaatttacttgccatataattttgatatgacactattattcaataacaatagaaactactttaatattttaaaacatacaaggagatattatagattagaatatgaactttaatatttatgataaaacacaaaattacaaagaaatatcatgccttcaagatgtccacttcaggccacatttctaggtctctagtgataaaagttcacaatattttgccattagaggtatcattgcagatgtttaggcaactcacattgtagaagacaggcggagcagaaatattttaagcaggtggacaaaatgacaaaataaacatttggaagatgactctgatagctactgtggaagtaaaagagaccagaaaccacgtaggagattatttgaattgtccaacaaaataaaaagggagctaacccctaaaacagtgtagatgaacatcacaaatactatacatacctgaatataagatgactcctgaatttaagcaatccatcattctcctaagaagatcccctccaaatattttttgacaaacatgaatatgtacaaatatttagagatagaaataaattaaatatcttttattatttttaatctagctacatatataactttaaaattgtatagtttattatctgaaaagaatccacaggcagaatgaatgaatgaaaggacaggtgggcatctagggtggatctggggtaagtctagaatttctagtttggatcagagaatgattgaaatgataatgttgccaatcacttaaaagggaaatatagggtatctgacttttttgaagaagtggagggtgaatttctgaatatgataagtttggtttttaatatattgaggttgaagtgcctggaaaacatgagggggaaatgttcagttggcagttggcaatataggtatggaacctaggaggtattgggggatagaaatgttgtatttattgataagtcttcatggaaatggttgatattattgaaggagtttttcaagtgagaagaggagggatctacccagaatcctagaaaaccccaactctgtgcaggggaaggagtgaaagaaaggagtcagtgaagaagcctgagatgaagtggccagagaaccaggaaaggagaagaagaaccacgaaagacaacacagaagcagagaaaggagattttacaatgaggtaatcatagtgatgtttaattcattgatcatagcaaaaataaaaacatttcacaaaagtggtaaaagcagaagctaaactaaagcaaatatggaatcactggaaagggaaaaagtagacacaatatatagacttttttttttttcctgtaagcttggcaatgaagggaagaaaaaagagaatatcaagaagaaaatgtacagtcagggacagtgcttcttttttgacaggtaacataataattttttaaaatatattgttagtaagaaaaatttcaaataaaaatcaaaagaaatagcatattgaactaccttatagccattacccagtttcaacagttagcaactcatggctacttctgtttcatccgagcccaccatccgttttctcccttttccattgtaatctgaggaaaatccccaaaatcaaattatttcatctataaaatatttcagtatgtatctctaaataaggtttccttttaaaagcctatctacaattatatcacacctaaaatattaatatttcaaatatacgacaagtgtccaaatgttgctcatcttctaacttccatgtgtttattcaaataaggatccaaataaggtccatatgttgcaaataatgtatctcataagtctctttttatatataaattatcagagagtttattttgttttattaaattttaaagataccagaacacatttctatgggaaacaggataatctctatacaaaggatgctgaggatattggatgtgggatggatatggaattacataactatttcttgaacacttacgtgtcaggcactgtgctaagcacttcatatacaaatattatctcactttaattatcatgaacaccctgagaagttattattatcattcttgtattggtctggactatttcagttgatgtgaaaaaaaatcaaattgatttaagcatttaagcagagaaatgaattcactgaccttcatagtcaagttatagaagaacatgattgccctgtttcctgcagtatccccatgcctaaaatagttcctggactaatacagtcactcaacaaaaatttgttgattgaataaactgaaacaatgaaaaggtatatggcttcaggcatgactgtaactaggggttcaaactacatcatcaggacccaatatcttgcagttgtgctttcctctgtgtgaataccactcttattaagacttcatccatggggtggcccctagtagcaagatgtttatatcaacccagattctggtccataaacaagaagtctcttcctgcattgttcaaagaaaagtcttaaattttactggaacaaattgagtcttgtgtctatctctgaaccaatccctatggtacacaccaattgtttaaagagagatccagtgtccgtgtaaggaacaatcactgtggctaagaagataaatttttgaatggtcatgcctgggggacaagcccattcccacagtcaagagtgaaataagcttcccctcacccaaccatgtaggctggaagtggagaaaaggtcgttcctggaggaaaaagacaggttctgctaccagaaggaggaatagaagctgagtaggcagaaacaacaaatgtcccagttttacagaagaggagcttgagtaaactgcccaaaatagcagtagagaagaatggttaggagcataccttacagagtgaccaatctgtattcaacccctcattttccacttcgtggtcatgtaaccttgaacaagtctattattaccctcgtaatcctcagttgatcatctgtaaaatgagggtaaggatagaatctacctcatatgtttgaggtgaaaattgagtagtagtaatgtaggaaaagtacaataatacagtataataatactataatatagtaagcactcaagaataatagctatcaatagcactcaagaataataactattaatattgctcagtcacacaactagtatgggacaaaataatgtactaagctacaaaaagaaatgaaagcgtgcatgggtacatgcccttttatcatttctgtgccatttctgagaagagaacacctggcagagtgtgattatagactgagaaaaagatactaccacgatcagtgcatgtttagaaatctagtgttattgtctaaagggataatcagcacccagtggcagttttcactgatcttaaaaccttcaatatctctccctcaaaggcctgggacctcacctgtcactggccacagtctaaggcttttcatccaaatcatttatatctgtagataccagaaccactgaagtaatgtttggaaaacacaagaactgagccaccttgaccttggaatctacaaagctagcctacaggaaaacaaataggttatttagtcaaatagtcatatagatcttggttaaaactttggctctgcccgtttataaaattgtgaaattcaatttacttctgagactatcagtttttttccatgtgtaataatggggataacaactcttgcctcacaaaattattctgaatattggatgatgtcaacatgtataaagcagcttagtacattacctgcacagaaactgcccagtaagtgaaattttcgtctctactaccatcaaaccattggccatccccttaaggggtcatgtttgttgactttcttacagtcctaccttcacttcagtactgcacatcctttttcagtcttgaaagatacactcatcaagattactcacttgggaaaaaaaagatgagatttgcatagctttgtttgttttttgtttgggtttttaatttttgtttgactcaggatttaaaaactgaaacagtgaagatgacagcagttggttgaagcaacatttcctataagtctacaatatgaccaagggctttgtacttttttaaaatagtcattccaaatatcataaaatgcagtgttacagaaagtcccttgaactccaaaaagctgccccacttcaccagaaagacaatggcccagttctcacctgagtccaaatagagaaagtgacaaaattgtttttgtgtaaattattttcatcttgggcattttttacacttatgccttaatacttttatactttttaaaagtattgttttattttgactgatcagccatcatggtcctgtcaatgaaggattttggtttcccctagagtaagtagaggtgtggaggcagtcaaggcttacctgtacagtgacaggaccagttcagtaaaagtgtatgccttttaaaaatttctcacttgttccagcctacaatacaccaataaaactttgactttttctgacatctgacttcatagaccctggaccagataactgcagatgctaaacctctttttgtgtcttgatatcagacaggcctcttctagagctttttaaaaaaaaaaaaattctttatttttattttttatttccatagcttattgaggaacaggtggtgttttgttacatgagtaagttctttagtgatgatttgtgagactttggtgcacccatcacccaagcagtatacactgcatcctatttgtagacttttatccctcaccccatttccatcctttcccactgagttcccaaagtccatcatgtcatccttatgcttttgcatcctcatagcttagctcccacgtataaacgagaacatacaatgcttggttttccattcctgagttacttcacctagaagagtagtctccaatttcatctaggtcactgcaaatgtcattaatttgttcctttttgaacagaaaaccaaacaccgcatgttctcactcataagtgggagttgaacaatgagaacacatggacatggggaagggaacatcacacaccgggacctgtcaggggttgggggacaagaggagggagagcattaggacaaatacctaatgcatgtggggcttaaaacttagatgatgggttgataggtgcatcaaaccaccatggcacatgtatacctatgtaacaaacctgcactttctgcaccagtatcctggaacttaaagtaaaatttttatatgtatataaattttatatatattttatatataaaatatatgtatatatttatataaatatatataaaaatatatttatttatatatatatttatatataaatatataaatatatttatttatatatatttataaaaatatatttatatatatttatatataaatatatttatatatatttatatataatatataaacattatattatatataaatataaatatatatattccttcttacgactgagtagtattcacgtgtgtatatctcacagtttctttatccactcgttgattgatcggcatttgagttggttccaccattttgcaattccaaattgtgcagctataaacatgcatgtgcaagtatcttttttgtataatgacttattttcctctggaaagataccatgtagtgggattgctggattaactgctagttctactttagttctttaaagaatctccatagtttttcatagtgattgtactagtttacatacccactagcagtgtatcagtgttctccgttcactgcattcgtgccaacatctattttttttttattttttgattatgacgattcttgcaggagtaaggtggtattgcattatggtttttatttgcatttccccgatcattagtgatgttgagcattttttcatatgtttgttggccatttgtatatcttcttttgagaattgtctattcatgtccatagcccactttttgatggaattgtttgttttctccttgctatttgtttgagtttgttgttgattctggatattagtccttttccagatgtatacattgtgaagactttctcccactctgtgggttgcctgtttcttctgctgactgttccttttgctgtgcaaaatctctttagtttaattaagtttcaactacttcccgtcgtttttattatatttgcttttggtttcttggtcataaaattattgcctaagccaatgtctagaagggtttttccaatgttatcttctagaatttttacagtttcaggtgttagatttaagttcatgatccatctttggttgatttttgtataaggtgagagatgagaatccagtttcatttgcctacatgtggcttgccaattatcccagcagcatttgttaaataggatgtccttttcccactttatgtttttgtatgctaagtcaaagatcatataagtatttggattcatttctgagttctctattctgttccactggtctatttatttttattttttttattttttttttgccagtaccatgctgttttggtgactatggccttatagcatagtttaaattctgtcaccacacctcttcaacatagtactgagagtcctaaccagagccatcagacaagagaagaaataaagggcatccaaattggtaaagagaaagttaaactgtcactgtttgctgatgttataattgtttacctagaaaaccctaaagactcctccagaaagctcctagaactgataaaagaattcagcaaagtttctggatacaaaattaatgtacacaaatcagtagctcttctatacaccaacagcagacaagctgagaatcaaatcaagaacccaaacccttttacaaaaaaaaaaaaagaatgcttagaaatgtacctaaccaaggaggtgagagacctctacaaggaaaactacaaaacactgctgaaagaaatcatagacaacacaaacaaatgaaaacacatcccatgctcatggatgggtagaatcaatattgtgaaaatgaccaggctgccaaaagcaatctacaaattcagtgcaatttctatgaaaataccaccatcatttttcacagatttaaaaaaaaattctgaaattcatatggaactaaaaaagagtcagcatagtcaaagcaagactaagaaaaaggacaaatctggagacaccacattacctaatttcaagagcctttaaactcaagtaaacctattgtctttaatctacactgccaactacagagcataaatatgaagtaccagtaaaatgtcagagcaagacctcttgtccgcttttatattagtcaccttgacattccccacagcattgtgctacaaaatgcctcccatcccctcactcagagctatgatttgctgtttccttttgcagcaaaatgccactgtcctctcccacattttctcgtatgctgatattggacatatgctataatctgatgagtttatcctattggcatcacaaaatcttatcatttccttattagaaaggtatcatctttctcacataacataattcagacagcttgcagattctcagagagtctagatcatcaagatggctgacaacccacagtcattacaaagaaggaacaaaacagcagctagataaacagacgttgaataggccatttagggaagaatgctagaatccagcaaggaagttacagagaccctcggatgcacaggagctcaagatagcagcatggagagggtaaaagggcagtgagtgaattaacttggagccatgagcattccccattgttgaagaaaagttaagagacatctacagcagtccacattcctatggaacatacctggagtcctacctacaggagagacccttggcactcatgggccctgagccaagtatagggagctacctgaattctgtacaactgttccagagagggaattcgtgccaggttccacccaccagccaggtcctaagctgctgcagcacagtgccattttgagagtggaaaccacacccaactacatcgtgcccagaagatacttaatatcccctgcattttcacaacccttgggctcaactgacatcccctacatccacccagaggactgcagcatcatgatgccagtaggaactagcagtctgacgatgttgccagcacccaagtgtcttaccaaaaaaaaaaaaaaaaaaaaaggtagtccagcacatcagagaggctaccctcagaaacagggaattggagcatgtgttccccaggacctgagagcaatttatttggggccactgccaccaggagtgattcctccctcctctggcagtgacaccaataggcacccttgaaacttgcccagaagcctggaaactggcccacctgacttgccacagccactaccagtgcctatgcacattgcccagggatctaggactagaaagtccagggtaagatgtcactaccgacaatgcccatgcaccccatccaggggtgaaagaagtggcctatgatggccaacgtcaatgcctgtgtgcaccacttggaggcactaagagaagcttgaccagcctgccatccacaccactggtgtgtgtgcactccatttggaaactctaggactagcctgcctgggacctgaggccatcacagctggcactcaagcatgccacctgagtgccccaaaaccagcctgacgaagccactgttccctgctaccactgctgctggtgcccacatacacaacctaggggactgaggactggccagctgacaaccaataaatgaatgtagtagagttgcaggctacaaaatccacacacaaaatcagtagcatttctataccccaataatgaaagagttgaaaaagaaatcaagaaagcaatcccatttacaatagctacaaagaaattaaatatctaggaataagtctaaccatgaaggtggaagctttctgtgatgaaaaatacaaaacattataaaataaatagaagtggacacaaaaaacagaaagacatcccatgctcatgaactgtaagaattaatattgttaaaacgaccatactatacagtaatctatagattctatgcaatacctatgaaaacaccaatgacattcctcacaaaaatagaaagaaaagcttcaaattaatatgaaaccagaaaagaccctgaatacacaaagcaatcttgggcataaagaacaaagctgtaggaatctcactacctgacttcaaaacatactacaaaactacagtaaccaaaacagcttggtacagttataagaacacagaaagatcaatggagcagaacataatccagaaataaattcacatatttacagccaactgattttcaagaaatgtggcaagaacatacattgggaaatggacactttcttcaatatatggtgctgggaagtctgggatagtcatatgcctaagaattaaagtagacccctatctttcaccatatgcaaacataaacttaaaatagactaaagacaaacatgtgatccaaaactataaaactcctagaagaaaccacaggaggaatacctcaggatatcgtttaggaaaagatattatggtaaaacttcaaaagcacaggaaatacaaaataaaaataggcaaatgatattatatcaaactaaaaagtctttacacagaaaaagaaataattagcagagcaaagagacaacctgtagaatgggggaaaacatataaaaactatacaggcatgaatatctaaaatacacaaggatctcaaataattcaacaataacaacagaaaaacaaataaatccaattaaaagtgggcaaaggatccaagtaaacatttctcaaaagaagacacacaaagagcaaataaatatattttaaaatgccaatgtcactaatcatcagggaaatgcaaagcaaaattataatgagatatcacttttctccagttagaatgcctatcccagaaaagacaaaaaaaataaataaatactggcatagattcagagaaaagggaactcttatataccattggtgggaatgtacattagtaagccattatggaaaatagtatgaaggattctcaaaaatctaaaactagaactactatataatccagcaattctagcactgaggatctatccaaaggacaaaataatcagtatatcaaagagacatctgcatcctcatgtttattgtagctctattaacaatagtaaacataaagaatcaacctaagtttccaccaatagataagtagataaggaaaatgtggcatatatgtatacagttgaatactgttcagtagtagaaaaaatgaaagactgtcatttgcggcaacatgattgatcctgcaggacattatgttaagtgaaataagtcaggcacagaaagataaatactgcatgttctcacttatatgtgggagcaaagaaaattaagttcatagaagtagaaagtagaatagaggttattagaggttggaagtgtggagtggaggagaagataaggagagtttgattaacagattcaaaattacagctagatagggagaacaagttctagtgttgtgtaacaatgaagggtaaatatggttaacaacacttactgtgtatatttaaaaagctagaggagaggattttgaatgttcacaacagaaagatataaatatttaaggtgatggctatgctaactatcctgatttgatcattacacattctgtacatgtatcaaaatatcactctctatcccacaaatatataagtaattattacatgtgaactgaaaataataggaaaaaaatgtagagtcttaagtccttctctgacctactgaaccagaatctgaattttaataggatctccaggtaattaattggcatgaatgtcctgccaggcaataaactctcaacattggggttcgttttttcttactgaacacaaacacacaagttaacatgtaatattagagtatgtgcccttatttaatagtaactaacacatcacaattgtatattattaccagtaagcctattaaacaatacttccggcatgtagtttttatactggcctcttttctaggtttttgcaatatttcttaaagagagatacccctgggaaagtggctcttgagtgttaacattactgggaccaaatttattagctgctatgtgtttctgttagagaaagtgctggaaccatgtaaagctttcggggaaggaaaaaatcagaggtgcataaaaaaagagtagaggatgtgaaaagtagctaaaataaaaatatatactaacagttcaaaacagataaaaaaggtgggttttcagactagaaataaatatttagagggcaagcattagagaaatgatagggaactccggtttccttctgttttacattctcttaggaaaatatggtaaatatatggaatgcatatatctaccatacttcctgtgcccatgacagacatcagtaactgactgtgctggcatgtccagctcaaatgacacaacctaagaatccttctatatagagactccaatcttctaccactaatcaagaggagttgggaaacaagtttctcaatggatgtgttgaggcctatttgaaggatgggtgggcaacacccatctctaggtatacgatatgattgactcaggtacatcagattaggatgtttttgtttttgtttttagctaagtcttggtcaagagaatccaggtactactcattgcaactccaaactgcttccaaatcagagttctacctgaatgtgaagtaagggaataacatggagatgaagttcctctactacattttatccattcagcattttatcatcatcaacatgatacatacgaggcatcagaagtcctagattaagagaattccaagatgatgaaagaagtctcataattcatatggttaacctacaattctgcccctatttttcacattgactacatcaataactaatctacctaataaaattttaactgtggcattctaggatttaaaatgctatctgattctacttatcctgtaatatccctacacaatctagtcttataatatcatgtgacaagaagatcgaagcacaggggaactgtatttctacccaattctaaggaaagctagttcctgataaagccaactatccctgtaagaagtggaactactagcatcaggcttgcctacatggcttgtggcattaccacacaggaacttggcactccatgatggtatggttcaaccaccataaatgagattagctgaagcaaactggagtggggagtaattattggaacacttcaaattccacatcacttatgtaatgggcagccaaaactgccagtagtcaatccataaggctagaatatctggggcataagagttcagcctatcctgagagtccctctaggcagaaaactttgtagtgtttggtaactcagaaaaggcagtactatataacagatatagaaccactcatggaccaccaccccagaacgcatagaatatatgaagagagctactacccaaatcgtccactctacatccaagaaaagagaaacctctctcaaatgttgtggctccaccatagtgccaaaccagtatgctactataattccttcaaaaacctgcaatacagcctgaagacttctggaggctctgcattcaatgtctgtgccacctacctttggactaaatgaagtaattcaactatcaataactatacccagtttttagtcttaatccctaaaaactcctgcagcagtatgatgatgaaatttgggttgtggcagacgcaatcatcaaggtggaatactttgtctcttgcattaggcctccatttccactggagcccttcttcaaatagtattccatatataaaagctactcagtctcttgatatctctatacagcctccagtttataacttagctctggtaaccacttgtcctacaactatatttttaggttcacttccttaccatctaacacatgaagatatttggccagatagagtatctacactgttaaatctccagcagacaagttgaatgtcctatccaccttttcactgtaatttgtctagactaattgtatattctccaaccagaatacccagttgcccagcaaccatggtttctacccttcattacttatttgtaccactgagcctacccaccaccaccactagcctcaatactattattagctattcactacctaaaaagttaccaacaggttctttaaacatatctgccagctaccttccaacaatctaaaaaacaatacaggcatatgatgaggtgggaaattatcccaataagaagttttgtctagctttccacttaacaggaataagccatctgctttgctgaatgccagagattcactattcaggacaaagaagccttcaaccctttcacactctagtttcaattatctctgtccccttagatccagcctagcttccataacttcctgctttgcctgacccatcaatgctttgccttttaccccacagtactacgcccattcccattaacacaaaatggggcactgaagcacaaagtacaagttgagcctcccaaatcccaaatctaacatgctcccaaatctgaaactttttgggcaccaatataacactaaatgctcattggaacattttggatttcagaactttgggtttgagatccagtaaatataatataatacaaatatttcaaaatctgagggaaaaaaacaaatttgccagactggtcccaagcattttgcataagggatactcaacctatatactcttcttcatttctgtcatcttcttggcttctgactcttggcctctatacaccagtgctgacactagaatttggccttcttcaattttatatacctctaggaccttggcattcttacaatgctggtggctttgctcacacattcacttgtttctaattgtattcatttcatttatgtgagcaatatatgaattatttaaaattcaaacacttcagataaaatcctccttgaccaacatctccaatcccaatccctcctccagaaataactactgttacatttaaaaggtatataactttgccaagtatccttccaaacctttctttatatacatacatacttatatacatacttacatatgtacctctataaatttggtcaatgtgtgaggttatatttatttatttttatataaatggcaacattctgaacatactgctcttcaattttttaacctccttatggtgtcttggatatctttctatactacacaatagctttacattttgcatatgactcagattatgaaggtaccagtttgtttaacaattttcctatctatgggcatttacattttctctactgttttcattattgcagtgtaacaatagtgaaagaacatccacatacatatcttattgtgaacattttaaatttattatccagtgccaatattaaaaactgaaaccattgtgtcatatagaatattatttaaaatgttaataggtatctcactcccacttataagtgatgggatcattgggatcccaagcctcagtgtcacataatatacacactaacaaaccttcatgtgtaccctttaatctatgaaaaatagttgaaactataaaataaaatagacactgccaaaatgtaccacaaaatacagctgtagtaattcacactcctgccagtagtatatcagaatatctgttttcccagactctccccatacatggtattgtcaaactttttttaattcaaaaaggtttaattataaaatgttgttttttaaaatttaatttttaaattttgaataattatacatattcatagcatacctaatgaagtttcaatacatacaatgtatagtgattaggtatagggtaattatattagggtaattagcatatccataatctcaaacatttatttatttctgtgttggggacattcaataatctccttctagctgtttgaaactatgtattattgttaactatagtcatcctacaatggtatagagaactaggactcattcctcctatctagctagaattttgtatcttttttcctaccattctggacataggccctggcaaatatttcattatgaaaatgtcaaaagcaattgcaacaacaaaaattgacaaatgggacccaattaaatgaaagtgctgcagtgaacatgtgattgcatgtgtccttttgttagaaacatttattttcttttggatctatacctagcaatgggattgctgagtcaacttgtagttcttttttaagttatttgagaaatctccgaactgctttccacaatggctgaactaatttacattctcaccaaaaatatataagcattctcttctctttacagcctctcaagcatctgttgttttttgacttcgacaatagccattctgactgctgtgagataatatctcactctggttttgatctgcatttctctaatgatcaatgacagtgagttttttttcatatgcttgttggccatatgtatgttttcttttgaaaagtgtccattcatctattttacccgtttttaatggggtcatttattttttgcttgttcaattatttaagttccttgtacattctagatattatacctttgtcgtatgcatagtttgtgaatattttctctcattctataggttgtctatttactctgttgatagtttctcttgctgtgcagaagctctttagtttaattaggccccacttgtcgatttttggttttgcaactgcttttgaggacttactcataaattgtttcccaaggccaatgtccagaataattcaacatcatttttaaatagtccatcgttttttcattgatttgaactgccaacttacagtaaattcccatataaacatgcatctatttctggacttgctgttctgttctctaataatatatatttttaatcccctttgtatctttggtcatgtctaccattttattcttaaagttgtttagctgtgtcctctatttttatttttcaaacactcttgtcaaaaccttgtctattttattggtgtgtttataaaaaggctaagtctgttttgtgctgccataataccacaaactggggagtttataattaacagaaatgtattggctcacagttcttgaggctggggaagttcaaaattgagagccaacatctaaaaagggccttcttgctgtgtcttcccttggtgaaacatggtaaatcaagagaatcagagagagagagaaccaaaatggggttggacttgtccttttaaaagaaatctactcttgcaaatagtgacattaatccattcataagggcagagctctcatggcctaaaaacccttaaaggtcctcctcttaatactattacaatagcaagcaaattcaaacatgggtttggttggggacaaacattaaaaccatataaatagcttttggtcttattgatcaactccatggcttatttatgttttatattttattaatctctaccaaatacaataattccctcttcctacttcctgttccttcaattttaaaaattccttgttatgtatggtgaaaagttccactccaaactctggggccactggaaccccatcccacagacaacagatttcaaaaaagactataacattttagcaacattagcaaaatgttactgttgtgtcatatattcaactcaaagagccagttgctatccagcactatgcttagcccatgaataagcaggaggtcgtacaggagactcaagaacaaagattatttagcaaagaatcatgattggcattatccattccctataacagctaagatatgagttagtgaagtctgtatgcccagaaatctcccaatactgtaggttatatggtggaaaattatgttgttaggagaaaaggaaaaattcaaggtgtggtaggtcatgaagaatgcaatagtaacatcgattattatgtaatttttctgggcctcttctccatctgctaaatgagttgattccttctattctcatccggatgtaaaactgtaagctttctggcctgggaagagggattatatgactattttgatgatcctttatttctagtatatttcttggcatgcaataggttttcaatgatcatccacagaataaatgaatgaatgaataaatgaataaagttttctaagcctttgagatacttttcaaggctgataaatcatggcatgttgatgaagggaaattattggacgttgtataccctgtaaaacctagtactgtgcctggcatattagaagaccttaataaatttgttgattaaataaatgaatgagtaaattaataataacagattcaggaatgtaactcattttccagttctagtactttaatggcaacacactttaaagaacttaatattgtctccccttctctctctctctttcacacacacagcataatattatcctctgtggtcattttgggtacagtgcc
